United States Patent 7,745,391 (HUMAN THROMBOSPONDIN POLYPEPTIDE) - sequence listing, part 62

SEQ ID NO: 209458 - DNA, 251 bp, Homo sapiens
tccccacttgccatttttgtttctaatgatccctggatcaccacataatcctctaacattgacccactgacctggaactaatgtagtagacctggatccactgactcactgatctaatgtagtctctactagtctctattagttttccttacttcaagaatgcaaacaaaatgtcgaatattatcccctaaaattaaagtaaaactcctgacaatgtttaaaaaacaggagtgtataactgtcattacact

SEQ ID NO: 209459 - DNA, 670 bp, Homo sapiens
agcgtgcagcctagatccctggcatgcacagttcacaaggttgacactcctataagaatctaatgcccctggtgacctgacaggaggcagagctcaggcagtaatgtgagtgatggggagcagctgtaaatacagatgaagctgccttcactggctgctcacctcctgctgcgtggcctggttcctaacaggctacagacaggtaccagtccatggcccatgggttggggagtcctagattatagtatttggacccaccattccaggagctcactgtgaaataaatgggaccgaatgttcttttagaatctcctttttctatttcttcccatctagtcctttgggatcctgaaaaggtcccagacttagtgaaaaggatagacagacattaggggcaggaaaaccatcagccttagtgaatcgtatccagcacccccagggtatattatcatggcacatactaagaagatgcagatggactttttgtccatcggtgagtctgagggtattcattatgtatttggaattgtgcttggcaactggaaagtagaaggaaggccatcttgggcagtgggggaagggcagcagccaccaaagcacacagggaaatgaatgcttttggctgaagacaggagaatcttgtctggtcatcccatccattgcaatgttt

SEQ ID NO: 209460 - DNA, 525 bp, Homo sapiens
ctgctctaattcctaaagctaattatatattaaggacaataatagtttgacgaacgtgttggaggttcctttttggaatttcctgatgagtaaatttctctctctctctctgagtctcctaatagccttgcataaatctctggcttacacagagttaatttatagtttttaaagcttgctcttaataatgctattggtaaaatctaatttaaagggctactcttggtcaagtctaggtaaggccactgttaaagttggagtagaatttcattatagtatctgttttctgtgtcctagatcctgtatatttttcttaatcaaatgaaagtataggtgaattaactcatttgtatgagcactatataaataaagctgggttatttagctttagagattatttagaggttgtaatcctctaaatgtatcaactctttggtactagccagacatggaatccacaaaaacaacatagaaaaaatatgaaaatgtttggggtttaaaaaaaatctaaacagtataagtaat

SEQ ID NO: 209461 - DNA, 288 bp, Homo sapiens
cctggccgccccagggcagcaagacccagtgctatgtagttctccaaagtcctatttactttagtgattctgattctgtatttttaactgggaaaaggattctctttcaggaaagcaaccacttctgatgctatttaggtattattctccttatacttataggagaaaaaattgatgttaatgaacaggaaatatttgccaaattatcacacaaataatttttgtatcattttaaaatactccttattgtactgagcttgttggtattttaataaaaattattggcac

SEQ ID NO: 209462 - DNA, 559 bp, Homo sapiens
atcatatgggtaagttttatatcttgggagtaaaacacactttgtaaggtgaaattatttaaagagttgtactacaggaaatatcataggtattaaatatctattatttgatttcatttattctgagaaggctagggaagttcagaggaacagaagaaacacctggaggcatactttttgatagaagatcctccagttggctatataaatgacctgaataagtatttcccaaatggtggtgtatattttatttgcattagactcacgtgggggagcctgttaaaatcaaagatttctgggtcctaatccaagagatttggattcagtaaatctgagttgaagcccacaaatatgaatttttacagatgctctagggtattcttatacaaatggtccaaactctgcattcttcaaattattcttctgcatattgaacttgacaatcatggctaatataaaactgctttttaaaaaggtatatataagaatggtttaagtttgaaggcaaatatgtattttatatattacatacttcccagattaaaaatttgagtacatc

SEQ ID NO: 209463 - DNA, 116 bp, Homo sapiens
atgaggtaaaccctataaaatttattgattgatttgttggagagaattaatggtgaaggagtcaagaattacattatgtttttctctttttttttttttttttgagatgaagtctc

SEQ ID NO: 209464 - DNA, 612 bp, Homo sapiens
tcattttaaaatttttcattgtgtgtatacaaatacaactgatttttatacattgaacttatatcgtgtcaccttgccaaatttattagctttaatatgtatgtgtgtttattatttagggttttctctatataaaattaggtcatctgtgaacagagatacttttacttcttccttttcagtatggatgcattttatttcatcttcttgcctacagcattcttttttgccctggctataacctccagtaaaatgttgaatagaagtggtgagaggtagacatccttgtcttcttcctgatcttaggagcaaagctttcagtctttccctgttaagtatgatgttagctattggtttttcatggatgccctttatcaggttaagaaattttcttttctgtttctaatttgttgagaatttttatcatgaaaagatgttggaatttgtcaaatactttttctgcatctattgagatgatcatgtgggtttatgctaatatgctttattatgttgataaatttttatatgttggaccaacctcacatttctgggataaactctacttggtcatggtgaataacccctttcatatgctgttagattccatttgct

SEQ ID NO: 209465 - DNA, 595 bp, Homo sapiens
caccactaaatatacactaaattttccaggaatgtaactactatgtaaataagggaaagattatactttgttttgtgtagaactttatgaagatttattcaccattttagaaaatcatatcgccagtggcattgctacatatctgagtgaccaacacaatacacctgtattggcctctatttataggtgtcatattcacacaaataaagccacgtgtacccacaagcacctgatggctccagtttccaatgtgctgtgagcatttacatttgtcttctgagaatttacacagaaatacatattttattaccataatgttccttttatttttctttcatattacagttaagactttgtagacaggtcagtagattttatctgggaattttatttcaggatattaaagggagtcacagggtatgacagggttgagaactagttacaaaccatcagtctattgttaagaactgtaaagagaattctaattcctaaacttggtaactattcttttatactactcacttcatcaataccacaagttgaataatatacttaactaaaatgtaaaagaacgaatgaaagaaacaaatgaaaa

SEQ ID NO: 209466 - DNA, 320 bp, Homo sapiens
tccgttaatctgactggccccaacctgggcagaaaaggaagggcggtttttctttcttttcttttcctttttcttctcttttctatgtatgtatgtatgtatgtatgtatgtatgtatgtatgtatgtattttgagatagaatctcgctctgtcgcccagtagatggagtgcagtggcaccatctcggctcactgcaacttctacctcccgggttcaagtgattctcgtgcctcagcctcacgagtagccgggattacaggcatacaccaccacgcccaactaattttcgtatttataatagagacgggatttcaccatg

SEQ ID NO: 209467 - DNA, 534 bp, Homo sapiens
tatatgagagctattttttttcattagtcttatcattaaacacatttcttaagtacctactaggtagtaggctttgtgataagcatttaaaaatataaccaaattatgtgtttcccgttgaggaattccctgtcttgcacaatgatagttacatgtattgtaaataaacatcatgaaatttggtagagtgcttgtgcatgttggcaagaagaaaaaatgaactaatatcatcctttataattcagctggatgtccttggtataagaggttgagagcacagaaaacaaagtttcaaaccacaactgtacattgttcagtctgagattatcataatgattgggttctattaactatttggttaagatgtaaaattatgtaatagtgtggtgagaggaaaaatggtggattaaggaacttaaaaattttgtcccttcataaaggtagcaataaaactggccttcaaaaaatgatcaaagtcaactttttcaggactcgagaaactaatcaaaagatcacagtaacctgagttactta

SEQ ID NO: 209468 - DNA, 580 bp, Homo sapiens
caagaactctgggaggccgaggtgggtggatcacttgaggtcaggagttcgagactagcctgaccaacatggtgaaaatccgtctctaccaaaaatataaaagttaaccgggtgtggtggcagatgcctgtaatcccagctactcgggaggctgaggcacgagaattactcgaacctgagaggcagaggctgcagtgagcggagactgtgccactgcactccagcctgggtgacagagtaagactctatctcaaaaaaaaagaaaaagaaacaaacaaatgataaatgtttagagagggggatatggtaattgccttgagttgatcactatactatgtacacatgcattgaaaccccagaaatatacacaatacattgtatcccagaaatacatgcaattattatgtatcgattataattttttaaaaaaatttttttaaaagaaagaaaggcttaggattccatctttctataagggatacgtatagggtagaaagcttctcactgcagtgggtgatgtattgccataaatgggctgaacaatgttttgcccctgtgaaggagggcacaataaggctgt

SEQ ID NO: 209469 - DNA, 401 bp, Homo sapiens
cagctggggtgggagtaggtttggcctgaaggccatgcctgctaactcctacctgaggatacagggctagccatttaattttggtttaaaaaatccatgcagaggctgggcatagtggctcacgcctgtaatccccgcactttgggaggctgaggtggtaggcagattgcttgacctcaggagttcaggaccagcctgggcaacatagtgagacctcatctctgcaaaagaatacacacacacacaaaaaaattagccaggcatggtggcacgcacccatggtcccaacaactcgagaggccaagtcaggaggatcacctgagcccaggaggccgaggctgcagtgagccgagatcatgccactgcactccagcctaggtgatagagcaagaacccgactc

SEQ ID NO: 209470 - DNA, 770 bp, Homo sapiens
  misc_feature (209)..(209): n is a, c, g, or t
gatcctggttttccttgaccactggccctgggacgtgggtgcatggactcgtaaagctgctagggcccctagaaaccacctgggttcagcctctcccacaataagagttcttgcccttcataccctctacctggatggatggtctttgggcagggaattaatgacagaatgagcagtccctaatggtattgggcagttgggagtgagtntaggcagcttctctgtaaccgcttctggggccacaccccaaaactctacaccctctgccccagaacaattctgcagagtggtgaagttcacttccccaactcttctccaagtctagctttcctttccttctggctccaaggtgctctgtgtccgtctgtgtatgtgtgtgtctgtgcgtctgtgtgtttatttggggaaaagggcaatcagcaatcaactgaggtttcttaattgtgattatattcctgagaatgaatgagtaggaaaggaataaggatgttgttatgatcgcctgtggattttgtccattcatctcatgctctctgaacagaaggtatacctgggaagataccagctttttctctcagggttctgagtcagaggacaccatccaagaatgttgttagcttttcagttcccgctctgcattgcctgaaaaaactggtatgttgcacgtatgcttttggttgaaattgaacatactctagtgaatgtgccttaaaaatcaagacactagttcagaggaagcacataatgtccagatctatggcgaacacagg

SEQ ID NO: 209471 - DNA, 305 bp, Homo sapiens
ttatgaatgaatgaccctttggttttcaaagggactgcgttattgatgtgataccttccatttatcttttcttcatgtgaactcattcactatcccatgatagtgatctgatggctttatagtgggcctttcccccttttgcttggcgcttctccttgccactgccgtgtgaagaaggacatgtttgcttccccttccaccatgattgtaagtttcctgaggcctccctaaccctgcacaaccatgagtcaattaaacctctttctttgataaattactcagtctccattatgttcttatagcag

SEQ ID NO: 209472 - DNA, 388 bp, Homo sapiens
atcatatcagtggatacaggaatataacagaacgttatttgatgtagccttcttaagccacaggggtttttttgctgagaacttaagaggtcaagatatcccgtcatcctatcctaacccctgcccccattttaaaagattttctctcataataggagtaatacacattgtgaatgtatttaatgccactaaacagtaaacttaaaaatgattaagatggtaaattcttaaataaataaaaatgcagaaaattttaagaagtcactggatacacggccatgagcttttccctccttcatccaacaggtttttaacactttccccatgcaggaaaatgggctttaatagtggaaagcaaaatagtctcatttatatgaaggagaaatct

SEQ ID NO: 209473 - DNA, 414 bp, Homo sapiens
tgtattctgttggcgttctgcaaaaaggtggtcagacctgcagtcaggggaacgatgtttctgtcgatgacggaccgtgtatatgttggtgatcgcagaacatactgtattttcactatatcttttttttttaatctgacaaacttttttgcttttattttaattgacataattgtacatattgatggggtacattgtggtatttggaggagtttgagaccagcctggccaacatgatgaaaccctgtccctactaaaaatacaaaaattagccgggcgtggtggtgcatgcctgtaatcccagctacttgggaggctgaggcaagaggatcgcttgaacccgggaggcagaggttgcagtgagcagagatcgtgccattgcactccagcctgggtgatagagcaagactccat

SEQ ID NO: 209474 - DNA, 1250 bp, Homo sapiens
ttccgaaagatcagccaggtcacagtgagggtcaaaggtgagccacgggcctcagcagctgctgagtggatggtgcgtgggactcaggaagtgacgttctctccccgcccagcccccttcctcagtctattgctccgaatcctggaccacacactgcgtgctgaggctccatcgctgtgctgggtgaggggtggaggactgtccagctgacagccacccaggaggcctgcccaggagacccagcccagcctctccttggaacctgaagaactccaggcagctgatgggacactggggcccaggtcagcccctccccttccctgaggttgcctgaggacgccttcactgttctagagaaggaggccctccccatggctggggacagtcacagcagctgcagacagatgatgggagggagcattctttccctaaccctagaggcgggcgagcattcaccaagtgttgttgttaaagaaaaaaagaaagaaaaagaaaccaggattgtacctgaggtcaggcagacagtgctcaactcagcactgggaagattgctagaagccttgggcctatctaggaagactgggccaacatgcgatcccctctgcaaggtggaggccatgcacctgcctcctgctcctgagctccggtatcctcactgtgacccaggccccactgcagcaaagagacactgggaattagcccttctgtcccctccttgccagaaggtgggaagatgtgttggttgagggcctagaatttttttcatccccaaagactttctttttttaatattattatactttaagttctagggtacatgtgcacaacgtacaggtttgatacataggtatgcatgtgccatgttggtttgctgcacccatcaactcgtcatttacatttggtatttctcctaatgctatccttcccccagcccccaaacccctgacaggccctggtgtgtgatgttccccaccctgtgtccaagtgatctcattgttgaattcccacctgtaggtgagaacatgcggtgtttggttttctgtccttgtgatagtttgctgagaatgatggtttccagcttcatccatgtccctacaaaggacatgaactcatactttttatggctgcatagtattccatggtgtatatgtaccacattttcttaatccagtatcattgatgaacatttgggttggttccagctctttgctattgtgaatagtgccacaataaacatacatgtgaatgtg

SEQ ID NO: 209475 - DNA, 584 bp, Homo sapiens
caaatttaatcttttaagacaatcttataaaacaaaggccacctcccccatgtcatttatatataatcttcatttttcatgaggtaatggaagctggagagttggcccttgaccaaagccttgcagctaacaagaggacaagcctcctgccccacagtgtttcacagccagtaccccaagctcctgaattcatctgtctaatgtgtaatatatttataaacactctacctgggatgtatgcgtaccttctactatggactgttgttaaagacaagtaaatatgcaatcgtggtctttcaataaactaaacggatataaaaataaatatagaatacagccagaagatcaaaattgacatattatctatttatgcttataatatgtaattacatgtaatattgtaaaacactttctaccatttcataaaattctgtgttgttatttagcccagaattcccttgcaatcttttaaaaatagtatctaatagggcttttaatataaatgtcgtagtgaaactgttttatgtactgtaacccaaacatttctacgtagtaacactgttccatatagaaaacaaatatga

SEQ ID NO: 209476 - DNA, 306 bp, Homo sapiens
ccataacattttggggaggagagggtgttatgggctgaattggctgtatttagggttaaggtctttaaagagtatgaggctatgaatgtgggccctaatccaatatgactggtatccttataagaagacaaagacaccagggatgcacagccacacagaaaagaccatgtgaggacatagtgagaaagtgcccatctatcagcaaaacaaggaaaaaggcttcagaaatcaaacctgctgacatcttgaacttggacttctagtccccaaaactgtgagacaataaaatttctgttgtttaagcta

SEQ ID NO: 209477 - DNA, 216 bp, Homo sapiens
tggtttctctatgatcagcccctgggatacagatctgtcacgttacaggcttgttaacttgctacaggactaaggaaatcagtatttattctacatcagaaagacaccaagagttaggagaaaatagcgcagtcggagaaacacatagatctatgagtttgtaacttttccaggccatacacgtataaatgctgttaatggttcgcattttatacc

SEQ ID NO: 209478 - DNA, 900 bp, Homo sapiens
ttcctggggcctctctcaagcacgaggttttgaagattatgccggtgcagaagctgacccgcgccggccagcgcaccaggttcaaggcgtttgttgccatcggggactacagtagccacgtcgatctgggtgttaagtgctccaaggaggtggtcactgccattctcggggccatcattctggccaaactctccattgtccccgtgcgcagaggctactgggggaacaagatcggcaagccccacagtgtcccttgcaaggtgacagacggctccgtgctagtgcgcctcatccccgtgtccaggggcactggcatcgtctctgcgcctgtgctcaagaagctggtcatgatggctggtatcgatgactgctacacctcagccaggggctgcactgccaccctgggcaaccttgccaaagccaccacctttgatgccatctctaagacctacagctacctgacgcccgacctctggaaggagactgtattcaccaagtctccctatcaggaattcactgaccacctcgtcaagacccacaccagagtctacgtgcagaggacccaggctccagctgtggctacaacatgggggttttatacaagaaaagtaaagtgaattaggcctgaaaataaataaataaataggtcaggaaaatgaataaaggggaaaacaaccaaccaaccttttagttacagcttgattcttatttcccaaactatcatagccttagttttacaaaagagaggctgaccttgattgtgcctcacttaggaaaatgactaccttatgctagttagagaagtgataagtctccaaggttttataaataacaaaagcagattaaaaaaaaaataataaaagcctgtattttactcctaatggaagcacattgaaaaac

SEQ ID NO: 209479 - DNA, 528 bp, Homo sapiens
atgtcacttagttcagaaaacgatcttgttttctttcataggaaaactttcttcccagcccacattattggctccctaagtcaggggttatagaaagaaatctgaaatccactgctgcagagagcctgggacattgtctatgcctccctgctttggggcaggagttaggggtgtcctgggcctctacctgtaaatgaggatcctcctttcacagttccagccttccccaccccaccttggccaagctagaccagcggttctctaaacgtggtccctggaacatcagcagcagtatcacctaggaacttcttagcaatgcacattctcagaccccattcccagccctgctaaatcagaaactcagtgggtggggaccagccatctctgttttaacagatgttcccgccagttctgacatgcacaagtttcagaactgtgattccccaaatgtggctttcactaataattttaaaaaaacaaaaagtttaagtaaattaatagcatgttgctaacttttaacttgggcca

SEQ ID NO: 209480 - DNA, 407 bp, Homo sapiens
tggcccagaccccatctctttaaaacaaaaaagtacatgggataaatggggaaaacactcttgagacaagaccaaaacatacagtggctgctaaatgtcagtgccatgagcccagggttctcctacatccccttccgtggtcagggaggactgctgggctctgtgtcttctgtgattctcccctggctctgagccctttgcacctgcaactcacagcgccgctcaggtccctgggggtaaagtgccataggataaaagccacaggagggttttgaaatgctcttttcctctcagataggtatttccgcatctttacggagtctcatcaacgctttttaaacctcccctgggatttgaaccagcgcccatagatacaggtggcttgtcaggtcagctaggtgctgcta

SEQ ID NO: 209481 - DNA, 317 bp, Homo sapiens
gaggacagtggggcactgggcctggcccatgaaaccattcagtcctcctaggcctctgggcctgtgatgggtaaggctgctgggaaggtctctgaaatgcctttgaggccttccaccaccccctggtggttttggctattagcacttgcctcctttttacttaatgcaaatttctgaagtctgcttgaattccttccctgaaaataggcttttcttttctaccatttgccaggctgcaaattttccaaacttttatactctgcttctcctttaaatgtaagttccaacattaggtcctgtctttgctcatgcatatg

SEQ ID NO: 209482 - DNA, 489 bp, Homo sapiens
agcattagtattttcccatctgacgttacaaactatgctgcaatgaagagccctgtgaccatatcatttcacgcatgcaccaagttcctggacgtggtgagtggttttggaaaatgacgaaggttttgccacacttgtgattttgagagcaattgcaaaattacctctcgtagggctgtaccagtttacacccccaggagaaacaatggggagtatctgttttcccacagcctcatcaactccatgcattatcaaactgttttatttttgccaacctgagaggtgaaaaggtgtgtggtcgaatacaagtggccatgagttctgtgcagctccttccatcaagagatagcgtcgatcctcctcctttcaaatctgagctggtcttgtaacttggtttggccaatagaatgagacatattgatgtcccatgagttctgagcctgggccttgagctcctggcctcaagaacttgcagctttgtcagggcgc

SEQ ID NO: 209483 - DNA, 692 bp, Homo sapiens
  misc_feature (678)..(678): n is a, c, g, or t
  misc_feature (681)..(681): n is a, c, g, or t
gcctcggcctcccaaagtgctgggattacaggcataagccatcagacccagcctggctttatttttttaattgtagaatttgcactcatatgtatcagagagttaactattaagttcctttgttttctgctcatataccagggacagggaatttttggataaaggtgctagacaggagaaagctgtgagttaagaaaatagacacaattaagtgaaagagtcccatcttctaaagtaacatctttgctggaagtgaagcctgggtcctggaaacatcccctctgtgtgcacatcctcaaactgcccctcctgctgtgggggtgctgttttctatgttgctgtagctcatccttgcaagtttcctaatcttcaacgtggaacaaggagttacttagttttcaagtggcgagataaggaagcttctgctttccaggtcagcacaaattaattaatgctggcatagtttctaggataacataagtggtgcaagagtcactttgcttgcgatgctcccttgggagatcaacatggtaagtacaaagatgactgagcttaattaaatctaaattctgaatgactcatctcactatgtatttttttctcaacgtttccatcactggccttcttcttgatattgcttattccctcgtgccgttcgcacgaggggagggggagatnaancctcccccggg

SEQ ID NO: 209484 - DNA, 137 bp, Homo sapiens
ttaagaaccaaaagcccaagagagtgttcttcacttttacgtgtacattgtccgtggagacctgtagacctgacctcggggtactaagccacactctgtggttctcgcctctgcatttgctcattttcaccctctct

SEQ ID NO: 209485 - DNA, 408 bp, Homo sapiens
atggaccttactgagtcacagaaagacaccttcaaactatcagctctgtggtcttcctggggtaacagagatagggatgctttgtaaaataacctatctgtggctatcttctgtcttgcctaaccttatctccatcacttcccaagaactcagcccttgactaatatttaacctttcaccttcacagtaatctttcagaaacaagaagaaattctgagaatgaggtggggataggcaggctgcctgtgacacctaatctccttggaacaatggctgcaggccccagatctggcccttcaccctgcagttgggtgatcataccatgtgactgaggggaaagagggtatcagtctcctggtaccacaagacagcttccctcacagcaggctgaaacctgagcctccaccc

SEQ ID NO: 209486 - DNA, 490 bp, Homo sapiens
ggagaacataagcctattcacatattcagtacactgctactacaaccagcatttgagaaacacattaaaactgtctataaccaaggaattcttatagagtgcttaccactaaaaacacttagaagcaaagccaaacaaccctactcaacaaacattatagtcatatctccaaagggaataaatatggcctttataagcaaaagtaaatttaaaaataacaagagaaaatatctccagatgaggagaaagcagtgtaacaattctggaaatatgaaaaaatgtgggtgttatgacattcccaaacaagcacaccaacttggtagcaatggatcctaatcaaaatgaaatttttgaaataccacgtaaagaattcaaaacattaattttaaagatactcaatgaaatcaaagagaaagctgaaaagcaatacaaagaaataaaaaatcaattaaggatataagtgagaaatttaccaaaaagatagatatta

SEQ ID NO: 209487 - DNA, 531 bp, Homo sapiens
aggtggggacctcaggcgacggcagctgggtgagattcagctcacagtgcgctatgtgtgtctgcggcgctgcctcagcgtgctaatcaatggctgcagaaacctaacaccatgtaccagcagtggagctgatccctacgtccgtgtctacttgttgccagaaaggaagtgggcatgtcgtaagaagacttcagtgaagcggaagaccttggaacccctgtttgatgagacgtaagtgggctggtggcctgcctagagtgcctcacccattcaagtattttccaagtacctgttatgttgcctggcagcctgccagatgctggaaggggctatggctgaacaagacaacatagtctatgacttcatgaagcttctgtacgttagtggggaaaatggagtgccagagaagtttatcaaaatggccacctacatttactgctcatagaggctaaagtgttcctgaatatggaatgttccctactctttctgtttaaatgaagtctctctggtagtaaaaagatttgaatgttc

SEQ ID NO: 209488 - DNA, 595 bp, Homo sapiens
  misc_feature (175)..(175): n is a, c, g, or t
taaattcagaaatccagtgaggtgattgacaaaccacacaagttttctgtttgctgtggcgggtgctagtttgctttagttggctggctctggccataataagacaatagcgtgcactgctgctgccctattcgcaggagcagacaactaaggtgctaatgaaagcacacccggnctttcgtgaatgaaagtcacatgacttgttctgtttcctttattgaaagagaaacctttacaaaaatagtacttcatagaaggaagcatagtatgtggaacactaaaccaggaatcaggaaaccaggtttctagttgctgatcttaatgagtcattgtgtgtctatgggagagccacttaatcctgccttctcactttccctgtctgtaaaatgggggtaattataatcctcccctttctgtgtcacaaggccgctggaaggtaaatgaggtcataaacatcaagagtgttttaagctcttctaaaggaagatgctaataaatccagttgttgatacttattgctttgaaaccatgaatgtatacaggaaagacacttttgtaaatgggtgaggtgtgtttcacaaagtgtgctttcaca

SEQ ID NO: 209489 - DNA, 804 bp, Homo sapiens
gaagggaggtatcatacaagattaagggagaccttaggctgtttataggcagaggggaaggagccagtggaaaagaagatgtggtatagaagaaggggacgaatgactgggtgtgctttggagaaaacaggaggagataatattctgaaccatgacaatagaaagatgtaaattagtgcttctcagactttcatgtgcatatgaattacttggggttgagttaaaatgcagattccgattcagaatctggagtttcgggcaggtctgagattctccatttctaacaagctcctacctaatgttgatgctactggttcactgaccacattctgagtattaagggggtaggacaactcttcctttgtcatgagaagtgcatctagaaataagtttggtagtaaagggaagagaaattgttggagttgttgctacttgcatattgaagcgacctgacataaaggtagcaggtcgaatagaaagaaaatcaagtgagccaggtgttcaagttctcagtgactgttagcaggtatatgtccctgggaaggctgctggcaaaagtaatgatagaggactacttattaaagaaaagtcaagaggatgaagataagcagaggatagagtagggctgagctgggtgagaggaataagagaacaatcagaatcataatactttgggagtaattatagataactgggatgaaggaagaaaagagttgagaggtaaacaggactgacatgaacaggcaagaactctgctgaaaccagataaatttcttaggtcattatttttaaatgatttgacat

SEQ ID NO: 209490 - DNA, 274 bp, Homo sapiens
  misc_feature (8)..(8): n is a, c, g, or t
  misc_feature (26)..(26): n is a, c, g, or t
  misc_feature (31)..(31): n is a, c, g, or t
  misc_feature (103)..(103): n is a, c, g, or t
tcgaggancctttgctattaaaaaanacagngcttgtcatattactggtgataagaaagtacttgtcgagccgggcgcagtggctcacgcctgtaatcccagnactttgggagagattatttgaaagtgggattgtttcataaatccagaaaaatatgctaattttgcatacaatgtaaggaaaggtgtttttttaagtacctctctaaagtgcttaatcaagttggaacctttgtgactacgacaagagtcattctgctcccagcacacgcga

SEQ ID NO: 209491 - DNA, 333 bp, Homo sapiens
agagagacacccaaagacagagatggacacccacagatgggagagatacccacagacagagagagatacccacagatggcgaaagacacccacagacagagagagacacccacagacagacagccatagagagaaagagacacccacagatggagtgctgtccccctggtgccagtgagaaagctgaggctgggaatgggtcagcaaccgaatttcagtttacaggcgtatttggtcgtggacatggtcagccacctcagtaaaactggtgagggttattttgcattgaataaacttataagcagaaaaaaaaaaaaagaaaaaaattacaag

SEQ ID NO: 209492 - DNA, 520 bp, Homo sapiens
agaaattgatgcagcttttatgacttacctacccatcccctatttaaacttgcagaaagttagagtggaggcataaaaaaataagaaaatattttggagtagctaggtacctggaaaaaatcaatgagttacttagtctaatttttaggtgaccagagcctagaatggtaatagaataattttctgcagaaaggacatttaaaaataatctgtttttgaatgccagacaggaattattttgtagcaatcagttttcaactgttgttttcaaagctcctttaccaggggaagctgtctgatcatctcccatctctagccagtttcaccctacatcatgagctgtctttgcctttccgtacaccattacatgtaactcttgccctaagttgttccatgcatgtaaacaactttttcctcctgcttttcacacctcaactcaatcttcaagttttgatttattttcacttgattcctttatttagtctcccattgggttataatctcatcaagagaagagagt

SEQ ID NO: 209493 - DNA, 333 bp, Homo sapiens
tgtgcaggtttcacggacaggccattacttcagtgaaccccaatttcttcctcatccattacctatctcaacataattcttcatgaaaacacacatgctctccctgctgatcacgtccagctaatctcacaaaccctaaccccttctacaaagcaacaatgcctttccgtacaccattacatgtaactcttgccctaagttgttccatgcatgtaaacaactttttcctcctgcttttcacacctcaactcaatcttcaagttttgatttattttcacttgattcctttatttagtctcccattgggttataatctcatcaagagaagagagt

SEQ ID NO: 209494 - DNA, 538 bp, Homo sapiens
gagccacaggaggaggggagaggcctggaggacaccaacatgaacaagttgaaatcatcgcagaaggataaagtttgtcagtttatgatcttcacacaatctagtgaaaaaaaccgcagtaagttgtctatctcaaaatgactggaagttagatgttgcaacagataattttttccaaaatcctgaactttatatatgagagagtgtaaaaggatcactggaaaggaagaagttagaacaactgtacaatagagacaaagatcctcaaaatgagaataaaattggaatagatggtatatagcagttctgtgatggcctggcactcaatccagccagcattagtgtgttgattattgcatggatgttcagagcagcaatacagtgtgagttctccaaacaggagttcatggatggcatgacagaattaggatgtgacagcatagaaaaactaaaggcccagatacccaagatgtaacaagaattgaaagaaccaggacaatttaaggatttttaccagtttacttttaattttgcaaag

SEQ ID NO: 209495 - DNA, 883 bp, Homo sapiens
agcttcctttaggatttcttgtgagacaagtcagcttttatttgtctggaaaagtctttatctcacttttatttgtgaagaactgctttggcagccgtaccctcaagaactgcaccttccaaccacccttatatgagcctgctccaaaaccttgccagccagcacttccaggttacgactattgacctccagctcccagtttcagagagttctcccagtctcctggatcacactggtcggaaagctgtttggtagacaaccttcgagtctttctgccttcatactgtgggtataccgttctcccaactgaaaacccgtttattttcttatctgtctactcaaagcctaaccaacaccaaatggcctagaaatgccacgtacctaccagttgcctctttcctcctccagcccttgtgaatgtgaattcacatctctgttctctgtgttccttggccacttagtaccattcacaatatctctcatagctagctctctgccttagggctggcccatgggactaaaattccttgtggtaggtatttttttttcatatttctattcttatagcatctagcatagaacaaacagcctagtatctagtgggtatccaataacaacttatgcaggtgattaggcaagaaaaagaaataaagcctattcaaattggaaaggtggaagtcaaattgtccctatttgctggcaacataatcttatatatagaagaacttaaacactctgccaaaaatccattagatgtgataaacaattcagtaaggttgtattgtatgtatcaaaacatccctatgtaacccatagagatgtataattattttatgttgatcaaaaataaaataataaaagctcttaataaaacagtcatctc

SEQ ID NO: 209496 - DNA, 444 bp, Homo sapiens
tgccttaaaaggaaaactgttgctaatgcataggatttattcttttcctagttcttctggtgcgctctgaaatgttgataattatgttgacttgcagctatgacttggttcagctgttttgattttcatgttatctcactaagttatcaaaaatctgttccaccctccaatctctactccccttcagaaagaaagagtacatgcacttatggtgtatatctctttctttgaccttaaaggattaaagcaaaaataacacattagcttacagacttttgatttttttttttttttaatttggaattaatactaatgagactttgagaattgtattggtggctaccattcctttgctgattgttttcgtactacagttcaattttgatagtttgtgcaaggtattattttctttccatacaaatgtgttgaacagaaaaagtaaaa

SEQ ID NO: 209497 - DNA, 993 bp, Homo sapiens
taacttgtttaggaaacctaagtctgttccctttttggctggggttaggtagctctgaaaggccggtcttcatcaggacctcagatgagcacccaaactggggcttccattcaaattgggtcaggtgaaggttttactagaggggagaaatatgatagtatgatttttttaaacaggtgtttaaaacttatttccagggttttgaactttaattctgttctatgtatctgactcttcaatgtctcaggaaaacactgggtgtttaaggagatggttttaggattgcttcaggttctggaaaaattagtggagttataactcccattcagttagtcatttcctatataaactctatgagatgtgctcaggttgctacagatccgaacttaccccggtgcaggatctgagatggttgatctggcagccctggttcgagcttctctgggtgagcaggaagctctgcagggaagaggcttaatcattaattttctgcagcctcatgccctgcccctctcgacagtctgcctacatttgtgtggtctgaagagtgcggttctgtaatgcgttgggggctcttaagccagagaaccatgtcatgagggccagagtggagcagctctgactgccttcctctcccactgccttgcctggccttggaggtgaggcccagcacagatgggctctagggggcggtgccagctttgggataatggtccatgtgaacagaactggggcagcccatcagctctggggatagtcactaatagtgagtctggggcaatgaggaaggtccggtgtggtgattttcctgaaatagtccaggcattgacctggtctctcatggaccatggatgatctcacacctcatcaaatccaatggggtcccaatgagcatatcctcatttggaactgttgactgctgtggaagagaacaaagaaatgacagcagtcatcgaccctgtgcttcccatgtcaccctatcactacccatta

SEQ ID NO: 209498 - DNA, 227 bp, Homo sapiens
cattgtgcattgcactccagcctgggcaacaagagcaaaactctgtctcaaaaaaaaaaaaagaagacgacgacgacagatgccataacagctcacaggagaggggtgacaagagttaggggaaggggtgaataagagctgcctcccaagcactggaaagtgagccaggacaggtatttttggttttgtctgcacacctggaggtatattcattcagttgagcacag

SEQ ID NO: 209499 - DNA, 188 bp, Homo sapiens
cctgtaatcccagctactcgggagtgtgactctgtctcaaaaaataaatgaataaccctgttttcccatctgccaggctttctgctttcagtccaagccctctgtgccacaggtctctgcccttcctcctgagagccctcccagctcctttggacactgccctgatcccacttgtgatgtgctgtcac

SEQ ID NO: 209500 - DNA, 317 bp, Homo sapiens
aggctgccaccagtgccatgctgcatggctaaaactccaatagacagcatgtagtgcttgggtgacagactttgggacaatcacagccactacaaagtgaaaggggagaatccagaaagtacagagccagaaagggagagcccctaaattctatgtaaaaactgcccaaatctttggctgaccactgaactatgcatgcatggggcagacgctaagcaacctagctaaggataaaataactaagccgagaattgaggtagtgcctcgattcagagacagagtttgtggttttagctcaaccaagctgaatgttggca

SEQ ID NO: 209501 - DNA, 439 bp, Homo sapiens
aaataagggacttttaatagcataacaaaaatattgtcacaattttataaaatatacagatcaatttttaaagtttgtacttccatattaactgatgaatttagtattttaccaacttttttggcctggtttcccattaagaataccgtctttgggccaggtgcggtggctcacggctgtaatcccagcactttgggaggccgaggcaggcggatcacgaggtcaggagttcgagaccagactggccaacatggtgaaaccccatctctactaaagatacaaaaaattagccggtgtggtggcgcgcatctgtaataccagctactcaggaggctgaggcaggagaatcgcttgaacctgggggtggaggttgcagtgagccgagatcgtgccactgcactccagcccgggcgacagagtgagactccatctccaaaaa

SEQ ID NO: 209502 - DNA, 277 bp, Homo sapiens
tctcattcaagctttaaagtctgattctattattcctcctttaaaattgaaattctctatcattagacccttcagaaattacagtaggagttggtggtttgatataggggaatgagtacctaactcgtatttaacatgtttttttttttagcactcagcatattggcacagagtgggctctcagtgagtgtagaatgaatgggcttatcacttgagttcaggttctagctctctcaccaactagacaggtgaatttgagcagttttaacctttatat

SEQ ID NO: 209503 - DNA, 635 bp, Homo sapiens
cagggttctttgggaagcttcaaaaaattcaaaagtcatagtgccttttttcatggaattcactaagtagagacttttttgtaggcatatcattaaatgctggactctcaagttttcgaaatgagaagtctccatctgggaggtataaaaggaaacccccatctggttggttttagcatcttcaaggtgaggatacaattcttaaaattgtctacctatttctgagtcctggttcaaattcctttgtgatgtctatgtcagctgggaccctgtaggccccactgagttgcacatcaccaagtgtgcccatcactgtggttagaggccgtgggctgtgtactacagacaatgctgtaattgcttctgtgaccaagtgagggcggagtttgccctttatgtgatgtaggcaatattctatttttaataagccagaaaaatctgttcaaatccagtaacttcaagattttccaaagactggaagatgtggaggacgtgggcatcagctggaatctgatttctctcccctccacacttgctcttccccatttctcaactgctgtctcccagtgtaattaccatctcaagcattttctgttcgtcccctgtaggtacaccacatcgtgccaacaacccat

SEQ ID NO: 209504 - DNA, 478 bp, Homo sapiens
agagagacacaggaatctggggaaaagggcactccacagaatggagggataaaaggagtctctaggatattagtgaagggagttcccaagataccagctgtacagcagtgctagtaagcaatcagttcagattggagcaaatcagaaggctccaggagaggagagacgtttaacaatagaatagctaaggtgttgaataacccaagagcaaatttactcaattgggggacatttaggatatatttctgataatgcagcaatgcaaaaacccaattattacctctggtgggttgcgtgcaggaaggaaaatgtcatatgacaagactcagctatgaagaatatttgtataattaacatttaaacattagataattgagctaagcaaaaatttttcctgaagtatattgggagagaagagggtgtgtgaaagagctgtatcttaatcttctgtgtcagaggcaggtaacactgaaaattg

SEQ ID NO: 209505 - DNA, 1156 bp, Homo sapiens
caggcatagagaaaaggccatatgagtacacagccagaaggtgtctgcctacaagacaaagagggaaaacttacctgaaaccaaccctgatggatattggatttctaagctccagaactgtgagaaaattaattttatgtgctttaagacactcaatttgtggtattctgttatggcagcctatgctagtcaatttgcattaccataaagcaacacctgagagtgggtaaattataaagaaaagaagttgaatcggctcatggttctgcaggcagtacagaagcatagtgctggcaattgcccctggcaaggggctcaggaagcttacaaacatggcagaaggcaaagggaagccaacatatcacacgtaagctcaggaagcttacaaacatggcagaaggcaaagggaagccaacatatcacgtggcgagaaagacagagaagcggtaggtcccagactcttttaaacaacaagacctcatgtgaactgaggggaaactcactttcaccaaggagatggtgctaaaccactaatgagggatctgtcccatgagccaatcacctcccaccaagacctacctccaattttggaaattatatttcaacatgagatttggaggggacaaacatccaaaccatatcccagcctgagcagactaacagagtctctgaataaatctatgaaaatgactagagtattattttgttgagtgatttcttcttgtattaggattggtctccttgaaaatatttttctcatatctgttataataaaatactgagaatcatactaattctactctaaacttagatatttaagagggttggatttgactgattgctctgatgttgctaacatagtcaaagacttttcaaaactaaagtgtaatattatgtcatgcaaccttgagaaaattacaatggacaaagcagaactataattcacaattcatctcccaaacaaattgtgacaccccttctttcctatccactgaaatatgcctaaaatgagaaaaaagggaaatcttaaaaacaacaacaacaacaacaaagaaaaaacagaaaacggcaacattcaggcaaaaaagaatgtgaggactatgatgctggcatgctaaacttaattaataataaatgagagagtttggaatgatta

SEQ ID NO: 209506 - DNA, 236 bp, Homo sapiens
gcttttctgcgtatttcatgattgaagtgattgagttaaattccaacttggaacagttttattgtcactagagatgcattttagtgttccatgttttttatgtttatatatcttttctcctttaaagattatatccattttaagataaagtaataaattgatatcagcttttggagataaaagaaatattaaagtacacttttttttaaccaaacaacaatagcacacgtgtatgt

SEQ ID NO: 209507 - DNA, 213 bp, Homo sapiens
ccgcaagttgccccataaggtcttctgatgactcatcgccaggtaacttcctgaaagtgactctcccagaatcctagcacaccaggattctaacagtaaaccactttacacatcagtcataactccagatagcttccaccaaaggtaagaagagtgccgtggtataaaaaccatcagagctgtccataaaatgttactgatgggagaagatgg

SEQ ID NO: 209508 - DNA, 363 bp, Homo sapiens
cgagctcggcacccgtaactgagtgataaccaacgaatttttatatctgggaaactttatagcatgctcattggagaaattttgaaaaataaaaaagtactgaaagaggttaaatcacaaaattttgttacctagacataaccactgtaaatattcgggtatatttctccacatcattttttttttctatgcatctataaatacatgaaaagaaaaagaagggtcaggcacagtggctcacatctgtaatcccagcacttcgggaggctgaggcagatggatcacttgaagtcaggaggcggagtttgcagtgagccaagattgcaccactacactccagcctgggcgacagagcgagactcc

SEQ ID NO: 209509 - DNA, 456 bp, Homo sapiens
cccgatgttgaccaattctgtcctaagggttacatgctccccgcaccccactccccatcagctatgtcagccgtggccactggcaccacactgataagggaaagggaacacccttggcagtatgtgacctcagtccttttccctctctgccaatacagagtgtcattgatacattagtgacaaaagggctacttaagacaggaggcataatgtgagatgccagaaagagctgagacatggaaaactgggacacagtggcacctctagctgacttttaaaaaataaatcattaatcaagaaccaaaccagaactgaagtgacagcactccttcctgtctcctcctgcccttgctcacagcacacatgacattactgctgtgacacctgtccctctgcctggtgtttattactgaggaagcccatagtagatccacagctttggggagctacttgatc

SEQ ID NO: 209510 - DNA, 350 bp, Homo sapiens
tattggtgtctcactctagttttaattttcctaatgtctaatgataattaccttttgatgtgcttactagctgttcatctatcttctattgtgacatgtctattcaaataatttgaccatttaaaaaattggcttattatgaatttgtaaggcttccttatacactaagaatgaaagtcctttggtttaagatgaatactgtgaatattttttcccagttcatggcttacctttttgttctcttaatggtatctttagaagaacaaaaatttttaattttgatatgcagaaaatgtctgttttgatgaagtctaacttatgtatttctttcttttttttttgagacgtag

SEQ ID NO: 209511 - DNA, 624 bp, Homo sapiens
cctatatacaataatgagataggagtaagttaattgtagtaagaagagggacaggagaggaacatagccatctctcggccatagcagtcctgaaatccagtcagcacatgttgtcatggcccctgttctagggtctgggaatataattatcttctgtgggagtggttccctaatccatgtttctccaggactcttggttccaccctatgaggtgtcttctcttttctataacaattagcccataatatacagctttctcaccctgcttcctgcctgttgaagagtgggcgcccagaggccttttttcattttgagctgtctctatcctatcccttttaggccaagctgttagtattttttaataaccaactttctttaaaatgttgtgagtttcctgtgaatcttagtggggttcactctatgcctcaaaagccacatctataatagcctttgagacagccctctctgctttgtgcagaacaatcccctgaagattcctagtagtacttttgtctaggtgatagggtgtactaggcaccacctaagtctttctggagtcttaacaaagagtattatggccatttaataaccactctttgcctgcaggggaggtggggcagaatg

SEQ ID NO: 209512 - DNA, 515 bp, Homo sapiens
acagttttaacataatgtttttgataataaattctagtgcaaagagaaccaaactggagggtcacgggatacaactgggagggacacttatttcacccctttttactcgagttaccagccaaatcacagaaatgggctctgcacagtctcgtcaaggtggcctgcagtatccacgaattgtgtggcctgcagtatccacgaattgtgtggcctgcagtatccatgaatcaactgcaagtctcatgtcagctcctgaaaggcaatgggagcgggtgaggaggagcagcttctgcccacgtaattcctcctccctgacctcatgacctgcccagagctgtgcccctctgcccactttcctgggatgactcctagccagggaaggctctcaggtcccaggtacactctcagcctgctctttctgagcacattcctagtcttatgagattaaaggctcttctgcagccagagaatcctacacacacctcctttgaactccagccactctgaaaagcaaa

SEQ ID NO: 209513 - DNA, 461 bp, Homo sapiens
atctttgcagtatcatgcattcatctttggttcccctaactttgtaaaagaaacaagttttttccttcagtcccagaagcaatggccggagtgtgcacctctcagatggcttcccagcagtgtagtaggagacctggttagtgtactgggcagaagagggaaataagatgcttcatgtggccggccgcagtggctcacacgcctataatcctggcactttgggaggctaaggagggtggatcacttgaggtcaggagttcgagaccagcctggccaacatggtgaaacctcgtctctactaaaaatacaaaaattagctgggcgtggtggcgagtgcctgtaatcccagctactcgggagactgaggcaggagaatcacttgaactcaggaggcggaggttgcagtgagccaagattgcaccagtgtactccagcctgggcaacagagggagactccaccc

SEQ ID NO: 209514 - DNA, 166 bp, Homo sapiens
ctgaggtaatgggggctgtctgtgaagccttgcggcaggacagcccaggtaatttgctgagcctgatgggtgtcagggtcagtctaagtgaaagcaaagagaggcggggacgaggggtgcaggggaacagtgaaaaaagcatctttacgatcaagcacggaatagt

SEQ ID NO: 209515 - DNA, 205 bp, Homo sapiens
ataaggaggtattcacattgcacagacattgatgggctcagtgaatggctgggatagctggagaaccaggtttgaggttatgtagtaaaaaccacaaccaaaattatgatgtagaactggtctggtgaggatatctctgctgcattccagaggggtaggtgctggaatgatgctgctgatggcactgggaactgcaggcccccac

SEQ ID NO: 209516 - DNA, 321 bp, Homo sapiens
agcccatagctgtctgtatgtcttctactggagcatttatcacactatatcatagttaatctgttcaattttctcagagattcagttatatataacttctatgagagaagtgcccaggaatggcatttgtcttgtgttaccattttatcactagtgatgaagactatatctggtgcagtaaataattgaatgcatgaatgacttctcagttgattaaacatccttctctttaaagattcttttcttatgcattaatttttttctagtctatttatttgtcttcacactctttgacctctgctttctgattcttatgtttta

SEQ ID NO: 209517 - DNA, 389 bp, Homo sapiens
tggaggtggggtgagtggaggccagaagtgcagttgttgaggttggagaagtagccagagaagatcatgtaaggtgtgactgtgctcccataaaactttatggacactaaaaattgaattttatgtaattttcctgcatcatgaaattaaaaaaaaaattgtttcaaccattggaaaatgtaaaaaattgttcttagctaacaggccatacaaaaacaggctgcaggttagatttggcccatgggtcatagtttggcaattgtgttatatataaattattacactgttttatcttcatcatggtacacatccatacctgacatgttttatttgcctgtgtatacatttattgctttgtcaccgtctactagaatacaagttttttgaga

SEQ ID NO: 209518 - DNA, 749 bp, Homo sapiens
aactgggagcctctgcatccatccgtaactgtctggccgtgacagtggttagagaggagtggcttctgtgaaactctcacaatctcaaatctcccacaagtgcctctttcagctaactctaaactggtaccatagaggaaatggattctgaaaacttggtctccaaccttagacaaattgaataattaatatgtcctctcctgcttcttctgtaactgaatttgcattgggaagcaggcctgtcactctcagactttgtggtttgagtagggctcacttcagcaccaccttttcctcttctcagccccacggactggcatgagactcaggcctggccaactgaatgtcacacacctatgaccatcagttggctcagagatggactcaggacaccatcacagccaatgaaaccctgttagggaaatttgtcagaaccatacaaagaaatagctccacttttccatagagatgagacataagcctggactaactggtgtccaatttgccatcaagagagcatctgagaagacagaggaaaactggggaaagcgaagtctaaggaaggtgagtaaggacaagtccagttgatattacatgaatcacctggacctggaaatcaaggcattgctggattcaaggccaagaaaaattggaagctggcttgaatcaggttctatcacttgcagttgaaaaggtccagactaatatgataacaaaggagcaagtaagcaagattctgccctacagta

SEQ ID NO: 209519 - DNA, 824 bp, Homo sapiens
gtagtcccagctactcgggaggctgaggcagaagaatcgcttgaactcgggaggcggagcttgcggtgagccaagatcgcaccactgcactccagcctgggtgacagagcgagactctgtctcaaaaaagaaaaaaaaaggatagggctgcaccagtccctggggacgtcccaggtgcctccctacaggatccatctccagacactggccttgtagagccttctcagaaggatccatcaactcttttaccctgagcactaggtgagggattcactagggaaggcaggtgacggaggtgacatccaggatcccccctcaggccccatacactcagaagcaagtcacaccactggccgtgcgagagcaggtggtggacgccgcccgcctgcagtggccgctgctcttctcccggctcttcgaagtcatcacactctcaggtaatggcatctgacagggggcagggagcaggtatgggctgggcacccaggggtcccatgcagccttcacactgccgtctctcctggccaggcccccgcctgcccaagacgcagctgatcttggctgttaactggaaggggctttgcttcctggaccagcaggagaagatgctgctggaactctctttcccagaggtcatgggtctggccaccaacaggtgcgggccctgagggaagatctcttcttacacactgagtccttgtgatgcatctgggggctcggggagagatggggagaggggcagtgtgccgtcccgggtaacaggccggggtggagggacaagaatctacgtatgcgatggcttctgtacttcggagccccaccct

SEQ ID NO: 209520 - DNA, 2036 bp, Homo sapiens
gaggaatcgagtagggatgcagagcctggtggcactgtcctgagagaggaggaggctgggcagggccccggcgctggagaggtgccctgcatatgggacctctcagaggtgcacaagagctgtgtgcccaggtacccctgtctcctctcctcctccagcccccagcctactctcctaatggtctgtgtctttcagggatgagatttactgccagatctgcaagcagctctcggagaacttcaaaacaagcagcctggcccggggctggatcctgctcagcctctgcctcggctgcttcccaccctcagagaggttcatgaagtatctactgaacttcatcggccaagggccggcgacctacggccccttctgtgccgagcgcctgagacgcacctatgccaatggggtgcgtgcggagccccccacctggctggagctgcaggctgtcaagtccaagaagcacatccccatccaagtcatcttggccactggagagagcctaaccgtccccgtggactcagcctccacatctcgggaaatgtgcatgcacatcgctcacaagcagggcctcagcgaccacctgggcttctccctccaggtcgccgtgtacgacaagttctggtccctgggcagcgggcgcgaccacatgatggatgccatcgcccggtgtgagcagatggcccaggagaggggcgagagccagcgccagtcaccctggcgcatctacttccggaaggaattcttcaccccctggcacgactcccgggaggaccctgtcagcaccgagcttatttaccgccaagtcctccgaggagtctggtctggcgagtacagcttcgagaaggaggaagagctggttgagctgctggcccggcactgctacgtgcagctcggcgcctcagcagagagcaaggctgtccaggagctgctgcccagctgcatcccccacaagctgtacaggaccaagcccccagacaggtgggcgagcctcgtcactgccgcctgcgccaaggccccatacactcagaagcaagtcacaccactggccgtgcgagagcaggtggtggacgccgcccgcctgcagtggccgctgctcttctcccggctcttcgaagtcatcacactctcaggcccccgcctgcccaagacgcagctgatcttggctgttaactggaaggggctttgcttcctggaccagcaggagaagatgctgctggaactctctttcccagaggtcatgggtctggccaccaacagggaggcccaggcgggcagaggctgctgctctccacgatgcatgaggagtacgagtttgtgtcacccagcagtgtggccatcgctgagctggtggccctgttcctggagggcctgaaggagaggtccattttcgccatggccctgcaggacaggaaggccacagatgacaccaccctcctggccttcaagaagggggacctgttggtcctcacaaagaagcaggggctgctggcctctgagaactggaccctcggccagaacgacaggacaggcaagacggggctggtgcccatggcctgcctctacaccatccccacggtcactaagccctcggcacagctgctgagcttgcttgccatgtcaccagagaagaggaagctggcggctcaggaggggcagttcacagagccacgtcctgaggagccacccaaggaaaagctgcacaccctggaggagttctcctatgagttcttcagggctccagagaaggacatggtgagcatggccgtgctgcccctggcccgtgcccgtggccacctgtgggcctattcctgcgagccgctgcgacagccgctgctcaagcgagtccacgccaacgtcgacctctgggacatcgcctgccagatctttgtcgccatcctccggtacatgggcgactacccttctcggcaggcctggcccaccctggagctcaccgaccagatcttcacactggccctgcagcacccggccctccaggacgaggtctactgccagatcctgaagcagctgacgcacaa

SEQ ID NO: 209521 - DNA, 792 bp, Homo sapiens
gagagcagaacttggactgagtcctgcaggacacaggtattagcttttctcttttatttgctttatgtttcatttacttctttggatcgaatagctccaattgtattgctgttatttggtttttcattttgttgttgggttttttgatgtggtgtttttttgttttgttttgtttctttttgtctttttagaaagagggtttccctctattgccctggctggagtacagtggtggaatcactgttcactacagcctccaacttattcctgggctcaagcaatccttctgtctccatctcctgagcagctgggactctaggcatttgccaccgtgcccaatttttttttaattcctttttaaaaatattttaatcctttccggaaaaaaatatgttttccatggacttgcttatttcctttatacagtccattgtcgttgaattcttatttgaatttgtgatacaccctctcatagggaacataacaaatttcctcccacagcaattaatgacgagtgcgatgagaagcataatgacaatgattaacttgataattaaaaatctaatcaaccaactgttgatgattgtactaaacaaaataatttcatttttacacaaccagttgtatgtgaactatgttgaaaccaggatgcatgactggcggcagaacaaagaagtttggtttaatttctatctatacacccagtaaaatatctgtaataccactggaaaaccttaaaatacattatctatttcttgtaaaagaatgatgaaatgtgaatttgaacagcat

SEQ ID NO: 209522 - DNA, 604 bp, Homo sapiens
ctctctctctcgcctgccaccacataagacatgcctgcttccccttccgccatgattataaattttctgaggcctctccagccatgcagaactactttttcagataaaattatcctgttgtggtagccatggagatgcaacacttggagtgcccttcaagatagaaattcctgattagctgggaagaatgcagtttgctgactggctccatccttccgggtggacaatagaaatcttgaatgcttatggtatgggtgaccgtaaaagaacaaattcaatgtctaaggaggcttttacaccagaacaactccatcttgaaaaggagctgggtgaaatgaggctgagacctactgtgctgcattcccagacggatcaccaaggattcagaccgataccaatgatgcaataaagacatcatttttcctccaggaaaaaaagagaaatatgggtttagtcaccaaggaagaaggcagtaaatagctttgaacactcacatttacactctaatatatctgtgtaaaggatatgaaggatataaataatttagaaattgtgggggaagtaggtatctctaatattgaataaaaagaaaataaatgaccag

SEQ ID NO: 209523 - DNA, 405 bp, Homo sapiens
cagtacatttgttaaaaggcatatattccatttacaagcacttcatataattttttaaagttacttaaaatatgggcccagctgggtgtggtgagagtagcaatgacccaggagttcaaagaccttgactgtaggccaggcaccaataataaatggtcggatggccttgagaaagtgacagctctgctgggtttcagtttccacatgagtgacatgattgatttggagcaggttacttctaatattccatgcagcttcaaaattccacaactgaataattcaggttaaggaatttgtacctaaatttaatagacactgatccagtaccaatatatgccaggtaatattataagcactttacaaagtatttaatgatataataattttaataaagcatagaccgca

SEQ ID NO: 209524 - DNA, 323 bp, Homo sapiens
aaggcccttgtgagtgctcttcagggacagtgctccaggttgggagcacagtgatggcaaaggcctagaggcagaagctggcatgtgtgaggagtagcagggaggtccaggtagactatttggggctagtggaaggagctgaggctggacagacaggaagatcagatcctgtaagactctcataaggacttgggcatttattcggtgtgcaaggggaagccacagtggggttctgagcagagaggacttcagagcagagtttgacaagagaggacttctgtgtaggaggcccaccagttactgcatggcatagaaacagcaga

SEQ ID NO: 209525 - DNA, 338 bp, Homo sapiens
gtatgtttagcctttgctactatgcccccaagtcttgattaatgtagctttataacaacttttgaaatcagtaagtgtgagtcttccaactttcttctcttttgggattgttttggctgttgccttgcatttccgtatcaattttagggtcaggtttttctgtttctgcattaaaaacaccacggattttgacagggattgcattgaatctgtagatgaatttggggagttttgtcatcttaacaatattaagttttcaacctatgaacacaggattttttatttatttaggtttttaatttttttaatgttaccttgttttcagtgtaaacgtctca

SEQ ID NO: 209526 - DNA, 213 bp, Homo sapiens
cttttccccatttattttagtgtccttatggaaatgttgcctggggcaattattactgtgatatgctaatttcctcattatttattaagttggaattctgtaagagttgtttcttctccatttattcagtttttttaaatgtcagcatggacttgaatatttatctcattctttgagttgtaacactatacttaattattttgtgactcattt

SEQ ID NO: 209527 - DNA, 820 bp, Homo sapiens
cactcatcccagggtacatgctggttgcaaactaagcccaagagtggatttggacgcaagttggtaaataacaactaggcttttagattcggagtttggatgatgagaaaagtgaagttttgagtgggtgggaagaaaccttccctgattttggctggtacattcagagactcacagcactaacagacagggcaggctgccggggcaggaaccctggggaaaggtgtgtcacacagggcctgaggtgaagggagagctgctcgggtagcagtgggggagggggacagaggctgggagatccttcctagagatgggagcagctttccacttcaaggaccacaggtctgcaggcccacagctcctaggacagaaacttacaaaactgtcactgtcaggagggagtgctggctctcagatggactctgttcctgagcccctatcttgcttccattcaccttgcaccagctgcccagagaagctagccttgagctgatgtctacctttgcaatattccacctgagtgcatgctgtcttttgctgatctggtcttccaaaatctaagaagcctacaacagcattttgggatatgggacatttagaggtctcattacaagttccatgggacttttagaaaaagcttagatctatggacaactaggagaaggcaaatttaaacttgtttgaagcaacccacacaagagcaggttttcctaacctgggcgggggtgtccataaattcccaagggggtccatgtgaactcaggaggcgatgaacctgctgaaattatgtgaaaagttattcatgaaaaaaattaaaatt

SEQ ID NO: 209528 - DNA, 171 bp, Homo sapiens
atgtagttgcattgattgtgttgtaaagaagaatatatctagcattagtaatggcaatggcaataatgatgacaataatacagattgcattgagccatatatacattatctcattccagtataaaagaagtgcccccagcaacttcttggacgccaaggaggtttccaaat

SEQ ID NO: 209529 - DNA, 390 bp, Homo sapiens
ttggggcaattttggtaatctgtatttctgtatgaaattacccatatcatcttggttttaaatatacagtcatgcgttgcattttcagtcagtgatggactgcatatatgatggtggtttcataagattataatggagctgaaaaattgttatcacctggttatatcatagcaattgtaatgttgtcacacaatgcattactgaagtgtttccggtgttgctggtgtaaacaaacctactgtgctgccaattgtgtaaaagtatagcacgtacaatcgtgtacatacataatacttgatgatgataacaaatgactattttactggtttatgcacttaatatgctaaacttttattattattttagagtgaactgtttctactgattaaa

SEQ ID NO: 209530 - DNA, 474 bp, Homo sapiens
acttgatgagatggggcacccgagaccagccacgcattccacagctgtgccccagggtccaggggatggggctgggggtggtcggacaaaaccactgcccacacttggagctgggggcagccgaacaacaccactgcccacgccttcctggcgagagacggttccagtctccccggtgctggcgtgggcacgccgtgggacagaagcgcagtcattcggcagaggctcccggctgttctcacattgtcagacccaccgtcaaggtcatttcaacggcccctttgcccggccgggcctcctgagttccctctgagcctcagagcagctcgtacacacagctttgggtttctaatggggatggggtcttcaggcctcagccccttctgggcatttcttccgttacaaaggaaaggaaatgtaccgaacactagaaacagtgtttaataaatagcagatttctcttcctgtctgtga

SEQ ID NO: 209531 - DNA, 433 bp, Homo sapiens
aaagggtcacctgttatcttttgctttattttactcatggggtctattcccaagtacttcacaaacacataattcacagggtagaaccagaacatcagctgtgtcaccctcatttggaagagcaaaggaatttatctccctaagcccttctaggcagcacagacttatcgtggactcagaagccagcaggctccttctctctggctctgacaccctgtgtaactgtccctgagccttctcagacagagctgctccagctgcaccaagagtaggccccagttgcataatcagttgttaaaatacttggcttccagctgggcgtggtgactcactcctgtaatcccagcactttcggaggccgaggcggatggatcacatgaggtcaggagttagagaccagcctggccaacatggtgaaaccccatctctacta

SEQ ID NO: 209532 - DNA, 730 bp, Homo sapiens
cgtcgacttttagaggacccccatcggaacccaatgagcccacactagctgggctctcctgcatcccccatcaccctttccggggctggttcttcacctaccacttccaacgtggctgttcaagaatctcatccattttgggctcattttggctcctcggagatgggtcctaaatctagagctccagtcccaacctttctcttaagctcctggctcacatttccagcaatctgctgaacatttccatgtgggtgcttgtcagctccttaaagatagcccctctatcaacaatgtttttgtttgttcgtttgtttttgagtcagagtcttgctctgtcggctggagtgcagtggtgcaatctcggttcactgcaacctctgcctcccaggctcaagtgattctcctgcctcagcctcctgagtagctgggagtacaggcacatgccaccatgcccagctaatttttgtattttcagtagagccagggtttcaccatttcggccaggctggtctcgaactcctggcctcaggtgatccacccaccttggcctcccaaagtgctgggattacaggcgtgagcaaccacggctggccaacaatggatttttaaattatttccacgctcacaaaaaacctttccaagatgacgggttgatgggtgcagcaaaccaccatggcacatgtatacctatgtaacaaacctgcacgttctgcacatgtatcccagaact

SEQ ID NO: 209533 - DNA, 619 bp, Homo sapiens
taagtcgaactctagagcgatccccgaaagctactgtgtgtgtaagagagaagagagagagatcctgcccttgagaaacaacaggattaggacggaaaaaaaccagatgtgaccatagtaagttctatttcataacaaaaacacatattttaaaaattggagaacatgtagtgtatatttcaaatagttacaagtgaggacttgaaacgttcccatcacatagaaataataaatactcaggcgcaggtgcggtggctcacgcctgtaatcccagcactatgggaagccaaggcaggaagatcgcttcagttcagtggttggacactagactgggcaacatagtgagaccttgtctctactgaaaattaaaaaaaaaaaattagccaggtatggagtacatcagatacagagacttaaatctctcgcaatgcttcagggttcttcaactgccaaagggtatcactaaaatgcccagggaaatacaattttcacagaggataaatgcttgactgtgctaggttataggcacctgtattccatttccctagagtatcctcttcactagtctaaagtgtgcgtgtccctggatctttgctactacagaaaaataatccaaccc

SEQ ID NO: 209534 - DNA, 935 bp, Homo sapiens
accagcaagtggtctctgcttttggtttacttctttcatagttgctccattgttttttgtttgtcagacacagggattgtggttgccttcccagcaatctcactgttgttccgctggttcaagataatcacctcctatcaaaggattcattctagacttgccttttcagcttttctatttgatctcaaaagcggctctgtgttatttgtgctaatgctttctccattggagctgataatcaactgtaatcatatttttgacccaaactttgatgatcaccatcaaatgatttattgaatatccttatgtttaagacacagtgctaggcactatgcgaaaatcagctaaagtgtgtgtgtaagagagaagagagagagatcctgcccttgagaaacaacaggattaggacggaaaaaaaccagatgtgaccatagtaagttctatttcataacaaaaacacatattttaaaaattggagaacatgtagtgtatatttcaaatagttacaagtgaggacttgaaacgttcccatcacatagaaataataaatactcaggcgcaggtgcggtggctcacgcctgtaatcccagcactatgggaagccaaggcaggaagatcgcttcagttcagtggttggacactagactgggcaacatagtgagaccttgtctctactgaaaattaaaaaaaaaaaattagccaggtatggagtacatcagatacagagacttaaatctctcgcaatgcttcagggttcttcaactgccaaagggtatcactaaaatgcccagggaaatacaattttcacagaggataaatgcttgactgtgctaggttataggcacctgtattccatttccctagagtatcctcttcactagtctaaagtgtgcgtgtccctggatctttgctactacagaaaaataatccaaccc

SEQ ID NO: 209535 - DNA, 891 bp, Homo sapiens
  misc_feature (542)..(542): n is a, c, g, or t
  misc_feature (579)..(579): n is a, c, g, or t
  misc_feature (694)..(694): n is a, c, g, or t
  misc_feature (709)..(709): n is a, c, g, or t
  misc_feature (718)..(718): n is a, c, g, or t
  misc_feature (730)..(730): n is a, c, g, or t
  misc_feature (736)..(737): n is a, c, g, or t
  misc_feature (739)..(739): n is a, c, g, or t
  misc_feature (741)..(742): n is a, c, g, or t
  misc_feature (746)..(746): n is a, c, g, or t
  misc_feature (752)..(766): n is a, c, g, or t
  misc_feature (768)..(769): n is a, c, g, or t
  misc_feature (775)..(775): n is a, c, g, or t
  misc_feature (791)..(791): n is a, c, g, or t
  misc_feature (801)..(801): n is a, c, g, or t
  misc_feature (806)..(806): n is a, c, g, or t
  misc_feature (890)..(890): n is a, c, g, or t
gaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggaatcctggttgaggccttggctcctncctgtagtcccagctacttgggaggctgagagaggangatcgcgtgaacctggaagtttgaggctgtagtgagctatgattgcaccagtgcactccagcttggatgacagaatgaagtatcactctaaacacccaagctaaaaaaaaaaaanaaaatctcagcaaanaacaaccancaacaccaaaanacaaannanannccanccccannnnnnnnnnnnnnngnngtgatnggggcccaccaccacncctggctagnttttntatttttagtagagatggggttttttcatgttggccaggtttttttggaactccttcttctagtgatccaccttccttgtcctnt

SEQ ID NO: 209536 - DNA, 629 bp, Homo sapiens
aggaaaaagttaatttcatgtgtaaccttaatttaataataataatcattagggctttgttcaagatggatgagcaaaattctgtcaccccttctacatcttagctcacctgtcctcacaaataaacatcactcttgaatactacaatctcactttattagattgtaaatttttatgaggaaaaaggtcctgagctatggcaggcttaattattccctcattcacatcttaggacaaaactgtatgttaaatatggcacacaaatactaattgtccatttactccactggaagtgccctaaggtaccttgggatgcctcagtgaagtgccaaatggaagacattctcattttaaacaggtgacctttttattaagagttttctaaagtccttggggcaaatgaaatcttttctcattattaaaaaaaatgaaatatatctaaatcataactcaaaaatcataaaatagaacatatggaaaagactttcctctggatgcacgacactgttggctccctaaagaactacttttagggaacaaaaaactgttcaagcccaagcatataagtttaggccccttcgtggggagaatggcttataagcggggaacgggaaacgagatggaaagat

SEQ ID NO: 209537 - DNA, 303 bp, Homo sapiens
ggctttgggaggcaagacataaatcgagagcaatcagttgagtattgtatttggtgtggggtcacaggaatataacaatatgcttacaggggtactttgtaacacccatgcagtcatttttcagctaagcaattatttttacttactctattggaaaactgagagaaagctgcagctacatcagtggtgtcctgagacatgcattagataatgtctacggtttatgaacctcgtaaatgcacagaaaagttgaagctgtttttttccttttgctagtgtgtcaggtcaaaggagattatctgt

SEQ ID NO: 209538 - DNA, 457 bp, Homo sapiens
catctgtcctctgctacaacttatacatggaaattatttctataaggatgaatgcaaaatgttgagttgtattccagacttcaccatccaacttacctaccattactgcccctaaacacattaaataacacttaaaacacattgcataaaatagggataataaaagagtgtgtaatcatttattgcaccaaaggcagtagtcataaaagtgtacccccaagatggaatgaggaggcataggaggatgaaggagtggcaagatgaccaatctccacatccattcactgaattggagggcagatgcaaagacagggcaagaagattccatatgaaggaggctgtagtctggtctccttattgctcttaaaattagtaagtatcaactgttttcctctcaattttattaacaaaaatcatggttgttcgtatttgctctctcctggccaaagtttctaga

SEQ ID NO: 209539 - DNA, 597 bp, Homo sapiens
ggccatccatacatcaaatattaaagctaaatcatgttcttgcttcataggtaagaaaatgaatacagatggaaggtctgtttcccaaatcccagtagctcatcttgcctactctgggcactgtgtccaaattccactttgcaggccactccttgaagccacagctacccctaatctggcctctcaccagactcctagacacacatcttgctgaggactggtgccagattacctgaagcaaatgtcaggtgatgaactggaaaagaggtctgagggaagcttccaatttgcattgctgatgccaatttcaggaaccagtaagtgagcgcaaaaaagaagaaggcaggaagacgcagagacaagttctaaaacatcaggtcaactaagcaaggagactctctgaggctgtactggaagcaggggagaatgttcatattctgaatgcacttgctggcaattcactgccagcccagtatggtgaggggctgggttacacccacatctcagaaatgacggcagactcccaaaacaatttacagcaagcatgccttaaaagtgcattagcgggccaggcatggtggctcacgcctgtaatcc

SEQ ID NO: 209540 - DNA, 218 bp, Homo sapiens
cttcatgactttgactttcaacaatccttcaagggaggcattagttcatcattacacctgaagaagtcggaggttcaaagacctcacaacaagcaagtggaaaagtaaatgttcaaattaggtcttcttttccaaaaatcctgttacataacagtataatgcaatgtagctaagccaagaactgtggtcatctgcattgagatttgtttctgttaaga

SEQ ID NO: 209541 - DNA, 372 bp, Homo sapiens
acacaccaggatgactaggcctggaggagtccagggtgggcctcagaccctcacttcttgtctggcacctcccattgccaaaaatgcagacttcagagtaggaccatttttggagccatgtataagaaacagatttctatataggtcaggccttgctaaaattcattttgagaagttcagagatggaatggagcaagacaaaattgaaattctagcatccttttcctcatacaattcaccccttgttttatgaagatgtgggacaaactgaatgaatgtaacttgcttaaaagagcacctgacacacatggatgctatggaagcaccattcgattccatgctttaactataaatgattattgttattattac

SEQ ID NO: 209542 - DNA, 339 bp, Homo sapiens
ataaaatagtctccatattccaggtttgtggcatttttcattaacttttgagttacagccatcctttttccatccccagggaatgtcccagttcctttaaaaaaaaaaaaaaaaactgatccaaaatcacagggcctagaaacattttctcaagtggcatgactgatgcttctgtggtgctacagggatggacagatgcaggagtgggaggtgggctgaggagaggcaaggtaccggggaggatgatgactcatgctttcctttcggctgtgtctctagcaacactggataattgggttgtcatccacaggaaaagcttgggaagcctatttgtgactg

SEQ ID NO: 209543 - DNA, 518 bp, Homo sapiens
ccattatagtcaatccgctgtgatatggtttggctgtgtccccacccaaatctcaacttgaattgtatctcccagcattcccacatgttgtgggagggacccaggaggaggtaattgaatcatgggggctggcctttcccgtgctattcttgtgatagtgagtaagtctcacgaaatctcattttctcttgccactgccatataacaggtgcttttcacctccctccatgactctgaggcctccccaggcatgaggaactgtaagtccaattaaaccactttttcttcccagtctccaatatgcctttatcagcagtatgaaaacaaactaatacaccctgcttccactcccactaacctatcttctgatttcatttgacatttaggaagtgtttctatgagataggacatgagtgatggctgactataaagtatccactcaaactaaagggatttttcagcaaagcatgcatatacatacacgcatatatacacaaagacacacagacacgtccaca

SEQ ID NO: 209544 - DNA, 480 bp, Homo sapiens
agggaggctttggaacaaagactatgtgtttgacccagcatgtgtttatgagaactgaattataatttcatcagcaaattcttatctgtgtcgttttacaaaggcacattctaaatttttgagggaccagctgacttgatcattgtgatactgataagatgaaaaaaagtgaattttgaaatgttgtcattccggttgctttggtgacacaaaccctgtagatcccagagcacaaggtcacctttatcttctcaaagggcatgttatgaaattgcacaatgcctgacactttcatgggagtaacttacccaagcccgttcttgggaaactaccccatcatgagatagctgacctagagagctcaacccatctgaataattggcaggaagcacatacgatctatttgacttcatcagaaaacaagcttctcacttggccttcaggggccttcccagcctcacagctcccatgcggggtcac

SEQ ID NO: 209545 - DNA, 503 bp, Homo sapiens
ggagaatgaatggtagtgtggagtagagaaaagagaggccctaaaagcaagcgtgtggcagtgttcatcagccatgctgaccataaagggagccctgagcagctgctactaaccatctggttgctgggcaagaataactatttggcagaggtggatccaacaggccatcattacttgatggtaaagatgacaatgatgataataatgacaacaacttgtattgtgcagtaaactttttgccaggcataacattaggcctttaacatacatcaattcacttaacccttagacaaaaccaatgacatattatccctattttatagacaaggaagatgacgctcacagaagctaagaaacttgaccaaggtcactccataagtgacagagccatgatttgaacccagatatgagtctatataatatacctatagctctatatacctataaagatggctgagagaaattaaaggagatctaaatatatactacgttcatagatcaaa

SEQ ID NO: 209546 - DNA, 399 bp, Homo sapiens
cagtggcctgtgagttcccaacccagctcagctgtgacagcgcctttgacctcagtgctggtggtggtacacatggaattgattacccagaaaacatcactgactcagacaagcagggcagactcatccgagcaataaaatgatcctcgaatagaatcatgaagatccttccggtcataaacagcaatatgtggagcaggctgaatctacctgctttaatcacaaagtcagaattatttataattagatgattgattttgtagcacagagggtgctcctaaaagtgttttgagaagcattttccctaaataatacaatattgacttgcgtagtaaatccctctctttgtagatagtgtatctgctgcctagggtttgtctgatttagtaaatattccaa

SEQ ID NO: 209547 - DNA, 189 bp, Homo sapiens
tgaggctgccatgagccataattgttccgctgcactccagcctgggcaatgaagcgagatcctgcctcaaaaattaaattaaattaaattagattgaaaacttttctcttatcaccttgtctacttattatctatttattgaagcctgtctcttgttggagtggagggaatgaaaaggtgggcagcaaa

SEQ ID NO: 209548 - DNA, 424 bp, Homo sapiens
tgggctagcaacaagatacctaccccacattagctgtggtacctgctgaaatgtgaccatgtgagcaaagaaaatgagccaaaagaaactctttctgaagattcactgaagaaaacctggagatactctttcattagtagaccccacagagacaggtggagtgtccgttatccagaatgcctgggaccagaagtgttttggatttcagattttttcacacttgggatcctcaacatgtgtatttgttggaaatggctacttaatttaaggaaaagtttaaggtggcctggaaaataagtagtagttgaactaatcaacaggaaccaaaactactttcaatatatagtgtacttatactcaaagagagacggaccattttatggtggaaccctgtctatggtagtattttgtgatgttttatttt

SEQ ID NO: 209549 - DNA, 504 bp, Homo sapiens
catgtcatttttagggtgtgttttttggagccagcatctagctagattgtgtttgcttattgtgtttactggtttatctttttattatgtatgtcattttgttttatgtttttattttattctttctttccaaggattactgttagacgtatgctagaacttctcaaggtattgtttttgacttgttttttaagatttctattttatctttttggcctatattctagatgatttttttctatatcatctttgagtttactaattttttcttcacaatacttcagattggagtttgtctcatacttatgttctcaatttcagtgaattaattttatcgtttcttaggatttccagtttgttctttaaatttatccattcttgaatcattacttaaagttgattttataatttattgttctgttttaatgaatgctgtctctcaattttgctctgtaagaatgctaaacatacttattttaaaaataaaaatgttttcacgttgca

SEQ ID NO: 209550 - DNA, 335 bp, Homo sapiens
tttctgcagtggaactggacaagataattaaggttaaggaggatactgagtattgagagtacagttgagatttaaaatcttaaatttttaatagagcttttcaacttgtttatcccagtttttccagcataagaaagagggaatgcatgcttctgtggaatttcatgtatagatatttgtgttagaaattaccccaaaattcagaaactaaaaatgcgtaacattcagccagatgcagtggctcatgcctgtagtcccaacagtttgggaggctgaggtgggcagatcacttgagcccaggagttcaagaccagcctgggcagcatggcaaaacc

SEQ ID NO: 209551 - DNA, 140 bp, Homo sapiens
gagataaacgttagatcttttgtgtagttccatagcttctgtagacttttgtcattggattcttggaagaagagaagaaagagggtaggactgagaaagtacttgaaataatgggtgaaaacttctcaaatgtagtaaga

SEQ ID NO: 209552 - DNA, 410 bp, Homo sapiens
taaaaatgcaggtacaaacatgcttggaacaaatggaaaattggaaagcctccaaaaagaaacaaagtctcagtaaaaaaatagaagatgtaaagaaaaaccaaatggaattttagaactgaaaaatataaccaccaaaataaaaaagttcatcagtgagttcaatggcagaatagtgaggacagagaaatagaatcagtgaatgggaaaacaggacagtagaaataacctaatatgaacaacacagagaaaacagactgaaaaaaaatgaccagagtctacagaagctatggaactacaacaaaagatctaacagttttgtcattggattcttggaagaagagaagaaagagggtaggactgagaaagtacttgaaataatgggtgaaaacttctcaaatgtagtaaga

SEQ ID NO: 209553 - DNA, 478 bp, Homo sapiens
ggtacctagggcagtcagatttatagagacaaaaagtagaatcgtggttatcaggagctgagtggagagaatggggagttaatgtttaatgggtacagagtttctgtttggggtaatgaaaaagttttggaaacagattgtggtgatggttgcacaacagtgtgaaagtcattaatgccacttaattgtacacttaaaaatggtaatgtggcaaattttatgttacatacgcttaaccacaataaaaaagaagagggaaaaaattaatagactttaatccctataacataaaaggatcagggaattgcagagtagtaggtagtgtgaattctccattttatatgccttctttatactttatatacctttcatatatactaacgcctttgatcttagacctaagaccaaaacaatcctttttcttaacagtaaatacagccatttaggtaacagccatttaggtaacagccatttaggt

SEQ ID NO: 209554 - DNA, 383 bp, Homo sapiens
tagctcggtaccctgccccagacggcttaattgacagtcacccttcaccccgctctccgggagcctgaatctccctctgagtttcttgcaaaagcaaagagaattagatggggtgatagtgaactacacacagctctggacggcatccaattatcttcttcctgatttttaccagaaaactaggctcacggagagcggggtgaagggtgactgtcaattaagccgcctggggtagctagagaccaataaacctactttctaaatcagaggcaatttccttttccacagcgcctgctctgcctctctgtctacaaggacacatgagaccggcagagtcagcggtggccaacttgggcctaacgggcgttcggttgtctcgcaag

SEQ ID NO: 209555 - DNA, 467 bp, Homo sapiens
ttatctacccgttcccactaggcattactcaacagagaaccaatagctaggaacttcctctattcctaaagattttcaagaaaggaagagaaatatcttgggaagtttaggaaacataaatatttaggctcatttattgatgaaagtgggcaaaatgaaatcatcctatgcatcttagtaatactatgtggtatcacaagcagcttgacataacaggctggtatcaattgtcatgggtaagtgctaattgctgaagatctaccaatttgctgtgtgcttttactaaaaatatctttgaaagttccacagccttccaagattttgtattccttgatataacctttaaattgccttcttcacattccctcttgtttgttagtaatgaaatgccaatgatcacagtaccggaaaaaagaaaacggagaagaggacaataaaaaatcatggttatgatttgtggagcaaag

SEQ ID NO: 209556 - DNA, 537 bp, Homo sapiens
tgggcctgtgcagctctgaatgctgcatttacttttgggtcctgcctccaacccagaaccacctgtggcctttaattcctgttactaggagagaggagaagcgattaaaccctgtcagtatattcatttattagctgccctttgaagcttttttgaaagcattttacaaggtatatcccgtcaggttgcttaggaacttttgcagcctccttcttcaacattatcattttcatttgaatcaacactggcagcttgacacctctggacacctggcatggcagtgggaggtacctccaaacactgtctttccgtgtctgcaccttcaacaagattttctctgtaaattcagctccaaaacaatttttataaacacagcattacttttgtgttgttcacaaatcagatttggaaagaggtgcttggggactgtcatgagtctatttaaagataacctgatttaaataaaaacaaaaacaaaactttttatccaaggcaattttctttcaatatgggaaattaaattagcttcagtgtctt

SEQ ID NO: 209557 - DNA, 223 bp, Homo sapiens
tcagccctctgtatctatgggctccacatctgtggattgagccaaacttggactgaaaatattcagaaaaaaaatctgcagtgtttcaaaaagcaaaacttgaacttactacatgctgaatactatgttgaatccacctgaaacaagtaataggtagatgttgtaagtaatgatcgtggagatgatttacagtatatgggaggatgtacataggttatatgca

SEQ ID NO: 209558 - DNA, 708 bp, Homo sapiens
tttctgtctccccatgatttaatgtgaactctgtgagaatgggcatcttgtctgttttgtttttcatctgttaaaaggaaaaaatcttcatacaagttcaatttagcagagtttgagaaagaaaactctgcgtatgggatagctctcagaatcagaacagatctaagaactccaacaagcaacgtggtctagtagtatttataggtagaaaatagaagtgaagtataagacagaagtgaggtacagagcttaattggttacaggtcgtttgtcttatttgagtcattggttgcctgcgattgactgaagctcagctgctgtaattggctgagactcagttgtgttataaaattacaaatgctccttgacttacgttggggttacatcccgataaacccattgtaagttgaaaatgcgttgaatacacctaatgtacatcttagtctagcctaccttaaatgtgcttagaacacttacattagcctacagttggtaaaatagataacacaaagcctgttttgtaatacttacataatttattgaaaactgtactgaaagtgaaaaacaatggttttatgggtaccatcataaagttgaaaatcaaccgctttaagttagcgaccatctgtgtactcttaggttttcatttggtttactgagctaggcagtgattatgtaaggactcaaatgcagaggcatcctgaggcc

SEQ ID NO: 209559 - DNA, 920 bp, Homo sapiens
  misc_feature (665)..(665): n is a, c, g, or t
  misc_feature (677)..(678): n is a, c, g, or t
  misc_feature (685)..(687): n is a, c, g, or t
  misc_feature (692)..(693): n is a, c, g, or t
  misc_feature (725)..(725): n is a, c, g, or t
  misc_feature (733)..(733): n is a, c, g, or t
accgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagcaaccacntattaaaaaaannccccccnnnccccnngagtctgttacccccccccccccccccccccnctaacgcncacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttg

SEQ ID NO: 209560 - DNA, 281 bp, Homo sapiens
ctgtagggacatgggtatttgatcagtttgctctcattaatctgctaaccaaaaggagatagagcaccacggaaatgaaataggaaacaactaagttttcattaggaaagtggaagaggagagggactaaagaatgcagtgtagctttgctttgttgggttgtgttcatggccagagggaggccctgtgtggtgagggtaatcagctgtgcaagcaaggaagccagggtggagaggctcagagaagagatttggtgccggtgccaggtagggcaggaatat

SEQ ID NO: 209561 - DNA, 1115 bp, Homo sapiens
gaacgctccaggcctggtcctacatcaggaccttttcatttgcggttcccgaccaggactgcttctcccctagatgcccacgtgacttgttccccctttcctcctgttccctgatcaaatacctgccgattgacaaggccttttcagatcagccccacctgctcacttgctttcctgcctgtccacatatttaccatcagaacagaattctgcccatccgtttattgtctgtctcccccagcaaccactagaatggaagctgcatgtgggcatggcttagttttgtccactgctggatctcagcatccaaaacagtctaccacctggtaagtgctacagaaacatttacgaacaagaaaccagtactggctaccccgcactctgcctgtgctcatcttatcttccacctgaaaggttccccctctctaacttcaccctgcacccttcgaccagtcaatgatccccacagcttggcccactccaaaccccttaaaatccctgaacccaaactcctcaggaggcagatttgaggtttccccccaacttctcatgtggctgccctatgatttaaactctttctctgctgcggttccagatgtctcagtatactggctcgcggcacatcgggcaaatgaacctatcagataacaacggcagatcagatgcctgagcattcagaagcaacagctgtggagcccccgtgggttcagaaggcctggttcccgtctccagaagcctggctctcctccctcctgggcccactactttggcttcttgttcctacgtacaaggagttgcgaagaaggcaactcttcccctccctgaagccaaaggaatgaaacagactagggcgggagaggtggccatccgtcattagttgcggccatcagtaacagcaacaggacacggaacctaaggctgtatccatcctgggcccccagggaaacatcagcgggagcggtactaaggaagtgctcatctcttagagacaaaggcccatggaggggaacagtaaccatcccctcccaattcagaaaatgttaacataagcacttcatttctcatgcagataaccacataagtctattaataagaaagaaagagaaagaaaaaaa

SEQ ID NO: 209562 - DNA, 115 bp, Homo sapiens
ggaagctcagagtttaagcagcttgccaaaaagatccaacaactagcattagctaaaatttgaattcaagacatataagtccaaatccagtactcttttattaaatggaagctct

SEQ ID NO: 209563 - DNA, 598 bp, Homo sapiens
tctttctactttctgtacccttgaccctcctaacactgagctgtgctgacccgtccttggtccttgcccacctccggccctctgctcaccttccggctcctatcccaggcaccagacactgctttccctgcctccgggccctcccgagaatccatcatcctgtaggtcaggtttgctgctcataccttcctgtgcctcagtggtgtctccttgcctacctggtcaagtgacgctcccaagcaaggcttagagggcccttcttggtcttcccctgcccgtgtctcatcgggtcctggctacaccacttaccagctctctggcattggttaactttttcgtgtgtcagttttctcatgtttgaaaaggagttacagtaagcagtgagtgagtcaatggcagtcaaaccttgagttgatggcctggcctctggtaagggcttcatggagctctttctactttctgtacccttgaccctcctaacactgagctgtgctgacccgtccttggtccttgcccacctccggccctctgctcaccttccggctgctccacttgaaaacctccaccctgctcagcctctggctgctgcctcaggcct

SEQ ID NO: 209564 - DNA, 398 bp, Homo sapiens
ggccattgggcttggagtccccattctttagtgttgaggggcatctgaaggggtcatttcagggacttctgttatagttttggacgtgactgaggggtgcttgctggagtagtttcgcgatgacggaggtcttcatgtttggactccatcttttgtgtttgtaagtgattgaggggtggagatctggcatcctgttgcctcttgttttgagggtgactggtggttacctgctagggcttctgtcagctctactgctgtatgcagattgtgagaatcacttgctggggcttccataatctctagtcttagggggactgggaaatggcttgccatgctttctattatctctagttttaagggaccagttcaatgtgatttaaaactctttttatttgaaa

SEQ ID NO: 209565 - DNA, 305 bp, Homo sapiens
gaggtcacctttcctttcccgtggggctgggctgtgtgcctcttctgccccagccatctcccctctccccacctgggcgcagtgccagcctgctgggtgtgaacgggtgtttcccatggggagtggagccaacgagtccccggggacgggctgaagagcagggcacggtaccgatggacacgggaagggcaggcccagctctgccctgtcccttcccaggacctgtgctcagggtggccgtgaatgtcttcccacggagcagctggagggtcctgggcccaaagcgtggggagtgctgtgctggg

SEQ ID NO: 209566 - DNA, 610 bp, Homo sapiens
cttgtgtgtatgaggaattgtgtgtgtgtgtgttttgagtgtgtatatgtattcataaaaacaccgtttatattttttacaaaagaatgctcttgatttcatgttgccctagagtcaagtgtctgccacatttatttttacttattcaacaaactttcataaagctccatttgtgtgttcaagctttatgctaggcagtggggaggatacaggcaagttagacatggtccaattaagtacggaagagagatgtatacacaaataattacaagctatattgtccaatataatagccactagctgcattctagtacactagagtacttgaaatatagtgactgagaaagtttcagctgttatttaatttttatttcaatttaaaatagaaaactgatatttgattcagttattagaaaactttcaagtacatttagaacaatttgggtatgtgaatctactttttcaattatacattttatgaaatgtaaatgcagatcagttattttggaaaacagcttagtgtattagagttctctagagggacagaactaataagatacatacatatatatatatatatatatatatatatatatatatatatatgtat

SEQ ID NO: 209567 - DNA, 423 bp, Homo sapiens
gaaagttgcttatgaaaggacttaaatgtaagtgtagacacactgtctgactcattttctccccattgattttcaccataatttcagagaatttaccacagaaaaacatttgttcccaacacgtaataaaaatcactctcagctgggcggtggctcacacctgtaatcctggtaccttgggaggccaagatgggtggatcacgtgaggtcaggagtttgagaccagcctggccaacatggtgaaaccccgtctctactaaaaacacaaaaattagccggatgtggtggcacatgcctgtaatcccagctactcaggaggctgaggcaggagaattgcttggacccaggaggtggaggttgcagtgagcagagatagtgctactgcactccagcctaggtgacagagtgagactttattaaaaa

SEQ ID NO: 209568 - DNA, 616 bp, Homo sapiens
gcattagacaactcattcaacctctttggcttacagtttcccaagttacacgttctgtccatcatgtaaaactaactaagcctaactaccgctgttgtctttctaacctctccctcaccccaattctaagtcagtaaatgtggggtagggctcaggctgtttgtttgtttatttatttatttattgtctccacacgggattctgatgggcagttgcagttgagactgagaaccactgcccccagggatcatgcgaaatggggttctcgtggaggtgccaggttggccataggagaggagtggaccctttgggaacagcctaccagcaggaggaagtgagaggctggtcttcagtgcctgtctattgtgtgcttccacatgagcgaaagccacatgagcaggggaccccagagatcgtgtacctgaagggttacacagggacttgggttctcagtctttgcacgataagctcgcagctgccaggaatgtctacttcccagatttccagctgaccaccataccctggaaaggaaataataaaactggacagtttctttattaacaccctgattctagcttcactagagcttctctgggaggttgaaaatctgtaacaa

SEQ ID NO: 209569 - DNA, 265 bp, Homo sapiens
taatcctagcactttaggaggctaaggcaggaggattgcttgaacctaggagtttgagatcatcctgggcaatattatagtgagaccctgtctctaaaaaaactaaaaataaattaaaaatatattaatgaaattaaaggcctgtctgttgctcttaattcttttaagaataggagagctgtgtaacatatcttgattatgatctgtttctcactttacattccccaaatttaaatatttttgctctaattctgaatcaatgtaa

SEQ ID NO: 209570 - DNA, 369 bp, Homo sapiens
tgactctggcttaattaactgggaaggaacagatgcttttaaagattatatacataaaattgattctcattacctaagtcttagatgtcttaaaaatatggatatggtccctaatagtttctgggcacttagtcaaagatgacaaaaatagttatattaggcaatatagctgcatactcataaaaaggcatcaaggtatttttactacttggagaatatcatataaaaaagaaagtcctcctgcgaatttattctttcaactaacaaatacagggaatggcttttagtggattatgtgaaagcttgctgaggtctcacctgcacatcaacatcttactcaagttctctctagaaggagtggaacctgta

SEQ ID NO: 209571 - DNA, 276 bp, Homo sapiens
tgttgctcagtggggaatctgcaggcctcgacaggctctgagctgggaaacaggagtggccctgcctgtcctatgacacactgtgagtggagggggctgtggccggcagggacgtaggggagtcacacctgctgaagcccagctcagagtcaggactgggaccaaaggggcagagcccaggctggccatggaggtccgaagtgagggattaaactccagcgtggcagcctctgccactgacagccccagctcttcccgtggccccaaaggctggtg

SEQ ID NO: 209572 - DNA, 575 bp, Homo sapiens
attacagctaacttctcataagaaactataaagaacagaaaacaatgagatcatttaatagatacaggtttctacaaacccataattctatatacaacctaattatctttcaaatgagctgatggaaagaattttcacctaagccaaaggttaaagcatgtgctgccagcaaaagtacattattaaaaaaactgataaaaataataataaaaaatacactaaagggtccatactgtatgattcttttatatgaagttcaaaaatagacaacgcttactctggtgatcaagatcagaattattgttacctttggggtgatgggccttgattgggaggaagcactaggaaatttcagataggctggaaatagtctatatttggatctgggtagtgattaccaggatgtaaaaatttattgagctgcacattttagattaatgcattttactaaatgtaagttgtacccccatgaaccatggtgcgtcccctatttaagaactcagtgttagcttcctttctgtctttaaagatatcaaaccaggtaccacatttaacaggactattaacagacaaga

SEQ ID NO: 209573 - DNA, 249 bp, Homo sapiens
ttcataatgtggatcaaagtgacttaatttccataaatatatgtttctaagtctaaacattagtcaaggattgcattttatgttcatcatcacagaacttactgtttaaaaataaatgctcaccatatggaattactgagggcagagtattgaagttcttaaacataagcaggtggaagatggagaaagtttggaatcacctggctaaagccatccaagaaactggaaggtgcttactgtagaacactt

SEQ ID NO: 209574 - DNA, 640 bp, Homo sapiens
atccaatgaggtggggactattgtatttatgagtcccatttatagatgaggaaactaaagcatcaacaagttgatacatatagctagtataccgaaaactatactcagataaaacattaactttggggcactaagtccttcatttttctttttgtttccctttccttcacaatgacttacactataagtatacacaaaaaaggattaaaacaccctcatggccgggtgtggtggctcatacctgtaatcccagcaattgggaggccaaggcatgcaggtcacttgaggccaggagttcaagaccaggctagccaacatggtgaaatcccaactctactaaaaataaaaaaattagctgggcatggtggcacacacatggagtcccagctactcgggaggctaaggcaggagaatcgcttgaacccgggtggtggaggttgcagtgagccgagatggtgccactgcactccagcctgggcgacagagcaagactgtctcaaaaaataaataaataaaaacatactcatgcttcctagcctcctatgtggggatgaatgaggtagcttcctttaaaagacaaaccacttacctggcagggaagttacactgcttcacaccacaaggccgtgggaaatcttgg

SEQ ID NO: 209575 - DNA, 390 bp, Homo sapiens
aagaaaagacaaagaatctagaatagctaaagtgatactggagaacaaagttggaggactcacactacctaatttaaagatgcacaagaaggttctagtaatcagggcaatttggtattggcaagagaacagacacgtagatcaataaaacagaatagaccccagaaatggccaggcatggttggctcacgcctataatcccagcacttgggaggcagaggcaggcagaatgctggagcccaggagttcaagaccggccagggcaacatggagaaactctgtctccacaaaacataaaaaataagctggacatggtgccatgcgcctgtagtcccagctacttgggaggctgaggtgggagaatcagctgaaaccagggaggctgaggct

SEQ ID NO: 209576 - DNA, 144 bp, Homo sapiens
taattacgagtggggaatttgtaaaatgatatgatgctgcatggcctctgaatagtgccctgctgtatttctccatgtgacaagttataaataaagcccaaacctaaccatcaaacttgaagaaaaagtggggaagagaaaagc

SEQ ID NO: 209577 - DNA, 295 bp, Homo sapiens
tttgctcataaagacaatgggggatgatgaagcaatagaaagaagaaactgggttcctggtgactttgttgagcacagccacccttcccatccagacagcccaacagctccactcctccttccagttaagccactgctgtttgatctccattattacaactaaaccagtatcttcactaatcatatcctgaggatgtaggtgcaggtgaaaatgagcctaacacatgtggggacagaaaaggaatgggtctgagtggaaaaaagggagggtatttgagagtaataggtaaaggca

SEQ ID NO: 209578 - DNA, 604 bp, Homo sapiens
taatgtagggagtagggggcagtattaaaaaaaaaattctactgattgaactttttctcccagccccagagggtccatggtcattatgatggccctaaagcctggctctgacccctgcttctgagccaggtcagagcaaggcctggggtggaggcttctggggaaattttgtgttgttgctttattaaaggatagttttgctgaaatcactctatcccttgggtcatatacactgcatcacactttttataggagaggggctatagaagcctcccctacccttggaggtgacgtagtattgtaagaaaatagtgggggcagagcttcgcctggccaaatatatatgtgttctaattgtgctttacacaaattaattatattgtttgaaggtatcaaagatgaatatttatgaaattatacattaatgaaacactttcaaatgcctttcccgtccccacactgaacacagatacactcactttccaagctaaagtactggaatcatggcaatttcttccaatcagtgccagctccataattgatgagttttcacttccgttatttcatttgagtgtagtgatgatgtggatgttgccctcttaca

SEQ ID NO: 209579 - DNA, 676 bp, Homo sapiens
accacacataaggaaatactaacagatattcttcagacaactgagaaacacagaaagaaataaagaacaataaaaagcataaatatatgagtaaatataaacatttgcaatacaaaataagaataacaatataaaataacaagaattccatgtgctatttaaaatgtatacagaatttaaagaaacaaagcagatcacaaaaaaaacaacagaccatacaagctcttaaaaacaaattgccatattcttaggaaaagattgtttcatgaccatgaaaacaattactagagtgagttttacacctgtttaatcaaagacgactgttagactcgtcaaatttttgaaagccagtcagtcagtaatagtcatgcttctgaaattcagacaatcaagagttaacactctagtgaacaaaggcctacaacatccagatattttttaaataggatgttacgtatctttatattattaaccttaacaataatggtactctttttggataataaataaatgaagaaaaatgtccttgcactagaaaagaaagatacaaatattcttgagacttaataggagctgtcatcaaggcaacactcagaaacaatatacctacagctcctgatcaatctcttgtgcagctctgggttccttttcatatatggaaattagactcttacca

SEQ ID NO: 209580 - DNA, 427 bp, Homo sapiens
ggacagtgatggccagacttggggaatagctgtgggatggcaggatggtaagaaggtttgggagctgagacagattctgaaggcagagccaacagaaccagcatgtggatttgtgtggggcagggttcaaaggaaggagggacacgggagagctctatgggggaaattattgtattgtttccaagtagagaaccctgatgggaaggccttgaaggccagggtaagaagcctggcctttgtcctggggtctcaggccccatctgtttctgaaaagctggcccagggcagcagtggtgtggtgaacggtgcaaggcagaaagaaatggggccagggagggccaggtgaaggctatggcaacaatcaggctggaacagacaatgaccctggctatgagttccagggcccacccttgactactcacagact

SEQ ID NO: 209581 - DNA, 636 bp, Homo sapiens
cacaggataattgtggtgaggctgcttcttcctctactctttaacactaaacaatgtaattcatactatcaacacttccacccctcatattagctgcacctgctagccttgtggccactgctatcctttattcacagcaaatgactaatggatgcagtggctcttcttataaagacaagaactctagaggttaacacaagttctagatttcctctatcataactgcctgtattcttatgggtaagttattttacttttttgggtttaagtttttatatttttgaagtcaagatcactttcactaccaataaaaactataaaagacaaaatattaactacgtgtgtgtacacacacacacacacatctgcttgaagatataggaacgtgaaacagcaggttgtatagaaattcttggccaagatacagaagatggaaagttagagaggtgaatacaataattaaagttggatgcctcaagggataatttcactactttcagagatagagcaaaactattgacaacttcacatggttagagaagcgaatgtgaaagtccatggctcactaaatgtggggcattggcaaatctcttgtacatttagttgggattaagtaatacactaaaagtaattcat

SEQ ID NO: 209582 - DNA, 731 bp, Homo sapiens
tttccatccccactcccaaatgcacagactttacattacagccacactacactccccttgctatcttttccctcttcctcctttcttgcatcctcagcaccctgctcaagggttctttggggcatattttgaccctcggcacctggatgagggcttcctacttgttagtttataatagaatttattcccccatactgtgattgtggatttctacatctgtctacaacttggctcagaattcttagacttcctggcataggataggtcatccatgaatggcagtggtgctgctacctgcccttccttccttcatgtcttccctccacctttctctgcctgtgccctggcacaggagattgagtctcagacatcactgtgttgccttgccttctgttcatctgaaagagcgccttgcaggggatgaggagagagggaggagaccaagggaagggtgttgactgctgcagctttctcccctccagaaaggtcacagctcctcccaaggtgacctttcaggttctaggacctgctccctcctccacccctcccactctcgcttacttagttcactcctccacgatacctctgccccgattctctcaaccggctcacagggttgtaaatagtgcctttagtcaactctgcttgaattatctgtctatttcctgctcgaatcccatggagaccccattatctttaccatgtatcactgagagtgcttatcatcatgc

SEQ ID NO: 209583 - DNA, 354 bp, Homo sapiens
ccatctgaaggcatgcctcacagcagagaaacatcaactcacctgaaagggaagcaatggacagttgcattaatgaaattggatcatgctttctgcttgttattaaattttactttctgatagttaaggaatgcttgtaactgaggaagtaccgacttttctggaaggcatatttcccagatttgtaagaagagttagaaccacaaaaacatggtagcaaaaaaggtaactcaccatgtcttttgggcttcgggtaccccagcctgaaaatttggttctatttcagcaatcaggtaatttagtagtatttgtctttttatattcccatttaaataaatctagactgtattacat

SEQ ID NO: 209584 - DNA, 513 bp, Homo sapiens
agaagagcaaagagggaaaactaagttgaagaaataatggttgaaaatttccaatagctttaagatattaattttaatctcacgttaatcactatgaaaataactgaaaatatacagaaaaggaaatgagaagagtaacataaaaatgttaccataccaaaaaccaaaaatcaattaaacaccaaagtaggcagtaatggaggaagtgaggaacataaaatatatatgacaggctgagcacagtgggtcacacctgtagtctcagcattttgggagactgagggggaagcactgtttgaagccagcagtttgagaccagcctggacaacatagtgagacccttgtctatacaaaagaaaaaattagccaggcatagtggtgcaggcctgtagttccaactgctcaggaggctgaagtgggaggattacttgggcccaggagctagaggatgcagtgagctatgatgacaccactgcaccctaccctaggtgacagagcaagaccctgtctcta

SEQ ID NO: 209585 - DNA, 652 bp, Homo sapiens
tatggcaaggcgttgtgcacagagaactagttctaagaagttgtcagaccaaatggatacatagtgggtacatggccaagtacacatgtgaaatcctttttcccagaaaattcaaaataatatagggagcagggagatgcttcctgctagagacctgggcgggctgtatgatgcccagcttccaaaagatgtcacagcacaagtgtccaaatgaaaactgacttaggaaaggtatgagttgagagtaggcttaaagtcagggtttacttcttacattcagggagagaatgaggatacaaggggaagggttttctgtgctaggattgcttgagaatgagaggtaactattccatcattagttgtattgtgttttgatacagtttactctgtgtgaataatacagctctcccctgggggaataaaagtctgaccacttcaagctttcctttgcctatgtatagtcattttcccagcggatttaccttgcttatagttgctgtcttatccttcactttgaaaggattttcactatgaattgatttcaaagtgttaggctagccaaagcataagaatgagttacattgcaaagtgttggcctaggagaggtgattcctccaattcattaggaagtcagtaattacatgcacactta

SEQ ID NO: 209586 - DNA, 444 bp, Homo sapiens
tatggcaaggcgttgtgcacagagaactagttctaagaagttgtcagaccaaatggatacatagtgggtacatggccaagtacacatgtgaaatcctttttcccagaaaattcaaaataatatagggagcagggagatgcttcctgctagagacctgggcgggctgtatgatgcccagcttccaaaagatgtcacagcacaagtgtccaaatgaaaactgacttaggaaaggtatgagttgagagtaggcttaaagtcagggtttacttcttacattcagggagagaatgaggatacaaggggaagggttttctgtgctaggattgcttgagaatgagaggtaactatttgagatgaagtatatgttaattaccctgatcagaacactatacattatacatatacactatacctttgtatacacatgcacaacttgtcgagatt

SEQ ID NO: 209587 - DNA, 615 bp, Homo sapiens
gtgggaacaccaaggaggaaatgacacactgctggcaggagatggaaagcaactggagtcttcatggagcgatgacatttgagctggtcctcaagtagtgggtgaggattacatccatgcaagagccctgtgaacccagatactgaagtatgtctaatgacaaggatgataagttgatatggaaaaaaatatcacaggtgtttctgctcacagcaagcccagcagtactccaagagcagtacttaacttgggtgtcatgggctatgctctctatacagaagattacattagagtcttgtcttaaaaaccctttttgggaaaattatcataattcatttttttctaatatccaatgacttttacgcttttgctactttgattcatcagtacgttgatgataccttctcctctttgtcccattcctgcttcatgataatttaatgaaattaaagtaatggatttaattagcacctacatctatgattatatgtatatattatttatctgaaacctttggggtgggccagctaccacaattaaaatatcaacttgattcaagttgtgtgaagcacactttaaacttgaaataaaagtgaataaaatctaaaaaaacag

SEQ ID NO: 209588 - DNA, 472 bp, Homo sapiens
  misc_feature (444)..(444): n is a, c, g, or t
atacaatcagcagtacacccagacagagagactggagaaaatagaaaggggcaggagagagagcattaccaaagaaataatataacagaattttccagaggtaaaggacatgagtctttggatttacaaggtctacaaagtacttagcacaaaggactggaagacacaactagatgtgtgtgaagtttcaatagcaccaaggataaggggaatttcttgaaaatttcaagaaaaattaaaaatgtcactacagaggaacaagtatcagaatggtggcagattttctctcctagcaactctgacttatggaaaaccatggagccaagccttcaaagttctcagtaaaaattactttcaatctaggttgctatacccagctgaaaccattaatcataatgaggacagaataaaggcatttttagacatgtaagactgctattgaancttctaaactaggggtaccggccgatcg

SEQ ID NO: 209589 - DNA, 784 bp, Homo sapiens
ctttttcacaaagggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaacccgacacagtagcatttgtgccaatttctggttggaatggtgacaacatgctggagccaagtgctaacatgccttggttcaagggatggaaagtcacccgtaaggatggcaatgccagtggaaccacgctgtttgagggtctggattgcatctaacaccaaatcgtcca

SEQ ID NO: 209590 - DNA, 173 bp, Homo sapiens
cattgtactccagcctggatgacgggagcaagactctgtctcagaaaaaaaaaaaaaaaaaaagattgactataggcccccattctcctctggtttgtgctgaaaggtctgctgtttgttagttgatgggtttttttttgtaggtgacctgtcctttctctctagctgccttt

SEQ ID NO: 209591 - DNA, 208 bp, Homo sapiens
ggagtcactgggctttttgcatttgtgtctttgtatctttcatcagttctagacaactgtctgccattctaacttctaataatgcctctctcccattttctttcttctttttttttgagccggagtctcgctctgttgctaggctggagtgcagtggcacgatcttggctcactgcaacctccacctcctgggttcaagcgattctcc

SEQ ID NO: 209592 - DNA, 259 bp, Homo sapiens
agggctaggaacaagtgtatgtgcttagagctttgaaatgttgacaacagcagggaggccaaaatgtttggagcagaatgggaatgaggggaaaaggtcagagaatgcacagggggccctgtcatataggccattctaggccattagattttttattttattctaatgtaggccattctaggccattagacttttgattttattctaagtttaattaatacagtatgttccaagagatacaagagagtattttcaccag

SEQ ID NO: 209593 - DNA, 334 bp, Homo sapiens
acataaaaattattagaataaatgaattcagcaaagttgcaaggtacaagagcaacacacaaaaatcagttgtactgctatacactagccaaaaaacaatatgaaagtaaatgaagagaacaatttcatttacaatagcaccaaaaataataaaataattagaaacaaatttaatttaaaaggcacaaggccgggaagggtggctcacacctgttaatcccagaactttaggaggccaaggtgggtggattgcttgagctcaggaattcaagtccagctggggcaacatggcaaaacctagtctttacaaaaaaggcaaaaaattagccaggca

SEQ ID NO: 209594 - DNA, 1440 bp, Homo sapiens
gaagtctgcccggcctggccgccaagtgtcactaggtatccgcgtcaagccggaaccatgtatagcagctccttgtgtgtagggagaaagttaaaactgccatctaagggtgtcgatgggaagactaaaagtaggctcacccacctgctgtgaagcagcgcgcgcgagctgttactaacagtagtgaaaagccgggatccctgcccccgaggcacgcactggggcgccggctgacccagagacctgagggagactcattgccggactgcgttggaggagagagccaggggctggggcccggtgatggagcctgccttggggagtgcatgtgttggagagaggtgggaagcagataggataaccctgacctgagccatggagacgcaaggacaggactggtagacgggtcagtgggcagcaacttaagactgacctcgcttgagcctttgcctgcgaacgaggtataatacccacctcgggggcttgaggatcaaatgaggggctccacccacggcaaagtgtcactaagcgggatggaggaggatgcaggaagaggagtctgggaggacccgctctgaaaaggatggaactcgagagcaccattttcagggacgaagataagctgtttatttggggcaggctgtggggagagctgtgcagcaaacagccacccggggcccagggcagaggccttccaggctggctcgggcacttctgggtcccatgtccctggttttgcatcatccataccaatcactccatgttgctatgttccttcaccagaagactgggggctcaaaaagggcagggcagccctcactcaccagtctccccagcctcacccagctcagcacagggcaccaggcaggggctgagagtgctggggtaggtgggtgtggtcaaacagcttggaaagagtttggcctgctcattgcattcccctcagctcatcctggggatgtctgctcatgggagaatggcagagggatccccaacagtcattcctgatactcctctccctgtatcatgtcagcacatagtaggtgtggcctatgtatggcagattcatttctgcccccaataggatttgctgtagtttggatgtgtgtcccctcaaaatctcatgttgaaatgtgatcccaatgttggaagtggggcctggtgggaagtaattgggtcgtgagggcagatcccttatgaatggttcagcaccatccccttggtgatgagttcttgcttagttcacacaagatctggttatttaagagtctaagacctccccttctctcttactcctgctctcactatgtgatatactggctccccatcaccttatgtcatgatcttaagcttcctgaggttgcaccagaagcagatgccagcaccatacttcctgaaaagcctgcagaactgtgagccaattaaacctctttataaatt

SEQ ID NO: 209595 - DNA, 1565 bp, Homo sapiens
gaagtctgcccggcctggccgccaagtgtcactaggtatccgcgtcaagccggaaccatgtatagcagctccttgtgtgtagggagaaagttaaaactgccatctaagggtgtcgatgggaagactaaaagtaggctcacccacctgctgtgaagcagcgcgcgcgagctgttactaacagtagtgaaaagccgggatccctgcccccgaggcacgcactggggcgccggctgacccagagacctgagggagactcattgccggagctgcacagcctgtggggctggaggggaaccgtcgcccttggcgggcttccccaaccgccaaggcctgaggaccgccgagggcgtggcgggagcctgtcctcggttttacaggccggctggggagctgcgttggaggagagagccaggggctggggcccggtgatggagcctgccttggggagtgcatgtgttggagagaggtgggaagcagataggataaccctgacctgagccatggagacgcaaggacaggactggtagacgggtcagtgggcagcaacttaagactgacctcgcttgagcctttgcctgcgaacgaggtataatacccacctcgggggcttgaggatcaaatgaggggctccacccacggcaaagtgtcactaagcgggatggaggaggatgcaggaagaggagtctgggaggacccgctctgaaaaggatggaactcgagagcaccattttcagggacgaagataagctgtttatttggggcaggctgtggggagagctgtgcagcaaacagccacccggggcccagggcagaggccttccaggctggctcgggcacttctgggtcccatgtccctggttttgcatcatccataccaatcactccatgttgctatgttccttcaccagaagactgggggctcaaaaagggcagggcagccctcactcaccagtctccccagcctcacccagctcagcacagggcaccaggcaggggctgagagtgctggggtaggtgggtgtggtcaaacagcttggaaagagtttggcctgctcattgcattcccctcagctcatcctggggatgtctgctcatgggagaatggcagagggatccccaacagtcattcctgatactcctctccctgtatcatgtcagcacatagtaggtgtggcctatgtatggcagattcatttctgcccccaataggatttgctgtagtttggatgtgtgtcccctcaaaatctcatgttgaaatgtgatcccaatgttggaagtggggcctggtgggaagtaattgggtcgtgagggcagatcccttatgaatggttcagcaccatccccttggtgatgagttcttgcttagttcacacaagatctggttatttaagagtctaagacctccccttctctcttactcctgctctcactatgtgatatactggctccccatcaccttatgtcatgatcttaagcttcctgaggttgcaccagaagcagatgccagcaccatacttcctgaaaagcctgcagaactgtgagccaattaaacctctttataaatt

SEQ ID NO: 209596 - DNA, 422 bp, Homo sapiens
aggcttagaacccaagtcacctagattagtagtcctccagtaaaggcgattgtgcccccgggggacatttggccatatctggaaacattttgggttatcacaactgggggtagcgtgggctactggcttctagggggtagaggccagatatgctgtatatatatcctgtcgtgcctaagacagccatcacagggaagaattgtctggtctaaaatgtcagtagtgccaaagttaagaaacactgacctggatcctcctagtatgtttcttttagccaaaagtacaaagttcctaacttgtctcactggcaagacattttgtttgttcgttttgtttgtttgtttttgtttttcatatcttgctgtttccatcactggcagttttattatagaggaagcagtttgggaacgtcgctactgaga

SEQ ID NO: 209597 - DNA, 377 bp, Homo sapiens
ttcttctcttgaaaaaacatttttttaaagtcgtctaaatgattaggggcagaaataagtatctgaagaagaaatgtggtagcccctcctgggatgtggaatcctgaacaacccccaacatgagagatccttcatgagagattgggtcaacatggtattctttcaggggaaatctgtgcccatataaatgaatcgtagcacagacctgagttcagatccttgccttggcatttacaacttgggtaaacttgagtagagggagaatgaagagttttggaactcctttctctcagctgtacaatggagactaataacgcttacccaatgatattcctatgaagactcaataaaataataaaaatgtgcttgatatcatt

SEQ ID NO: 209598 - DNA, 509 bp, Homo sapiens
tagagtgcacaagatggctcaaaagggattaaggatgaatggagagatgggagattttgaccagaaactaaaatactggagtttaaatggctcaaggcattccttaatctactcaaagtgacacctaagattaaccatcacaaatggggatgaagtctggattagcgagagtctggaaagaccaagatcaggatgtcatcatggttggattctgctgagggcccacctctggattcatagaatggcaccttcttgctgtgtcctcacatggtctaagggactaaaagccctcatggcctgaccacctcccagtggtcacacctcctaataccatcactttgggggttaggatttcaatatatgaattccggggagacatagacatttagactatagtacctgccttttctatatgaactttactcctggaaaacaaaacagtagatgagagaatgtgtgtttttatgaaagtattccaactcaaataaaacagaaatgatagaaaatca

SEQ ID NO: 209599 - DNA, 329 bp, Homo sapiens
gcgcccggcctgtctcttcctttcttatcctctcttgccttcctgccttctatcatgggatgatgcagcacgaaggccctcaccagatgtaggctccttgatcttggactttctggccccagaaactgtaagaaataaatctctgctctttgtgaattacccagtctcctgtattctattatagcagcacaaaatgaactaaggcaaacgttgttatactatgagcatgtccttgaaaagtcaaggataagttaaatgttagcaaatggaaatgtgttttttaagtgagctcattaaagaaaccagagcgattttttctgtaaactaaa

SEQ ID NO: 209600 - DNA, 539 bp, Homo sapiens
tatctcgatgctcatttcaaccacaagactaaggaaaagtgtagcagcccaagaggaaacactctgtagcttggcattccaatatgtgcttgccagtgagtcatgggagtgctgatgcccgtgtcctgcaccaagagaacacgaagtccacggatgtgtgctgttaactctccatcccgtatgggttggtgactgcactttcctcaccatcaaatcctccctcctcacacctgtccagtggcagctctgccccttgttgatacctctgttatacgaaaggtagataaggagagtgaaaataatgggagacagtattctttgctggcaatttttttaaaggggtttaggtgaagctaaaggttgaaactaataactaccaagtttctggatcactggatctctacctcatttttaaaaactcttataatggaaaatttcaaacatatacagaagtatctgtcatccaatccaacaatcatcaattaatgatttatgatgttttatctatctccctcctctacttccccctccctgtagat

SEQ ID NO: 209601 - DNA, 279 bp, Homo sapiens
acttagttcggtgtgatggccatcacctgtggtccctgctactcaggaggctgaggggggaggatcgcttgagcccaacagtttgaggctgcagtgagctacaattgtgccattgcactcaagcctgggtgacagagtgagaccctgtctcaaaaaagaaaaatttcagatatttgatgataccaaataatacaatttttaaagtaagataacaatactgttattctttttaaaaaataattttcttttagaaattaccctgaaatattggccgggtga

SEQ ID NO: 209602 - DNA, 293 bp, Homo sapiens
acatcctttcagagttgctccaatataaaaaaagacttttcaaatgtctagcttaattaaacattttaatctttagaaaccctaccttggctcttttgagagtcaggttcatggtttcggttgactggcaccacaaagaggaagcaatgctgttaatgtaagttaaaaaccaagagagttttgtgatggaaagaaaacaaaaaagaaatcctagcagtaactatagtatttctatgctcattcattttacggctggtgccaaccaagaggtatcaaaaagagagaaaaaaaaa

SEQ ID NO: 209603 - DNA, 329 bp, Homo sapiens
caatgtttattgtaacactgttcacaatagtcaagaaatggaatcaacctaggtattcaacaacagatgtatagatagagaaaatgtggtgaatatactcagcggagtactattcagccataaaaagaattaagtcctgtcatttatggcaatatggatggaactgggggacattatgttacgtgaaataagccaggaacagaaaattaaactctgcatgttctcactcatatgtggaagctaaaaaaaagtttatcccatagaagtaaaagtgccttattaactatttatgtgattatttttaataaaatgttttatttgtaagtttt

SEQ ID NO: 209604 - DNA, 616 bp, Homo sapiens
tcagcgcacgatggcgcgtccagtttgagaattggtgtaagacatcacaatcccattattcagagcgcgtatggagtggaaacgcttatagggtttcaccaggatccacctctgatgttcagtgaagagtaccagaaaagtctgctagagcagtaccatctgggtctggatcaaaaacgcagaaaatacgtggttggagagctcatctggaattttgccgatttcatgactaaccagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcctgtttacttgagcaagactgataccacctgcgtgtcccttcctccccgagcaagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaa

SEQ ID NO: 209605 - DNA, 539 bp, Homo sapiens
tcagcgcacgatggcgcgtccagtttgagaattggtgtaagacatcacaatcccattattcagagcgcgtatggagtggaaacgcttatagggtttcaccaggatccacctctgatgttcagtgaagagtaccagaaaagtctgctagagcagtaccatctgggtctggatcaaaaacgcagaaaatacgtggttggagagctcatctggaattttgccgatttcatgactaaccagtttctgcaggctggaaatccaagatgaagtcacctgtagttcagtgtctgcgtctaagagagcactttgttgctgcacccgccatggggaagaaatactgtatcttctcatgaaggaaggaaccgaaggtgggaatagggaccaaactccctctttcaagcctttttgtagtgacattaattcatttatgaggatgccaccatcatgacataatcatttcccaaaggatttcacctcctcccactgttgcattgggaattaattttccaacacatgaattttgagggacacattcagaccat

SEQ ID NO: 209606 - DNA, 639 bp, Homo sapiens
aatgaacactttcacctggtaaagacaaagaacaagctctttggtgcctctttttgtaagggcaccccatcatgagggccccacccaaaggcctcatctctaaatgccattacattgtgggttagggcttcaacatataaattgcaaggagacacagacattctatccataacatccaccaaagccttttctatcattggttgagagctgcttcacagggcagtaacccttcagcgtttcctagttatcctacattcatgcagagcatgttcccatagccagaacaaatgtgtaaagccctcaagcagagagttagaagcgtttgcagtcattgtgtaaaggtgactgctgggaggatgtggacagggaaccacagacacaaccagcagcagcttttccacttactgactggtctcagcctcagataggcctttagtgctgcctggcaatcctgttgaatttctctagtcaactctctctctccttcctattcctcatactctcttaaacctccaagtccctctcacgcttcaccctcacctttgacctcaattcctctttcattaaaacaactgaggccatcagaagacaactccactttttccaccagtaggactaccccctctctgcatctgtgtc

SEQ ID NO: 209607 - DNA, 504 bp, Homo sapiens
taacattagaaagggaatatattattcttaccagttagtaatctattcacatttggtttagagggaagatttagaaggtgagataaaagcttgtgagagaatagtgtattcatgtgaaacttcttccatgggttcagagcatttagaaacaaacatcccttcacactcaaagcttacctttgagccagtcctccaatagtgaggtctttgaaggtcaggccaaattggctgtgggaggacctcaggttaggataggaattattttaagacatggcactatattcatgtgaaactcgcaaaaactagccttgcatataggctcatgtatcatgtctcagctgagatgtttgagagatcttaactagattctagaaaacaaaaaaggaagtagttttggggcaaatatatttgggaaacagtttattgtatttcctttccccaaatggattttcaagttcttcatataatctaaccccaacaaataaattgcctgtttttcaaaag

SEQ ID NO: 209608 - DNA, 452 bp, Homo sapiens
aaccccaccacaaacaccagtggcttcaagaggagggaagcagattcctcttttggaggcaggtaatccagggctagtgtggtagctccaaggtcaccagagacctggctccttctgtgctgttgctctgtcagcctcacctgctgcttctggtccaaaatgaccgctcacaattggcaaggtttttgtggtcttgataaaatgtatcataagagcaattgtaatgatgactcgccagccacgtgggggcttctctcattgtctttgggtgggaatgtcatatcatgcagactctgtggtgggaccagccacctgtcagcttctcactctccttcacctagccacctgctgcttaggttactgtatgaggaggtcacacctgtagggaatgatggtagaggatacccaggacagagagtgggagtcctcgctctgcagcagcaaagttagcc

SEQ ID NO: 209609 - DNA, 230 bp, Homo sapiens
ctctagcaggactccccattacataaacagagaggcttattgaacttgaaagtagagattcactgcttgtcaatctagatcatgaaggatttctgtacaaatgcaggtagtaacaaggtcacggtagctcaaactctgcttgtgcattcaaattcaatccagaaacctccaactgctaaaaccataaacgttctatatattatcgcctcaatattttacatttaatgtat

SEQ ID NO: 209610 - DNA, 279 bp, Homo sapiens
tatatttatgtatatatttatacaacataaaatatattttattatttaaacataaaatatattttattatttaatatagattcttaagtgataaatatgtttaatattattaaaataggttaaaataggttatagttagtacagtgaaaattggcagcccttttacaaaacatatgccataactatagcatttatcactgacagtcataccaggatagtcttttatttccaatcacttaaatattcctaattgcaaaagaaatttgaagactaaaattc

SEQ ID NO: 209611 - DNA, 360 bp, Homo sapiens
ttagttcgattattagaagactagattattgctcagcagtaaccactcctttcccacaaactcccctctctaggaggaatgtacctccccacccattcctgttaggcttggccaggtgaatcgctttggccaacagaatgtaactgacaaggtgagcagagatttgcagtgggcttgtgcttggtgctggtcctccggggctcctgcctttagccaggggaagcacactccccagcccctccttagccctctggccctggggagaatgagaggcatgtggcacagtcctggacccagccgtggctgggagcaagcctggaagcttgagcgagagataaatgcttggtctttttgtttgag

SEQ ID NO: 209612 - DNA, 551 bp, Homo sapiens
gtcatagctgtactagagtaacattgttatctgctagccattatattcttttggcctcatgatcataccacttgacttaggagttaaggtcgtgtggggcttcatgaggtcaggttttctgataagttctctcatagctgaccctgttccgaggaaagaacagtgtgtcttctcttcttgaacaagggtaaggactacagttgaagaaaaagttattctggtggtaaggaagacctcagtcaagaatactacaatgtaagtcatgactgttatcacaggggagagagattaggttcaactctgaatacagtgaagacaattggggatttatagctaacaagcagagtgaggtcagtgcatggaaagttactaacaggaaacatcaagttagggggactcgtgctaaactgacttaataggattcttgctgaaggcaggccaggatgatcagatgttgggggaggggatgaggaaattgatcagatatagagggtgccttagttcattgggctgctgtaacagaatactatagactgggtggcttataaaga

SEQ ID NO: 209613 - DNA, 195 bp, Homo sapiens
gacatttgactttagcaaaggaagattctggcttaaataatttggtgttggttttctccaaacagggatatattattgactggtagcaattttccctccttctcttagctgactgagaacttacctttgtttaatgagggattccttatttagaacttcagaggtcaggtaaaaagatttcatggccttacctgg

SEQ ID NO: 209614 - DNA, 607 bp, Homo sapiens
ggactcctgaatatttttcaaaactgaacaatttcagccatgtctgagctttccgtcttcctggaggcacaaatctagtttagctgaaccacaacagattgtacatatcctgcagaacctctgtggtcttaggaaggttgaaagtcaccaaatgtcacagaaaatgagggtcaggaaaggctgtgatcacaagctcttgatccagaggccactcgggtgcatctgtgtgactgacacctcattgcatcatcatttcttgtaaaatcagcttaattttgcagagaaatggccacagatttttagaattatgctgaattatgtaagggagcagccattttaaaaataatgtaatcaaataacaataataacataacagaagtttctgcaccacactgacactgaacatggctgtcaaccaactagccaaaccaaggtgaaagattctctgaacttcagttttaacttacttcgtccattctcccttttcagatcttatttcttcttccaaggcaactatatccactgtgaactgctgcatattaaacattcaaaacatgtctgtatctaacccagtgatggctacagcattataaaataactcctaagt

SEQ ID NO: 209615 - DNA, 430 bp, Homo sapiens
agaacacttaatagtgattcacaactttgtacattggaaacatctggggatcctaatgccagatggtttggggtgtggcctgaacagctgggcttttaaaaacctccccaggtgattttaatttgcagccaagattgagagccactgccttctggaaataaacttattttccaaatgaaatcaactattgtttgattgaatctggcatcatttctgagacaattcaattagtgttgtaccattatttcataagcaaatccttgggttaaaaattttagagctgtttggcttaagaaaaaatttaatctgctctcatccaaatgaaagatctacaggtaatggaaaccagagcaaattatctaacctgcctaaaccttggtttgttcattctttttgtactggaacaatgaaagttctaatgaaagccagc

SEQ ID NO: 209616 - DNA, 482 bp, Homo sapiens
gatacatcagcagcacaactttagattgaaacttttcttagaaagcactgaaacacaggctctcacaggagactttcagcacagaaaatggcatgtcaacattgcactgatatccttagatgggtcgcatacatattttatgaatgcacgaaaacagtctcacaataaattttagagtcatgtttatttcatatgcacgtgaacatggaacctacggaaaatttgcaattttcttttgatgcctgaccagaataaccagtaggtcaaagaatgtcatttacttgaacctatggtttgggggcagaggtctgtggagcagaatatgaaaacacctgatagccaggcgcggcggctcacgcctgtaatcccagcactttgggaggccgaggcgggcggatcatgaggtcaggagatcgagaccatcctggctaacacggtgaaaccctgtctctactaaaaatacaaaaaattagccgggcgtg

SEQ ID NO: 209617 - DNA, 183 bp, Homo sapiens
attttaatctacaatagaaatataaattcataaaacactaaaaattcttaaataagaatttattagagtaactcttaaatattacttagaaatgagtaattcttaaattagagtaactcctaaatgttacttagaaatgtcttcccattagcaagttatattatattctcacctttttttttt

SEQ ID NO: 209618 - DNA, 262 bp, Homo sapiens
tcagacgctgaactatgtgtagtgggctaacacttgtgaagccactgtgctccaccctgggcaacatagcaagacctcatttctaaaaaaacataagaagaagatgatggttacaaggtgagaagactggtgaatttgggattaaaccaaatctctaggactgatagtttccctttatttcctagttgtcaggccctatgctggatgtctttgcatgcgtaatcttgttaaatccccacatagttcagcgtctgatagacac

SEQ ID NO: 209619 - DNA, 593 bp, Homo sapiens
gccaggcagtggtagtgagaatgataatactgatagtaaatactgtcaacttatctaccacacaccagaaactagtctgggtacttttacagctgggtaatatatcagctaatctagttctcagactaatcctgcagggttaactttgatgcctagaggtggtcaataccatcgcctaagttcagacaagtttgtgtaaatgctggaattgcccatggctaattccagaggccaggtttcctgttctaggctattttgctagacaacgaagataaaaacatcttggtgttcaattttaagaggacacagggttaaagaaatcttaacagaagtcctgctatttggagcttccttggcagaggcaaacataatattatgttattatggtatttaagaaataaaaatatttttcatatattcactagtgatggtggcttagcttttttttattacagtaactacttaatattttgtatgcaaagattcaagttatacatttcctgcaatgacacttgaattcaacttattcagagctaatctcttctttgatccttggtttccccatgtgtaaaactggacaatctttgacctga

SEQ ID NO: 209620 - DNA, 274 bp, Homo sapiens
ggtctgtcatgactgtgtgccactctggttagtgtgcggcatgagcggtagtttgttcgtgagtttagatctgaaagtctttaggatgctaattagggtgagatccttacaatcacggctcagtggtcagccctggagctcatcaacagctttacagtgtagctttcccaagcatacatatcttcatggtctccctggtactctctggtttcctgcagctcttctttttggctctatcgtgagaaactcgtctaaatggaggaagggcacagag

SEQ ID NO: 209621 - DNA, 431 bp, Homo sapiens
ccccttctacctctgcaacctgacccagcaagaccaaccccttttcttcagcctaggtaatgtaaagacaaggaggatgaagatggttgtgatgatccacttccatttaatgtacagtaaacgtattttctcttccttatgattttcttaacatttttttctctagcttactttattgaaggagcacagtatataatacagatcacagacaaaacgtatgacaatctactgtgtatgttattggtagggcttctagttaacagcagtagttaagtttttggggagtcaaaagttacacataaattttcaactgtggggggaatcagcaaccctaaccactgtgttgtttaagggtcaactgtagttctcaactctcttattttaacttgtttctgccatagttaattacaaattcaatttctacaaatata

SEQ ID NO: 209622 - DNA, 540 bp, Homo sapiens
tcttgcatcatctttataccaactatgtcagatattcttaaccccattgtatgggtgagaagattgaagctcaaagacgttcagtgtttgttcagagtctatactgtgaacctcccatttaacactgtgccttaagtgtgaacagcagcttctgcagattctctttaccagggtgaagatttgctcatgactatttcagaacaatgggtcctcatagccccattctcactgtactctatctcaggaaccattctttttttgtctgggctactctagaggagagctggaagaaaactgggtttcatgataatggacacagtagaaacaaagtggtcaagagccagtaggcttgggttggtattataacaccagcatttaccagctatatgggcttgggcaagttacttgaccactccagactttggtttcctcctttgtaatatggaacaataatagttgtaagaattcaataaggtagtacatataacattcttagcacagaacctagcatataattattattcaataaatggtaaaaat

SEQ ID NO: 209623 - DNA, 450 bp, Homo sapiens
cctgggtgaccgagtgaaatcccatctctaaaaaaatatatagcatatatttaatgttcctgcctgtttcctgactcagagcccctaaaactcttaaaatttctgaataagtgtctaatgaagtacattaatgagacgagtggcacctgtgtagtctcaggaggggtctggttgctagcagagctgagcaagtgattagagggttaaaacatccattgctaccccagctaaccccctggaagggggattgaaggttgagttgatcagcagtggcgaataatttcatcagtcatgccaacgtagtgacacctccataaaccccaagaggagagagagagactttgaactagtacacatgatctactttgatatttatgacctttgggagaagatgttttatatgaagcagaaataaagtgtaagccaacattaaacaaaattctctgtaac

SEQ ID NO: 209624 - DNA, 1385 bp, Homo sapiens
agcactgtgggaggtcaaggcaggtagattgcttgaggccaggagttcaagaccagcctgagcaacatggtgaaatcctgtttctacaaaaaaaaaaaaaaatggctggatgtggtggcacgggcctgtagtctcagctatgtgggaggctgagatagatggtaggattgcttgagcccaggacagacctctagcaagactgaccaaaaaaacagagaagttataacatcaggaatgaaacaaggagtaccactccaggccctgcagccatcaaaaggataatgagggaatgccacaaacagctctacacataggaagttgacaacttagatgaaactgaccacttcctcaaaaaacacaaactaccacaactcacttgatataaaatagatcatttgaatagctctataaccattaggaaattgaacttacagctttaaaactccccaaagagaagtcttcaggcccggtggtttcattagagaattctatcgaagaattctttgtttaaagaagaattaacatttctatacagtctcttccagaaaataaagaggaaggacaacttcccagttcattttatgaagctagtattatcctgacactaaaaccagataaagacagtacaaaaaaaatcctttacagaccaacatcctcatgaattttgatgcaaaaaatatttaacaaaatgtttacaaatagaattcagcaatacatagaaagaattatacactgctgggtgtggtggttcacgcgtgtaatcccagcactttgggaggctgaggcaggggatcaggatcacttgagcccaggagttcaagaccaggctgggcaccatagtgagacccctctacaaaaaataaaaaaattaactgggcatggtggtacatgcctataatcccagctactcaggaggctgagataggaggattgcttgagtgagcgtgggaggtcaaggctgcatgagctatgattacaccactgcactccagtttgggtgacaaagtgagactctgtctcaaaaaaataaagaatgatacactgtgaccaagtggcatttattccacagatgcaaggctggttcaatattcaaaatgcgatctagagccgggagtggtagctcatgcctgcaatcccagaactttgggaggccaaggcgggtaaatcacttgaagtcaggagttcgggcccagcctggccaacatggtgaaatctcgcctctattacaaatacaaaaattagccaggtgtggtggcagacgcttgtaatcccagctacttggaaggctgaggcacaagaatcgattgaacctgggtaacagagtttgcatgagctgagatggcagcaccacacttcagcctaggcaacagagcaagactctatct

SEQ ID NO: 209625 - DNA, 1331 bp, Homo sapiens
agcactgtgggaggtcaaggcaggtagattgcttgaggccaggagttcaagaccagcctgagcaacatggtgaaatcctgtttctacaaaaaaaaaaaaaaatggctggatgtggtggcacgggcctgtagtctcagctatgtgggaggctgagatagatggtaggattgcttgagcccaggacagacctctagcaagactgaccaaaaaaacagagaagttataacatcaggaatgaaacaaggagtaccactccaggccctgcagccatcttagatgaaactgaccacttcctcaaaaaacacaaactaccacaactcacttgatataaaatagatcatttgaatagctctataaccattaggaaattgaacttacagctttaaaactccccaaagagaagtcttcaggcccggtggtttcattagagaattctatcgaagaattctttgtttaaagaagaattaacatttctatacagtctcttccagaaaataaagaggaaggacaacttcccagttcattttatgaagctagtattatcctgacactaaaaccagataaagacagtacaaaaaaaatcctttacagaccaacatcctcatgaattttgatgcaaaaaatatttaacaaaatgtttacaaatagaattcagcaatacatagaaagaattatacactgctgggtgtggtggttcacgcgtgtaatcccagcactttgggaggctgaggcaggggatcaggatcacttgagcccaggagttcaagaccaggctgggcaccatagtgagacccctctacaaaaaataaaaaaattaactgggcatggtggtacatgcctataatcccagctactcaggaggctgagataggaggattgcttgagtgagcgtgggaggtcaaggctgcatgagctatgattacaccactgcactccagtttgggtgacaaagtgagactctgtctcaaaaaaataaagaatgatacactgtgaccaagtggcatttattccacagatgcaaggctggttcaatattcaaaatgcgatctagagccgggagtggtagctcatgcctgcaatcccagaactttgggaggccaaggcgggtaaatcacttgaagtcaggagttcgggcccagcctggccaacatggtgaaatctcgcctctattacaaatacaaaaattagccaggtgtggtggcagacgcttgtaatcccagctacttggaaggctgaggcacaagaatcgattgaacctgggtaacagagtttgcatgagctgagatggcagcaccacacttcagcctaggcaacagagcaagactctatct

SEQ ID NO: 209626 - DNA, 398 bp, Homo sapiens
atcgaggcctggctgactttttcacctgctgattgtagagccacagtgccctgaatgaacatagacagttgttgtaaccgagtgagttacagagaaacgccacatgctgagatgaattcaggagtcctttattagccggtgaccaagagatggctagtacttaaaattctcttggccccaaagaaggtgttagattttcttatgtactttggtttagaaaggggaggtggggggagtctagttaaaacaatcttacagaagtaaagcaggcaaaaagttaaaaggataaatggttacaggaaaacaaacagttccaggtgcaggggctttaaatccattacaaggtgatagacgcagggctttgggtgttatcaactggacacaaacacaggggctct

SEQ ID NO: 209627 - DNA, 915 bp, Homo sapiens
atggcgatgaggctaatatcattccctgagaatagtaggtatcaatgatgtgactctgtgtaggagaggggattcaaagttaaatagggggtcaaagtaccacttggacttgtgtttcaagcaggaagcctctggaattaggtccagtgatccacaggggagaagagagctaggtgagcagttcttggagcagacagtcttttaatcctattggatgagcctgtattattgtctctgcagatgttctgtacccttctgcaaaagaggcaagctggcttttcccataactgatgaaatcaagagagcaggtctggaaaaaaacaagggaaatctccttatatcttactacgtgtaaaaagatgattctggaattcccgagtgcctactgaattaataaaccaggaagctgatttattttaccactctaaatccaacatggaagaaaccgtcagacatctactacatgtcatccagcagtacagattggagaagtaaactctgtcagcccacctttatcaaacagtgtaaataatcaccaaaccaagggaagcagaaggcagcaaaagtcgaataatttccaatgaagagtcagaggatctctctcagacaaagggaaatccttcaagtggagaggagatggtaggaggaaagtggcagcccagaggagatgagactgtggcaaattagaaagaaataaaacaatacccaaaggaactcaaaggagaggtgaagttcaagtcagggagaagagtaagtcaagaggactacctgccaagcatagcacagagcttggttactggctccactgtggagctggctcaccccatgggtagagtacaatccttcgagatccacaaggcacacacacacgtgcatagacacaaacacacacacacacacacacacacaaacccc

SEQ ID NO: 209628 - DNA, 650 bp, Homo sapiens
atgagctacacttacagcaaacaaggagagttgtacagcgatatagataacaaggtgacaaaactgcatccagagcttccttagtcttgtgaacgtctcttattagaagaatagcatacatctgtacaaattcgctaaaagtattattggagagtgaatttgcttgaggtctccccgggatacagtgtatccggggagaaacacaagaattatttgatgaggatgaccaattttctttctaggtaactctacttttcttccttatatttgtcttgattttttgaactattatctcattagtactcttccaaacctcttgcatccttgctttagcttttctacctagcaaaacctacaccctgagataaatgttgcaatctgctttctccatacctataatagatggctggaaactactggtggtatggagatatggggaagaagggaaccctgaaggtcgataccactacaaatccatgatctgtagcctcatctggatacttaatgtcacttgtcaattttctctcaccctgaattagctccttttctggatcctctcaatgactactccattatcattacagttgacccctgagcaatgcaggcattagggacactgaccccctcccccatgcagttgaaaatctgta

SEQ ID NO: 209629 - DNA, 304 bp, Homo sapiens
tatttttgtagagatggggttttgccatgttgctcaggctggtctcaaactcctgggctcaagtgatcctcctgcctcggcctcccgaagtgctgggattacaggtgtgagcctccgcacccagtcaatacactttaatccaagtcagtgtctatttaaattgtaagttagtttaactctgaaccatgagcctgtaccttggaaatatgtaatttagagtcataagtaacagttatctagctgagagtcatatgtgggttataccaaatgtactgccatcatgtgattataggttagtagtgta

SEQ ID NO: 209630 - DNA, 538 bp, Homo sapiens
cccacagtcacagtcatcatacagcccgtcaagtttcaccctgtaagcctggcattaccatcttccacattgctcaagctcagcccttatcccatggactacacaaactgcctattttattgcagaactgggtttagttttgttctacatttgttggctcacttgggcactgtctcagcctatctacttcatctacagtcagccaacacgcaactcaccccgcatcccagaaggcccagggacagaaacccgattcctccacgtcctcaccctggggcatcacaatgcctgttctcctttgttcaaagccatcccaaatattagagcttattgtcagaagcagacttagtttagaattaaagctgaataaacgggctataaaatcaggagtctatttgagataaaactacccgatctacggaagagagaaaaatgcagcatggcgactgtttcggacagaccagcagtatgaagagcaaatcctgaatgctggcaagcaacagtcgctgcactggccacagctacaacttgtttatga

SEQ ID NO: 209631 - DNA, 218 bp, Homo sapiens
ggccatgcacaggacggagctcttctggcaagcacagtactggacccatatggtccctccagggcgagtgagcttctgcatctagtctagtccccaggtcactcatgctaagctgtggtggtaggggtgatggcagcttgctcatgtggcactggggctgtatacgtgtctcctagggtcagtggcagcagtgttagctccgtcactgtggcaggagc

SEQ ID NO: 209632 - DNA, 646 bp, Homo sapiens
cacttggctaatttttttgtatttttaatagaagtgggatttcaacatgttggtcaggctgatctcaaactcctgacctcaaaagattcaccacctcagcctcccaaggaagctctttttaaatgtacaaccaaagactctgaggattcagctggtgttacttcagggctcccattgtgtgggaaccaaaaattactgtagtgctaacttgactgtctactgttagacatcatgttgctttatctctgtttcaacaaaagtagtttttgaaaactgcatcttttttagcattgtattggttaaccttttctgtaagaccactttatggggaaatatctgttcaggaagctgacacagaatggaacattaaaacttaggctttggtgagagaaaaattctttaaacagtggtctatatgcagtgcttaagtccttgcagtaaaaataagaattcaattacacttattgttgatcatgttctaaacctttgaaagctgtttatcaaaagtaatcaagaactcattatcactatgttcatgacaatcccaaacctagctaataagaaataggtctatatccatttgaatgacttaaaaaggacccttttatgcagaataagtgaaaagtacgactaccaccatattctt

SEQ ID NO: 209633 - DNA, 501 bp, Homo sapiens
ctcggtaccccgctagtcccaaccatactaataatgcaaggtgttaataagaaacattcagcatgagatttttaggaattttctatattatcttcacaatttcctgttaatctaaatctctcctaatgacaagtttatttaaaaagtaaaacaaaacttgaaggagggaggaaacaagaagggaggaaacattggagacagaaccagcttggcaagttgacagataaggtctgagaagtaggcaggggaaagatcattcatttcaggcaatatttttccattttacctgtataagaaccatatgagccctatttttctttctttcttttttctttctttcttttcttttttttttttttttgtagagatgaagatttcactatgttgaacaggctggtctcaaactcctggcctcaagcaatcctcccacctcagcctcccaaagcatgagccaccatggtgggcctgtatgaaggaactttttaaaaaatgctacaagcc

SEQ ID NO: 209634 - DNA, 563 bp, Homo sapiens
cattttatgcctgatattcctgcattctgtgggaggttattctttgcattgtaggatattaatagtatctttaggctataccaccacataccagtagcatcaccacctaatcattataattcaaaatgtctccagacactgacaagtgttctatggaaacaaagtcattccttgttggaaaccacttgtaaacaaaaagtctagtaatggtggaattatacagtgacagaaaagctcaggtttttctgattaggttgaaaaagctgctcagaaattaaatcctactgtgttcataaaaaacaaggaacccagccctgaagcaaagaactcatcagggaagttgttttctctttcaagtctatgatttcaaatgaccttaaagtggtcatctttacagtcagagaagcatatgtgtgttggggaggagaaaaaagaaggaaatgaggcagactttagaattatacctaggaaagaactgtatgtttggttataaactagatccaataaataaataaatggtttccacataactacttggcaaaggtacaataagcctattgtga

SEQ ID NO: 209635 - DNA, 396 bp, Homo sapiens
ccttacctaacaccatatacaaaaattaactcaatatagagccaaaacctaaacataagagctaagactgtaaaactcttagaagaaacaatagggcaaaagcttcatgacgctggatttggaaatgatttcttggatattacactaaaggcacaggcaacaaaagaaaaaacagacaaatcggacttcatgaaaattaaaaattttcctgcatcaaaatacactattaacagagtaaaaaggcagcctgaaaacaaaataacagaaaatatttgcaaatcatatatctgataaaggattaatatcctgaatatagagagagctcctaaaactcaacaacaaaaaacccttgtttcaaaaatgagaaaggacttgaacagacatttctccaaagaa

SEQ ID NO: 209636 - DNA, 611 bp, Homo sapiens
cagtcttactgcgtccatcagctgctgttggcaggtgtggtcaggtaggctggcactgtgtctgagcaagccagctctggtctgataacagagttttatctggaaggggaaacccagggctgggcttacgatctaaggtcagcagcctgtcacaccaagaaataaacatctgttaaggcaattggtacataagcactcagaaagtgtagcttgtcaaagtggcttaattccaactaggttgttattactcagttgacacctcttgggagagttttttgatattttctttaactctttagtgttatactttatgtatattcacatgaattgaaaacaggttcagttaaaagggtaattaaaaatataaaacattttttaaaaaagaaaacagggccaggcacggtggctcatgcctgtaatcccagtgctttgggaggccaaggcgggaagatcacttgaggccaagcgttcaagaccaggctggacaacatggtgagaccctggtctcaaaaaaataaataaaataaaatttaaaaattatctgtgcatggtggcaaacacctgtagtcctagccatgcaggaggcctgatgggagcaagatgggtaccga

SEQ ID NO: 209637 - DNA, 402 bp, Homo sapiens
ggcctccctcgtgttatccccagagcgctgggggccagtacagctggaggtgattagctcgcatctgaagtcaacatagatgggagagggtggagctggaggttgctttttctggaacgaatgtcactaggaaatggaatggggggaagaaaatgcagatttagctttatgacctatgaatggaaacttcatgatggtaaatatgttactgccctcagctgggatctggctgcaccagcatggaatggtatgagccacttgcaagggccagtctggttagaaagcaaggtgaggccacgcagctggggtggcacatggaaacactcatctcaaattaatgaataagtacaattcagctcttaacacagcttgtattagctaagtgctagaaaatataaactg

SEQ ID NO: 209638 - DNA, 633 bp, Homo sapiens
tatcactattatttccatgagccactactaggaaatctattggataatgagattcaaacagccaacatgacttgagacatctatgtaaggactagtgataagcataataaatacatctacatttaaaactaactgatgaagccagtcacaaaagggtaaatactatatgattccagtcatatgaagtaactacagtggtcataactcatagaaacaaagtggtggttgtcaagagctggagaaaagggaggaggagaattagtttttaatgggtttcagttttgcaagattaaaaagaagttcaagcaatttgttgcccatcaatgtgagtatagtcaacactactgaagtattcacttaagaaaagttactatcttaaccatttttatgggttttttaccacagtaaatgaaaaactattagcttgtaagtaaattaaaaataaaactaaatgatggttaaagtgagataatgatacaacccaaaacaaataaaaatatagggagaataagaagagtagaataaaaatacaataagtgggatgctgagacaggaggatcacttgagcccagcctgcgcaacatggcaaaactccatctctataaaaagtacaaaaattagccaggcatggtg

SEQ ID NO: 209639 - DNA, 372 bp, Homo sapiens
gggggctggcctgggtaagctttaaggatatcttcagagaagtcatttacttgtgttggaacaaaaataggtcttgcatagcagcagggacagaactgacttggaggtcggaacagggtcccagttcccccttgggggtcccaattccagttcctcttcttattagctttgtaaccactaccaccctgcagctattgagtgctcacattgtagccagtacacattgaaatgacctgagtgtaaaatacacgatgaattttgaagatttagtacaagaaaatgtaaaatatctcattactattttactagtaacataatattaatgttaaatgataatatttcaatatattgggttaaataaaatatatgagt

SEQ ID NO: 209640 - DNA, 306 bp, Homo sapiens
ctggggatggtgtggtgttctcattggctgtcctttctctattttctgtaggctctgctgggaatggtgtggtcttctcattggctgtcctttctctattttctgtaggctctgctggggatagtgtggtgttctcattggccagtggggtcctttctccgtgttctgtaggctctgctggggatgatgtggttttctcattggcaaatggggtcctttgtccattttctgtaggctctgctggggatgatgtggtcttctcattggctgtcctttctctattttctgtaggctctgctgggaata

SEQ ID NO: 209641 - DNA, 586 bp, Homo sapiens
aaagagggttggagctaatggtcaggcccaagaatgtggggatggagaccctgtgggggtgagctgagaagctaggaggaagcggtcagagaatggagatgctggaaactcacagagggaggaggggagccattattggtgacggcagtggctcccaacattggccagatgtccaaatcacccagggtaaccttttaaaatcccaaggcctaggctacactgaagcaattacatcagactctgtgagggaggacccaagtatcagtattaatttttaaaaatgcctcagaggtccgggcgtggtggctgacacctgtagtcccagcactttggaaggccgaggcaggtggatcacctgagggtcaggagttcgagaccagcctgaccaacgtggagaaaccccgtctctactaaaaatacaaaaattagccggcggggtggtgcatgcctgtagtcccagctacctgggaggctgagacaggaaaattgcttgaacccagcaggcagaggttgcagtgagttgagattgtgccactgcattccagcctgggtgacacagcgagacatggtctcaaacaaaaaaaaa

SEQ ID NO: 209642 - DNA, 499 bp, Homo sapiens
gttggttttttgaaaggacaaacaagatcaatagaccactaggtagattaacaaaaaaaaaaaaaaggaagatccaagtaagtacaatcagaaacaacaaagatgatgttataaactaccctacagaaatacaaaagatcctcaaagactattacgaacacatctatttacacaaaatagaaaatctagaggaaatggttgaattcctagaaacaaacaaacctcccaagattcaatcaggaggaaactgaaaccctgaaaagacccacaacacgttccaaaattgagtcagtaacaaaaacctaccaaacaaaaaaaaaccctggaccagaaagattcacagtcaaattctaccagatgtacaaagaagagttaataccaatggtaatcaaattattcaaataaaaaatcaagtagggattactcccaaactcattatataaaatcagtattatcctaatatcaaaatcaggccaaaacatgcaatatcacaatgaaa

SEQ ID NO: 209643 - DNA, 745 bp, Homo sapiens
aaaaaatatagtgaagatcaatacctaaaggtaggcagaaagtgagacaacactttgtggggaaatgagagagacagcgaagatgaaaccaacatgtagcacagagtcgcctttgataggaagcaggcaacctcttttcctctaaaatgggaaaatgagtaaagttggtaaatacaagttgacctcttcatagtctcaattttctgttcaataggagaaagagccatatgctaggggaggggcagagggcctaaggaaagtaatgaagtttggctcagccacagcgggaaatgggagagaggccaccctagtaacaaacataaggtttacattgagggcttttctaaggctgaagtgagacacttgtagtgattctactttgaaggactacccatcacaaagaactcagcatccccgaaaaggtagataataaataggattaatctgaggttgagggcttgccaaaggactagactaaaagaccagggaaagaagaataactggtgagattagttcatatagtatcccataaagctgagggtggatagggaagaaagcctgaaaggggctgacagtttaggaggaaggggagcagtcaagaaaagggggtaagaaggaactgaagaatgtggaatgagcataaaggagagaaaagtcaataaaataaggaagtgaaaaaactgaaaagagggcagttatcagttactgaaattttaccagaaagagaaactcaaggtggtgacat

SEQ ID NO: 209644 - DNA, 685 bp, Homo sapiens
taggcggtccaaagtctgctcccatcagcagtgaaagattactcagaggaagtattgccaagaatgaatgaaacaaaagtgttttctcctaatggcagagggaacccaaccagcccataatgatttagttttcttctctagtgaaactaggtggtatgtgggggaagccgtggaggtggcctgttaccctgagtaactgtcccatgaactggctggaaacatgaacagctttacgcttcggtacatttttggttttcaggcttccttgtggctgttttcttgtttttctcttctttactatggaccgtgtgttttcaagtcctaaagtgtctttcacctctgcctctgccagcagccaggggaagcagtctcagcacagtgaaatgtgctgtgcgttgatgtcatcagaagtcatccacctcagtgaaaacagctgccagtgcattttaggaggcaagatagtagggaatggggaagcaaaaatagtgcctaccatagactttaggctttatctgattatcacagaaaaagccacatgccctcactcagcaaacacttactgaacagcagccaaatactagccacattgtttgctgtggggaacacatgtaaaatggggtacacagtccctaatatcctcacctttatggggttccctgatggggagaaacttacttgcccctta

SEQ ID NO: 209645 - DNA, 145 bp, Homo sapiens
ttgcagagcttagaacaattttgaagataaggtgtctccaagggatctgttcctgctccgttgctctttccacagcacgctacctgcagcttctgctggtatcactgcaccagactctggagcacgctgcttctctggaggagga

SEQ ID NO: 209646 - DNA, 523 bp, Homo sapiens
gtcttttaaatcacatttgtggtttcatattatctcatttaattcggattcctcttaggcctggattatctggattacattaattcaacaagcacctactcctgttttttcagacccaatggcaggttctggtgtttctgagctgtaaagggcatagtccctacactgtgggagctcccatctgacagggaaggttgacaggtgagtccagcccactgtggtagatggtgacttgccgtgccactccctgaggtccaggctttcctctcatgcagtcaggatggcaagtgacacgggtggatcagcgtggagccacaaaccagtcaacagataatgatttcacatctatcatatgctgagcacagttctacacattatgcagcactggataaaagtacaaatccctgccctcatggggcttccattctaatgtatgtatgtgtgtatgtgtgcaaatctgaatatgttaaatgataaatggtatagagaaaaaataaagctggatggggaataaagaatgatg

SEQ ID NO: 209647 - DNA, 699 bp, Homo sapiens
tcaggtagctgtcaggggctctcgtgagactcgttacttaggaaaaatgtgtctggcgtgggacggtagtcagagaggatttcttacaagacacacactccttctatcccaatcggacagtgatatgaccctggggatgttccatgaatcatttgttcctctttggccccatctgattgtgtacttatctccttacacagtccttctgaccttgaaatgatccagaaaagatgtaaaagagtaaattctatagtcagtttaaaaggcagcaggaaaggattgggaagcattttggacaaggggtctaggagacaggcccagctctgcacttttccgtgggacaaaggcctttgcattctctcctgtaagtttaggggattaaaaaaaaaaatcagtgcttaaccctttggatggcaggaggccactctgagaaacctattcccaaaatgaatattcacaatacagctctttctataatttcggaatgttccgatttcccccaagcccacacatggattctggattgtaaaccctttacgaggtccttcatgtcctgaccagcctaactagctatctgtggatctgcgacaatcaaaggctttctccacgacctggcccaggagccccctccttcctatctacatcagtggaaatgtctgaaggtacaacccctaggccagtctcacggagatgaccaat

SEQ ID NO: 209648 - DNA, 240 bp, Homo sapiens
gcccgattcactgaccatcttaagatgcgtcagattaacaagcaagcgctggcaggatttctggtggtttaccctttacgaggtccttcatgtcctgaccagcctaactagctatctgtggatctgcgacaatcaaaggctttctccacgacctggcccaggagccccctccttcctatctacatcagtggaaatgtctgaaggtacaacccctaggccagtctcacggagatgaccaat

SEQ ID NO: 209649 - DNA, 384 bp, Homo sapiens
tctcccacactggggcactgcagagtccttcccttctcgaatgttctccctggcacttgtgtttctctccttcctgacctctgcctagtcgcagatagagatgcattttgacagaaccgggaagagttgttctatttccatggcaacgtcaattcacattctgcaggtacattggccgccactgcctaaatgaaggctcctcaaggctctgtgtgttgccgtgcctggccaaaaataactgggcatgccaccgttcctcacagccccatggagagaggcattaaactgactggatgccaactgtcaactctgttcctgtcttcctgctaaagaggaagaaacaggaactgccagtgttttgggggaggggagccagggaggctg

SEQ ID NO: 209650 - DNA, 629 bp, Homo sapiens
aggacgagggatagcattggtgagatatacctaatgctagatgacgagttagtgggtgcagcgcaccacacctggctaatttttgtatttgtagtagagacagagtttcaccttgttggccaggctggtctcaaactcctgacctcaggtgatccgccctccttggtctcccaaagtgctgtgattacaggtgtgagccaccatgcccagcccagataatactttcaagaagaaaaatgtgataaaggtaggactgcctgttttcttaagttgtttctagcacctctctttactctctatggcgatgaggaatctggctgttaaagactgagtggaagattagcgtgaaacttgtcttaggcttgtaaaacaaaatgtcagggaagtcttcaagcctccagagcagcactgcccactagaactgacgtgagccacagagagacttttccagtgtatgcataaaaacctaaaaagagaggcgaaattaattttaagagtagattttatttaacctattttagccatactgctatcacttcaacacatcatttaacaaatacattaattaggcaatttacattctttgttgaaatgcagtgtgtagtatacgtttacagcacatctcagtt

SEQ ID NO: 209651 - DNA, 577 bp, Homo sapiens
accaagatggacctcccggcgctgctccccgccccgactgcgcgcggagggcaacatggcggcggccccggcccgctccgccgagccccagcgccgctcggcgcgagccccgcgcgccgccgcctgctactggtgcggggccctgaagatggcgggcccggggcgcggcccggggaggcctccgggccaagcccgccgcccgccgaggacgacagcgacggcgactctttcttggtgctgctggaagtgccgcacggcggcgctgccgccgaggctgccggatcacaggaggccgagcctggctcccgtgtcaacctggcgagccgccccgagcagggccccagcggcccggccgccccccccggccctggcgtagccccggcgggcgccgtcaccatcagcagccaggacctgctggtgcgtctcgaccgcggcgtcctcgcgctgtctgcgccgcccggccccgcaaccgcgggcgccgccgctccccgccgcgcgccccaggcctccggccccagcacgcccggctaccgctgccccgagccgcagtgcgcgctggccttcgccaagaagcacc

SEQ ID NO: 209652 - DNA, 331 bp, Homo sapiens
  misc_feature (78)..(78): n is a, c, g, or t
cttggataagcggatgagggttggggctatcctgggacctccccagcccaggaaaaactggaagccttcccccagcanggcagaagcttggaggagggttgtaaaagcatattgtaccccctcatccgcttatccaaaggaacggcggcaagaggggtgcgggtgtgctactatatctagcgggtggaggccaggaatgctgcttaacatcctacacacaggagatactgcccatgacaaggaattagctagtccaaaatgtcaacagtgccaaagctgaataaatctgttcaagagcaacacatttctattccctcttccatagtaattg

SEQ ID NO: 209653 - DNA, 468 bp, Homo sapiens
gttgcccaagctagtcccgaactcctggcctcaagcagttctcccaaatcagcctctctaagtgttaggattacaggcatgagccaccatgcccagccaaaactttgaaacataaataaaagtaaacaataatataacaaagcccttgtatctattgttagttaaaacagctatcaattcatgtctagccttattttgtctactcacttccctcactcctgtattattttgaagaaacctgttagtcacctatttgatgttatgttttagtttcttgttctgtttgtctgaaaaagtctttttttctttttaacttttttttttctttttattttttttgtgagacaggattattgcacaggcacccgtgcagtggtgcaatgatggctcactacagcctcaacttcttgagttcaagccacctcagcctctcaggtagctgggactacaggcatgtgtcaccactgg

SEQ ID NO: 209654 - DNA, 307 bp, Homo sapiens
ctcttcttcgttcctttgagataatgatttcttgtctgatccaccctcagcctggttgtcacagctgggtagtgcccccagagaagaagcagctgtagccccaggagaagctccgaggggaagagccttttaaagtggaaaaggaggatctataagctacctttcaggtgcaagacttagagagagggccaggcatggtggcttatgcctataattccagcactttgggaagccaagtcaggaggatcacttgcagccaggagttcaaaaccagcctgggctttgctgacccatctctaaaataaat

SEQ ID NO: 209655 - DNA, 435 bp, Homo sapiens
ataacatggctgagtgttggtacaggctttccacagcaatattaaaactgaaaaaatcagcaatgaagctcccagccacatttctgcctaatgatttgggggaaaacaacagaggcactcctcaacttttccttcactgcacaaagtggatttggctggaaatgccaaatgtgcttgtagctgggatctttcaaatgaaagcaagctgggagtcaacctcctgcagccgcaggccagaaatgggttgagaccaaactattatagtaacactggtgcacatctaaacagatttaactccctcccagcaatccagattaatttaatatgctttcttaatggcattccgcatttctcattaaagcaaatgaacgtccatccctctgtgataaattaggtcaaaaaacattcatatatttagggcacagggaaggagga

SEQ ID NO: 209656 - DNA, 346 bp, Homo sapiens
atctcaaaaacattatgttaagtgaaaagtgccagacacaaatgacctcatatcgtatgattccatttatatgaaattctaggaaaaactatagtaatggaaagcaaatcaggggtgaggggccttattttcccacatagtaggttttttttttaaaggcaagaatgatttaaaaacttcaaatctatatcatctcagatttaatcttcacctcataagataaatttgcaactttcttccaaatgatttacttgctcatttacaaccaatagcacattttatcactcaattctccattaaaactgtaaatcagcattggaactttgtttttttttttgttgtgttt

SEQ ID NO: 209657 - DNA, 238 bp, Homo sapiens
attctgctgcacataaaacacctaaaacaatttagaacatttgccatttctttctattctaagggaaataataggattaatgagatgttgatgagaaattgtcttctctatgcaacactgctctctgcaaaaataccaaactatgtcaaacctgttcccaaaaggaagaggattaaattctacacctagaaaattaaattctcaagctacctaccacacagtctgtcaatttatatag

SEQ ID NO: 209658 - DNA, 406 bp, Homo sapiens
ggatgtagtttatctttctgctcttttgggtatcaatggaaaacatgcacgtttattttcttgctttaattcattaatgttatcatttaaagattgttcgagttgtagatgcctttttagtgccccgtttcaccatttcatggtaaatactacttttaagaagcttcctatggcgtagtcatttttcacctcttgattgatctcagtgtcataggtgggatttggatgttctttagggatgacagagggcacctccctgggagaatacagatagaagccctctcccccatttgtcttcaagaattcttactacagaatcaagttggaaagttgatctcattaagtcatatttggtgctcttagtggaatgttgataacataataaaaactaacatctattaaaaaa

SEQ ID NO: 209659 - DNA, 438 bp, Homo sapiens
taagaccttggggatcaatttcaatctgagcttgtagtggatgaaaaaccatttctaaaccagtagcaacaggtctcgttctacttttatgttcttccatatgttttaagattttgtcgagtttttttctttgatgccaatgttgcacatttcttgttaagcttattcctagatattttagctgttcgttctggatgctatcttttttccattgtctttctcctgaatgataatatgattatgaaggctattgatttatatattttaattatgtacccagccaccttactcaatttccttaagatctataactgtttttcactaaattctttaggacttttcaagtaagcactcagccgcaagtaccaattttgtgttactaagttttctcatgagtcattctttgtttcattcctgatttttttgtttgttttttag

SEQ ID NO: 209660 - DNA, 530 bp, Homo sapiens
tctgctctctgttcatttcctcttacccttcttagcttggatacttttgtacttccactgaactcaatggcaaatccaggagacagggagaatttggaagcaatgatgggttacaaaagagacatttacttcacctctcactcttggggaatgtgaagcatgggggggaaaaagagcctctgcctgaggttgctgcaggtggcagtgtttccaggggaccactgggccatttcagaaaaggcaagaagataaagggatcattcatcaaggaagcagagactgaaaggaaccaatgggttctagtgtgtacacagaagcagaggatagggaggggttggagaggggtccattcagggaatgttcagggcagagtacagatgagcatcttaaagatgagcatgatctggaggactggatttctggtgacaactgcaatggatatcagagcacagtgtgaatgagaacttctgggtggctgtttctacctgcgtctagtgatgtcactgctgttgagagcgtgcagctgctca

SEQ ID NO: 209661 - DNA, 606 bp, Homo sapiens
tcggctccaccccttctcccagcgcatctggccaggagaccccagctcaaagccccctccagcttcaaagggcaccctggggtgggaggcaggagacgagggtggatgccctgacccactgagtccgcaccccagggcccctctctccaagctgtgacctcacctcagggttcttaacaggccttgctaacactctcccactcagatcctgtcattgtcaccatggccttcctaagacaccctcatcttctcccatccgagggtgggggagaaccaattcgattcgcaacttcaggacccaggacccatctagccgcctgggggattccctaccccacctctgcagcctgtaaattctgggggaggaggccctggagggaggatcagaggcatgtccttccccaacctcccactctggcctactaagaaatgggagcagggctgaccctatgaaagtgtgggaggtgaaggagctggagtcgtgattcctgggtatccccagacagacatcaccacactacagcccctcttctaaggtgatcccagcactttgggaggctgaagcaggaggatcccttgatgagaccagcatgggcagtataagga

SEQ ID NO: 209662 - DNA, 540 bp, Homo sapiens
cgtagaggttttccattcccactatatagcccctacaccctgaagtctccactcagaaaaaagttggcaaccctttatctgtctcccacaacatgataagtgtttttggaccgaaaatgcaaagatctggaactccatgcttcccacctctgtcggggccttctccgggtcctcctgcatctgtcatcccatcctccagagagtccctagggcctgggcaccctgcaaactcttagtgcagtcaaggtttcctggctgggggcccaagagttgccacggacccgcacacgctgcccaggcggcgacgtggcgcccctacaggcttccccgcgattggggacacgcacacccagggccaccggagggacaggtggtcaggcggactcaggtcacaccggcggacgcggggccactcacctgggccggggcggggcagctcacctgggccggggcggggccgcaggcgggcggggcggggccgcacctgagctgctccaacccgcggccgacgcggccgacgctgcctggctccacagcagc

SEQ ID NO: 209663 - DNA, 427 bp, Homo sapiens
cttggaatctttctttagttctaggaataccataaaataagaatcactgaaatatttttaaaacttatttcacaaatgaacaatctgatttaataattctattatttctctattttaaacaatcttttaaaatatagaaaatacaaagtaacctgaaattgcagagaattgtactggaaacatatctcttgttattgcatagcagataactataactatatatatataactatatatgaaatatatatgagacatatataatagttatgattgaaaaatttttaaatgtaattggtcagatgaaagttctattctcatagcagctgccatatataatccaaaatgagtttctacaggtggacgttgatggtttcactaaataaaaacaggtaaaagattttaatactgaggggaataagagctctgc

SEQ ID NO: 209664 - DNA, 652 bp, Homo sapiens
gcctgtagtcccagctactcaggaggctgagacaggagaattgcttgaacccgggaggtggaggttgcagtgagctgagatggcaccactgcactccagcctgggagacagagtgagactccatctctaaaaaaaaaatagaaaataaaagataaataactgttccttgtgagccctaacaaataacagaaagtgtatagaatagatgcaagccgggacttgggtcctgaaggccagagttcaatgtttgcatttcctaaaggaaatctagggcaatcacatctctaacggacagcggtcactttcgtgccagagataagccttgagctcttgctcacttggtacatgttgcattttctccttcatttttaactcctcaggaacccctagaatggtaaactgggaagtcacctcatttaacttaacaaggaatctggggcccagagagcttaggggtgcctcagatgctactggttatgaccacgatctgatgggtcatcgttacttgaaggggtgagcagaggcttcgcttaacttccttaaggctctcaatggaagaaccgcaagtgtctgtccccttgtcattttctgaaaaagcaatttatcattaagtcctccctgttgctgagctattcaatacttttttacctgt

SEQ ID NO: 209665 - DNA, 423 bp, Homo sapiens
tttagagtattgattgctcagatggaattgaggaaattttagtaatttctagaagcaaaattatagagttagtaaaatcatcttagcagagaataagatggtttcatgatatattttaaaatactctatactgggccaggtgtggtggctcatccctgtaatcctagcactttgggaggctgaggcaggaggatcacttgaggccaggagttagagaacagcatgggcaacacagcaagaccttgcctctacaagcaatttttaaaatcttagctgggtgtggtggcatacacctgtagtccagctactcgggaggctgaggcaggaggatcacttgagcccaggagttagaggctacagtgagctatgatcatgccactgcattccatcctgggtgacagagtgagaccgtatctcttaaac

SEQ ID NO: 209666 - DNA, 794 bp, Homo sapiens
tcaccttccaccatgattctgaggcctccccatccatgtggaactaaatggaatctttctctgttgcccaggccagagtgcattggcaccatcacagcaaagtgcagcctcaacctcctgggcttggctaaagcaatcctcccacttcaacctcctgagtagctgggactgcaggaatggggacaaagctattgaaaacttctccttctcaggctcacttcgccaacatctgtggctgaatgtagacattcccccttttaggcaaatttctttaaattcatagcaaggtatgaccaagaacattaaaacaatgcttcattgcttatgcctgacgttgaagagcaaaatttacatctgctacacagttcaaggtttccatggccttagtagaggtcatgaaatgtacagttttaaaacttattggagtatctttatgaacgattttaatggactagagtgacaatatttttatacaacattgacctcccctgccccaaatgatgtgaaagactgtggctgtattagaatttagtctagtaagaccaataccatttcagggagttttttgtagttttcctccataaatatattttccacatcaactgctctgagctgagttgctggaacattttcaattctttataagtacatattttggctgagttcagaaaccttggactaggcactgtcctttgagtgagacgtcaggattgaggtagcataggcacaagaccaaattttagttcatgatggagtattgccagcttgtgagcctctggtgctttcaaggaagc

SEQ ID NO: 209667 - DNA, 449 bp, Homo sapiens
gccaaaggcacctctgtttgaagcatccaatgaaggcccttcagagcccaggccaggtcttgcccaaggtgggggagcggcggcacacaggggccagctctccaggctgcagatgcctgcctggtggctcctgctctcccgcactcactggtgaccaggacaacatctcttgcacctcagctttctcatctacaaagcagagccaggattagagttgaagctgaaagaagggggaccctgttgccaggctgctccagctcccctcagcagcatcagagccctgagccctgaaccaccagccaaaacttgtcacccaagggctttgctgctggggtgatgggacatccagggggtcctgagacaagggggtcctttgggttcttgcatgcctgacacccaacatcaggagtgggcgtggctggtggggcatcactgggtgccctgaagct

SEQ ID NO: 209668 - DNA, 373 bp, Homo sapiens
gaattgaaaacataaattataacacacataaagcttatgaactccatttatcttaaaatagtcaatggattttttgctcaggcacaaaccttaagtataatcatcaagagcagaaaacttgaatgaatggtgtgtgaatgaatgtatgtgtacacaaaagcacactcaggtctccgaagtttaagtaaatgaaatgaaagggctttgtaaactaaaaagagccacagataaaggaggtagtagagcaacagagttaaaagcgtggagccagcctgctcgggtgttaattatattagctgtgtaaccctgtacggtacaaaagttacaatactaaaatttcctgtgccttagtttcttcactgtcaaaatgggg

SEQ ID NO: 209669 - DNA, 632 bp, Homo sapiens
aataatcaggcgtttaagtggccaaatcaagaaactcttagttccatctgggatggggcctgaggggattggggttgggggctgcctactttgaatagccttttatgcggagtgtgtggcttctccctagacctgatgaagattcccattcacaaagagagtggcttggacacatacgtgcttttgtcagtttctttaacaaattcaagattctggatagcagaaccttgtggtttgggataccagcatgctgaactgtattcttccacattccctcccacattaggaaaagattcaaggctgacaggaggtgctcactaaataaccaaaggcagaaaattaactataagttacatcctctttttttcttttcttttttgagacagagtcttgctctgtcgcccaggctggagtgcagtggcacgatcttggctcactgcaagctctgcctcccgggttcaagaaattctcctgcctcagcctcctgagtagctgggattacagcgtgcgccaccgtgcccggctaatttttgtatttttagcagagatgtggtttcaccatgttggtcaggcgggcctcgaattcttgaccttgtgatctgcccacctcgacctcccaaagtgctgggatt

SEQ ID NO: 209670 - DNA, 223 bp, Homo sapiens
gcacagtcatgtgaggagatgctggactacagcagccatctggaaaccctgatgggaaactgaggaaagatcagtgcagtgaagttgccggtacagagagaaggaaaggacctgggctggggatgctggaagaaccgctaattaatcagccctagggatgccagggtcctgcaacagctcgctatgtgaggtaatgcatgtccacattgttcacgcttgctta

SEQ ID NO: 209671 - DNA, 304 bp, Homo sapiens
taggatctgcttgcctggaaaaaaagaacaaacttcccattcatacatctttgcaaaaggtctgagtccatcttactcggactgggtgagcgcattctgtatacactatgtaggtgaccacagagtcaggtgtaactcttaccttaacctctactctaggtgacccgcaacctcaaaaatcatgtacctgtctacctgcctgccagcttcccttcatttttccaatgagtatttattgagaacctgggataaatgcagtttgtttcagggctagcaagataaatgctctctgaatacgtttgaa

SEQ ID NO: 209672 - DNA, 632 bp, Homo sapiens
gtaaaaccccatctctagtaaaaacacaaaaattagctgggtgtggtggtgtgagtctgtagtcccagctacttaggaggctaagccagggaatcgcttgaacccaggaggtcaatgttgcagtgagctgagatagcaccactgtactccagcctgggcgatagagcacgagattctgtctcaaaaacaaatgtatggctagtgaagttgctcactggcagtgggggtgggtgaatgggtgaaggcagagtttgtggtgttgggggacatttgcatagacatgtccagacagaatttggatcttcagacccagaactcagagttgaggtctggattggagcaggtttgagaatattagagtgtaggcggactcttgggagtgactacattttgtcagatcacttattctttctttcttcttcaattggtccattctaattctaatttcttgttatataagatagcttttgtcttttatatttttgtaaaaatcagatactctcctttgctttaaaaaagtacaattgtgcacaactttcccccaatttttagaagactttgctttcccctacttgcagagaacaagtcttgtttaggagcataactgatgtggttagaatctacttgtgcag

SEQ ID NO: 209673 - DNA, 459 bp, Homo sapiens
tgttcccatccttttcacatatattcctttacatgttcctttattcaacccacattaaacaaatgtttatggaaaaaatgaacataagctctgtgccaggcatgtgaaaggcactggacatgccatgaagatgcatgcaagtttttctgtcttgaaggaacatacagtttcttgtaggagacaaataaacagagataaattataatccattatgataagtgctataatagaatcaaggccaaaggtttttaaaaagttcagagcatttggctacctggtagagtcagagaaggcattactgagttggtgactttagaatgggtgttaaattgcatgaaatatatagatgtagttttagatgaaaaatgctggtaagttatagtgaaaaataagccccccttggttgtttaggaggattgggatttacagttgttgttattattttttctttctatatac

SEQ ID NO: 209674 - DNA, 384 bp, Homo sapiens
ggtagcccccttcttcagcacacgaagcccactgaaaaaagctggaagttggaatgacttctctccagagacttcttttttagaagaggcactctcagtgataccaacactcgaattctggtttgttactgcaggtaggtcttgggacccttcttctcccacctggtcctggctggggcgacgctctgtctgaagaccaccgttgccagcttccagtttgctgctcatctcaggtggaatcctttgaggatcttctgcacagagctctgcaccattcatttccccagtgacagtattttccctgaaacctcctgggttttctttggactcctgagatggctcagataaaacaccactaggggactttgggccattggtgctgct

SEQ ID NO: 209675 - DNA, 707 bp, Homo sapiens
actcttagaagaaaatgggtaaatcttcatgaacttgggcttggcaagcattctaagatatgacattaaaaacacaagcagcaaaagaagagaatttggacttcattgaaatttaaagcttttgtgctttgaaggataccatcaagaaagggaaaagacaacctacagaattggagaaaatatttgtgaatcatatctaataaagactcagaaataactttaaaaatggacaaaggatctgattagacattttcccaaatatataaaaatggccaataagcacatgaaaagatgcttgacatcattagtcatcagggaaatgcaaagcaaaaccacaatgagatatcacttcacacccactaagttggctaaaataaaaaagatagtaacaagtgttgacaagagattgtagagagattggaagccacagatactgctggtgagaatgtaaaatggtgcagccactttagaaaacagttgcaatttctcaaatgattaaacacagagctagcctatgacctagaaattcctctcctaggtatataaccaagtgaaatgaagacttatgtccacacagaaattggtcataatctctcccacatgtgcgcataacccaaatgggacaagccctatatcctaaaggggcagcgttaactggcgaatcttccctggtatatcagccgcaggggtccggtatgtatatgtcc

SEQ ID NO: 209676 - DNA, 135 bp, Homo sapiens
agcactcagtgacttatcagcgtggattgtttctccctattctgtcggtcagttgggtggttgtcctcttatctggctggcctggggctggacaatctaggacggtctcacattctgaaggttggcagactggtt

SEQ ID NO: 209677 - DNA, 595 bp, Homo sapiens
gtctcatctttgtcttgcctcactgtgctccaactgttctctctatgctccactgttctctctatgctccaacaaaaaagactcctttcagttcttgagcatgttgtgttccctctgcctggaattctctctcccctcctccttttgacctggttaactcagtctcatccttcagttctcaattcagatgtcatctcctaagaaaaaactttgatgacctttcccagacttgatcagatcttactacggagcagttacacagtttgtaaatatggctgattgtatgacttattaatatttgcttcccctgctaaatccatagagtagaaggcacctgttttcttcccattgtatttccagcacctaccatctacctagcacatagtgggaacattataaatatacgtagaatgaatgcttactaaaaatatataaacccaggccgggcgcagtagctcatggcaaatatgacctaatctgcagtttggagctggtaggatcaggtagtctgcaggggcaaggtaggcgctgcacattgaaggagtcgaagatgctgtggagagagcagttaggtatctaaaatcatgggaagata

SEQ ID NO: 209678 - DNA, 388 bp, Homo sapiens
caggactgaggccaccagcgtgaagtgcaggggacgctgggaagggaatgggagatgaggacagaggaaaggagtgagagaaggggacaatctgtggccacaatcaaacaagagtcatgggagacgggtgctgtgaagcgcctaagatgtaataaattcatctttttttttttttttattttgagacagagtctcgttctgtcgcctaggctggagtgcagtggtacaatctcagctcactgcaacctctgcctcccgggttcaagtgattctcatgcctcagcctcccaagtagctgggattacaggtgcccgccaccacacctggctaatttttgtatttttagtagagacgcagtttcaccatcttgaccaggctggtctcgaac

SEQ ID NO: 209679 - DNA, 601 bp, Homo sapiens
atttgctctatgtactggtgtatattacagtaatgaacactacaaaatatcattatcacaaaggaaatttgcatttgtattcattttaaataatcataaactaatcaataatttaattgaacactgttattcatgttgttttatactgaaatttattagttgtttaaatgtcaaagaccaaagaatgggatttctattgtatttaactctaaaacactgctgctcctactaatttattcaaatgaataggggggcttataattataacatgaggtagtaaacatccttcttggaggatcctgagttgtataaattaaggaatgcttttgtttcagaagggaaacatcattagtgtggtccacttttcttttatacatgcataacaaactccttggtattcataaaacctatatgcaaagaccgtatcccaaaatgggcccagcatggatctcctcagctgagtttcaactttcactgcttgctgaacactatttggagaataaaatttgaaatacttgtagaaccagagggctattttttaattgttaactgaggtggctctgcattttgagaaagccaatgaaaaccattaaaggaaatg

SEQ ID NO: 209680 - DNA, 395 bp, Homo sapiens
tgctgtgcccaagggactgacaaaggaaaaagttgtatttattctttgtgatttgacgcacagatgaaaaactaaacacataataacggaagttggtggttaataaatcacatcctagtctttcagagcttccgtaagcagacgacatcttcagtttctagggtcttgcagttttaacactgcaaaaccaatgagcatatgtccagaatcagctaaaaagagcgtcagattctttttctcttagtttgtctatttttcactgtctcttcttcaaaagtgtatctgaatgattaccttccggcattctctgttattactcgttggggtgctctcgattgtccccgtgtttgagggctggttgggagagggtgcttgggaaggatgtgccactgtcg

SEQ ID NO: 209681 - DNA, 135 bp, Homo sapiens
gcactccctcagttgaaggatgctctataaatacaaagcatcgttataatttattattgaacagagtcaattttttcttctgaatcatttttcaaacctctcatagctcaggcctctctgatgggagctctgaca

SEQ ID NO: 209682 - DNA, 389 bp, Homo sapiens
gcagcagaatctagcaatgcatgggacacagggggcataaaaagagttctgagacaaacccggccatcattctgaaccagggaagtcagcaaggggaactcttctgatataatggggtacaaagccagagggacacagacgaagttatctggagaaggaggagagaggccaatttgggatgggctggcataaagctgatggctgatttcttcaacaagtggatgagctcaatggaagaagaacagagaagggattccatgtcagaccttgaagaatccccatactgagagggagaaggaagaggagaaagaggcacagaggagaactgtggcagcaaggacgcacataagctagtgaagcagagaatctcaaggtaggaggccaaccct

SEQ ID NO: 209683 - DNA, 247 bp, Homo sapiens
ctttacaaaaaatttaaaaaaaaaaaaaaaaaaaaagtcaggcatggtggtgtgcacctatagtctcagctacttgggaggctgttgtgggagaatcatttgagctccagggttgaggctgcagtgagctatgatcataccactacactccagcctggtaacagagcaagaccctacctcttaacaaaaaacaaataaacaaacaaaaaagatttgaaactaaaaattcaaaggttagtccgggcgc

SEQ ID NO: 209684 - DNA, 181 bp, Homo sapiens
taaataagtaaataaaaaataaattaaacagaaaagacgaatacttgaattcaacaagtttatactagggatgcagttaattaggcagagggaaatcatacaattataattgtctccaaaggatctgctagtaactgagaaaagttaacaagtggtcttaaatttcacgttctcctggcta

SEQ ID NO: 209685 - DNA, 428 bp, Homo sapiens
ggctcgcctgccgtttacttgtgtgccccgccccccacccccacaagccacacagttgctcggtgtttcttgcagagtctaccttaaagtccctttgtcctaaatgaagatgcctcgctcggcccaggtgcactgagtcacagccgcctgcacgatgcctcccaggggctgaggcttttcatcagtatccacattggtctcatacagaccaggagttaagggccatctgtctaaggattcagagaaacaggaaaaatactcatgaaaagatactttttttttcttttttccagttttatggaagtataattgacaaatagaaattatatatatttaaggcatacaacatgatgttttgatatgtgtataaattgtgaaatgattgctgcaatcaagctaattaaaacatctatcatctcatataatta

SEQ ID NO: 209686 - DNA, 268 bp, Homo sapiens
atttttctcagtttggtacaaaggtcagtgtggattttcttttcatccccaacccatatttagtattcaaaatttttccttcttccccatttttccctgactcaccctgatgttttcactcttgtataaagctattaccaaccaaattttaatttctccactttgattttcaaatatgcctctacctctaaggactatgttacctaaacctccatgattgaacatctcccctcatttgctaagaagattcctgttgaggatgagttca

SEQ ID NO: 209687 - DNA, 221 bp, Homo sapiens
ggctggaggttagagcatagtcatggcttctgattccagtaaacactcaaggaaaataataggaatacaatgactttctgactgccttgctttaccgagggacgggaactggcaggacccccgtaactctctgagctgagcctcggggctccaggaagagatttgccaccctgtggtggcccctgatatgtagctctgtctggcgtcttcctcctgtgtga

SEQ ID NO: 209688 - DNA, 367 bp, Homo sapiens
atgagaagctcttaaactttcttggtttggcagcagagttatttttctagacaaagtataatgtgaaagtttaaatggatgaaaatgaactgaggaggcccccttggtgggagccactggggtgtgtgtggcagttgggggatcctgcatggtctcccttcattcccctaatgcctcttgaggcccctcagtgtgggccattaaaaggcccctagaccagcagatcccttctacagatctgcttattgaaaaacctgctctgtgccaggcagtgcctggaattctaaacctgaagctcccaaatgctgctctccggggcctggctcacattatcaagtcacttgggaagcttaacaaataacgtggg

SEQ ID NO: 209689 - DNA, 325 bp, Homo sapiens
tgtagagtacgtgttgtgagtttaagcttctattggtggacaagcaggcccagcaccaatttatctttatctgcaccagaccactcggttcagtgctgtgcatgcatcttgaagagtgttcaaatatttgctaaatttaaaaaaatgaataaacactgactgcatcttaaaaaaaaatcagggctcgtggagtcatatgatctacatgtgcatatataaataggattaaaaaaaggaaccatgcctgaataatcatgcctcaggcaaaggaacagtgtttaggagcagcctaggtataaaacttcatgttagctgaagtaacgcc

SEQ ID NO: 209690 - DNA, 343 bp, Homo sapiens
aaactgaggaacaagagctcttagcaggacttggatgaaaggccagtttagaacccaaggccttcccccatttggatcccttagctactctgtatactagcagacatacaaatgtaaacagagcaaaaaagatgcaagggccctcttccaaccctactgacccacctagcacatccagacctccaggagccaggctgcgatctgtttggggaacattcactgatgtcacaattttgaagtctaaaattcaagtcttgtcaatacctagaacgctcagactccttggcggctttctacctactccagcccctctggctttggcaggggcttcgtctataccatc

SEQ ID NO: 209691 - DNA, 337 bp, Homo sapiens
ggtgaacactggtttggtctggaaaggccaaacaacttgaagcaaaggtgggacaacaaagtggggagggggcttccagatcataggtagacaagcaacaaatggttgcattcctttgagtttctgattagcctttccaaaggagccaatcagatacgcatttatctcagtgagcagaagaatgactttgaatagaaagggaggcagatttgcccaagcagttcccagcttgacttttccctataacttagtgattttggggccccaagatttattttcctttcacattgtataaagaaaaagtaaaccatggagaccctacagcggacccaggttc

SEQ ID NO: 209692 - DNA, 461 bp, Homo sapiens
gggaaacaaggttgtttatttttttaaacagtattcatatttataccgctgagtgaaattatttatacacaccctgtaggttttgcatcttcagaatttgttagcattcagaggatgataaactgtaccttggacttatttgtgaaaaaatatgtagatgacacctggtggagtttattgaaactattattcaggtgtagagccagagaaactcagcagaaagggaagccgggtttttagatgtcacaatggatggttaaaaatttcagctttggggcaacattataatactcaaattatttgcctctggtcctcattttctccatctctagcatcggttctgaactcagggttttctgtaaatattaaatggcataatgcatgctgagagatctgtgtgggccctcccagggttaagaatccaataaatgttagctcatgtatcatcattattacagaga

SEQ ID NO: 209693 - DNA, 420 bp, Homo sapiens
ggacaggtgtccttataggaggaggaagatggaaagagagatttttttccctaccatgtgagcacacagcagaacagggccacctgcaagccaggaagaggcctcaccaggaaccagatctgctggtaccttgagctgagcttccagcctccagagctgtgagaaatacaaatctattgttgggccaggtgcagtggctcatgcctgtaatcccagcactttgggaggccaaggcgggtgaatcgcttgagtccaggagtttgagaccagcctgggcaacatagcgaaaccccatctctacaagaaaatacaaaaattagctgggcatagtggctcacacttgtggtcccagctacaagggaggctgaagtgggaggatggcttgagcctaggaggctgagcctgcactgcacttcagcc

SEQ ID NO: 209694 - DNA, 418 bp, Homo sapiens
ttcggccccagactattgtctgcctgccctgactcagcccaaactcagaaactgtggattctggaaagtaacgagacttttcctttgggaaagggtcctgaagctgacccacagtgctcaagaaaattggcagagaggccaggcacagtggctcacacctgtaatcccagtattttgggatgccgaggtgggcggattacctaaggtcaggagtttgagaccagcctggccaacatggtgaaaccctgtctgtactaataatacaaaaatgagccgaacatggtggtgggcacctgtaatcccagctactcatgaggctgtggcaggagaatcgcttgaacccatgaggtggaggttgcagtcagccaagatcgcaccattgcactccagcctggacgacaagcgtgaaacttcatct

SEQ ID NO: 209695 - DNA, 652 bp, Homo sapiens
  misc_feature (652)..(652): n is a, c, g, or t
gctggatgggccagagagagaagggccctgggccagggacaggagaacgggctggcctgtggccccttcctcacccgtttcagggccacttggttcccacctccaccttcttagtctgcctgccctgctttccatcttcttggaattcgccttgctgccgccccgcgcccacccccgcgcccacccctgcccctgcaccgtcccatgcccttatggatttattctttacacgtaaatatgtctttcctctttttgaaaggatttggagttggaacagagaaattcactatggatgatgctatatctttatatgacctttggaatatctgtaatcatcctgagggcaatacttatgtaatgaagatggaagaagagagaatatgaatactccgtgcactttgatcttatcgtttagctgctgatcataccatccctggagtcctacttctgactccaagttatgaggtaacaaatttctttatagttaaagcaatttgattctgggttttctgttacttgcagttgaaggcatcttaaatggcttagcgttcccagactggatttatatcctagaccgttttcttttaggttttgaacaatcattttaagcgctcttattccaccggttcccttttaggaatggcccccttcn

SEQ ID NO: 209696 - DNA, 256 bp, Homo sapiens
ggtctcaggacccctttatactcttaaaaaccaaggaccccaagagcttttgtttaaatgggttctcttaatatgctgcaaatcattagtgaaaactaagaaagtttggacacaagcatctgccattggccatcagagtgagggtgtctccccatcacacagcctctggaaacctgcactacatgcctgagaacacgagtggaaaagtccaccagtgtcaggaaaataggcttgacaccacagcaccccgggaaag

SEQ ID NO: 209697 - DNA, 199 bp, Homo sapiens
ttgcttgagttcaggagttcaacctgggcagcatagtgagaccctcatttctacaaaattggaaaaaatagccaagcatagtagtgtgcaccagtagtcccagctagtcagcaggcttgagcctgggaggtggaggctgcagtgagccaagatagtgccactgcactccagcctgggtgataaagccagaccctgtctc

SEQ ID NO: 209698 - DNA, 105 bp, Homo sapiens
agacagggtctcaccctgcctcccaggctaagcgcaatggtgagatcatggctcactgcagtctccacctccaaggctcaagcgatcctcccatctgagtctccc

SEQ ID NO: 209699 - DNA, 482 bp, Homo sapiens
ttgggatggtttgaaggagtagtagacaaaaggctgaaaaccctgtcggagagcagtagtccaggagagatgaaactgagtgatagaatggaaaagaaaggttttgagaggtgtgttggggaagggaggttggagaaataactttctgattgccaaacatgtgttcagacattctgctcatcctttatctaatttaattttcaccaaaatccatttttcatatgcagtaactgaggctttgagatgtttaaaaacctcctagctagaagtgaataggattgagattcagagccaagcatgtttggctacaaactgtctatgatttcccatgaaaccttgccttacccactgaaaataactccaggcgggaggattgctggaacccaggagttcgagactgcagtgagctatgatggtgccactgtattccagtctgggtggcagagtgagaccctgtctctaaaaacaaagacagaaagaaa

SEQ ID NO: 209700 - DNA, 535 bp, Homo sapiens
ccgtgagaaagcacaccccatatctccaaaatgctgtcaattccaccccctaaatatttttcaaatctatctcctcctcttcatccatacaaggacttcccctagtccagtccctcattttaggtctggacgatcttaacagctgtcaagtggtttgcctgcctcctataaactttcttacttatttatttagagacgaagtctcactttgtcacccaggctggagtgcagtggtgcaatcttggctcactgcaacctctgcctcccgggttcaagcgattctcctgcctcagtctcctgagtagctgggattacaggcgcccgccaccacgcctggctaattttttgtatttttagtagagacgggttggccaggctggtctcgaactcctgatccacccacctcggcctcccaaagtgctgggattacaggcctgagccacggcgcctggccaaagtactgttttttgatatgagtgagtacatctataagagcagtaactaaatgtggaactgtgaggtcaagtctatatgc

SEQ ID NO: 209701 - DNA, 363 bp, Homo sapiens
  misc_feature (202)..(202): n is a, c, g, or t
  misc_feature (211)..(211): n is a, c, g, or t
gtgctcggccccaaatgggctttttaggagttctcatggaagagatggaagtttcttcttgagtgagagcaatcccagagtctgatatttcacctagtacatgggaagggaacatgttttgtcctaagccaggtgtgaagtatagtcattcatgttgggcaaaaacgtggcaggacttggaacttctgtggggacccacaanaggagaatnagaggagaagactccatgaaatttctggtcctggtgttgtgtggatggcccagggccctggccagagagattcaactactaggtgaggtttttttcactttagacaaccctgctaaggcttcatttcacttatatgccgtctgtgggccttt

SEQ ID NO: 209702 - DNA, 530 bp, Homo sapiens
aatcctgtgcttctgtggagggagagcgaaggaagagtgtggacagtgggggccaggaagttctcaggtagcccagcaggccacgcagaagtcaaggggtgtgtaggtacaggaggggccgtctccacagggagacgcctggatccatactccatccaggcttcatctgcagagaccaggggtggacacctcgtttgtgggggccgtcacagctgatgccccagctcaggatgtccaccagaaaccaggagtcaccatcctcttaagggtggtgcctgtcctccagagagcatatcactgggttcaaaccccagctcctaccggcaaagcccggggcctccacctgggtgttcccatccatgaagcggggatacacagtgtggagcccttgggaggttggggagtgtgcctgccctcaccgcgcatcagctcataaatacaacaacagttgccttcacgtgctgatgctcagtgagcagtggcgcagttccccagctggcgcagtcagtggtgtctgtctgctgtcagag

SEQ ID NO: 209703 - DNA, 311 bp, Homo sapiens
cgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactg

SEQ ID NO: 209704 - DNA, 228 bp, Homo sapiens
ctgctatttcctgatgagcaaggggagcagggagcctggaatgcgaccactctcattactgagggacccccccgtttgtcattcgtcttattgcatcatcactattttaattaaccatctttgccattgggcctgcaagtaattgttctctgcattgttcaaaccactaggatggatacttttcaaggtgcaggctttccgctccatcacccattactaattaaagca

SEQ ID NO: 209705 - DNA, 250 bp, Homo sapiens
accttctgccacccttaaacctcttataattcttaatagtcagttacagttcctgttcctccagctccatgtcttcccaaacttttatgatgtttgagcacattcttgactcttgaaacatgggatcaggatttaacagtctttttttttttttttttttttttttaaaaacggggctctcactttactcgtgtcacccaggctgaaatgcagggggtgcagccacagctcgcggcatttctcaacctct

SEQ ID NO: 209706 - DNA, 715 bp, Homo sapiens
aggtcggcggcctggttgccatggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggaccggcgtccccggcggcactcctgactgtctgacagacaccttcagagtgaagaggccacatctcaggcgctctgccagcaacggtcatgtccccgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggatttgttcggactctggcagagaaaaggcccgatgccagttgggtgagtatggtgtgtgcaggacagagcctt

SEQ ID NO: 209707 - DNA, 725 bp, Homo sapiens
tgtccatcagtgtggctgtgccctgtggcctgccgtgtctacgtgtcatcacctgccttcaagaaacatttgcagatgtgcctgaggaggcctggccaaggatttcgattggaggattgaccagaatcacaaaaatgggctacaacttaagtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagtatgatggccgcttgcaagctgtgttttgtgtgttgccttcacgttgtggaagctcctctgagaatgtgtggctgtcacgtgggtgcggcatatactgcccttagcttggcagtgctgccaacactgcacctgttctgttcagggttagagttgacacgtttccatttgcagtgttcacagactcctcatagtgaccacgtgttgatggccaacgcgtgttcaatgccgcccgtgttcgttatagattctacatcctgccttccagcttagagctagaaagtgctgtttcaaagcagagccacctttttaggaagacattgcacacaaggacaagtttactttgccacctaatgttttcctaaataagtttatcaggaga

SEQ ID NO: 209708 - DNA, 752 bp, Homo sapiens
ttcgcagaggccgccgcttccaggaagctctccgggacgccgcgccctcgcctctgggcgcctgcgagtctgcggcccgcaggtgacggagctcacggtaatgtttgactagagtcaccacgctcgtggattttgttttcctatttctgtctttctgaagttcatgtgttgagctcacatgttgctgtccggcacctctgaatccacgtgttggcttttccagagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggaccggcgtccccggcggcactcctgactgtctgacagacaccttcagagtgaagaggccacatctcaggcgctctgccagcaacggtcatgtccccgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggatttgttcggactctggcagagaaaaggcccgatgccagttgggtgagtatggtgtgtgcaggacagagcctt

SEQ ID NO: 209709 - DNA, 808 bp, Homo sapiens
aggtcggcggcctggttgccatggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggaccggcgtccccggcggcactcctgactgtctgacagacaccttcagagtgaagaggccacatctcaggcgctctgccagcaacggtcatgtccccgggactcctgtctacagagaaaaagaagatatgtatgacgagattattgagttaaagaagagatggggtttcaccgtgctggccaggctggtctcgaactcctgacctcgtgatccacccacctcggcctcttaaagtgctgggattacagggtcattgcacgtgcagaagagcgacgtggacctgatgagaacgaagctccggcgcctggaggaggaaaacagcaggaaggaccggcagatagagcagctcctggatcccagccgcggcacggatttgttcggactctggcagagaaaaggcccgatgccagttgggtgagtatggtgtgtgcaggacagagcctt

SEQ ID NO: 209710 - DNA, 868 bp, Homo sapiens
gctaaagagatctggaaacagctggctgtgtggatgtacccagggcatcttcgtcagggatgttaagatgtgcagacacccaagtgaccatcctaggaagattacactcccaggtccctagaaacaggaggcagggcacgcaaggccacgcaggagcggcgcgtcggccaggaggcggcagggtcgtgcggaagacctgggccagggcctttatcatgagaaggagagggcgaggtgaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctggtaatttcattcatttggattctggcaccagggcagctggtctgctgaggtctcagccaaaagagtggccacctccaaggaagccgggctgttgtcggga

SEQ ID NO: 209711 - DNA, 5769 bp, Homo sapiens
aggtcggcggcctggttgccatggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgaaagcaaaaaggaaagctttccacaaacctccacccacatcgccaaagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggaccggcgtccccggcggcactcctgactgtctgacagacaccttcagagtgaagaggccacatctcaggcgctctgccagcaacggtcatgtccccgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggatttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccgtggcacctctacctggggatgacgtcaactccgatgattccgacgatattgtcattgcaccgtctctgcccatgaagaactttccagtttaggtccccgtcactgtctccacgctgtgatggcagcgctgccgaggacataggaaccacgactggaaagataatttatcgtgttaggagaagaacgatgatacctacttaacacctcagcatctgcgtcgtgtctctttgtgcttttgtttgtggaaggagacccaaatgcctttactttattctctggggagggccagcggctcgcatccccctcatctccagctgcagctcggatggtggattttcagtgccaacagacacatctgccgtgaactcgcatatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctccatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattataatcacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctgggctgggctgggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcaggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctggggcattctctgtggcggtcagaaggccgatggccccaacacagtggcttgtgaaagggagagaggaggctctgcatgtccacctgctctatgggaggaggacacaggtgtccccagcccagcctgttctctcccagtcactcaagggatggggccacccaaagtgcaggacccgccccaccctgcggttcgaagcctggcccctgtctccacttagcttctgtttctgcagtgggtggaagcgagtcagcgggggccctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgccccagcgtcaagtgccaaagcaggccccatctaccacttcagggtcgacgttggtggcaggtgttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcatgtctgttgagctgacactgctgaggctgaagctggccctgtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttggaaatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggcccggtgttggacaaagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagaccaacctagctcagatccaccaagataagcacagcaaagcttggctgcatttttgaggaataaaaacctgcagaaagcaccgataaccttcaagatctgaatgagattctattataacccgtctaaacgattgcaaaattcctcctttggttttggaagcagcgtttgctctcccgtggctcggattctctgaggaccagggagttgacacacaaaccccgccatgggtccgagccagctatttctcaaggctcccacctcgccaagctcccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttagaattattctaactttatacataatgtataggccgatcttttggaagggataaggttttcattcttgtgcaactcattattctcattattggccttttaaataaaaagttgttttgc

SEQ ID NO: 209712 - DNA, 329 bp, Homo sapiens
aggactcaaatggggcttataatgtgacagtctaattttattttaggtgatgaatgaaataaaagagaaagtactataaattgataaactttcatatctatgtacatatatgagaatccacacacacacacactcactcacaaagctatgctaacactatgagttcagatgttgatgtactcagccctccagaggctgtcccccaagcagggagctgcctctctagcatatgctcaggtctattggtacccactctgaggccatggggtgtattaggaggcatggctggatgtgctgcctgtgcattttcaccactaagtgacatgtcc

SEQ ID NO: 209713 - DNA, 286 bp, Homo sapiens
ctagttcaagatctgcataaaatgagaagtggctgctgaatttgattcagagtcaatgcaatgccccttcctcctgattcagtttcgctatgagaaaatgcaggcccacatctttgtggagaatgccagcatcgcctaggcactgaagaatgtcagtggcaagattagggatgaggataacaaaaagatgtcaatctttgtcaaccccactgataccccctgcagagaaagctgaagtcggaaaaggcaaagcagataaagctgatggtgaagaagcgatgtgatt

SEQ ID NO: 209714 - DNA, 353 bp, Homo sapiens
agagaggctagagaagaggggctgaggagccaagggcagcagaaaccaactcctaggaagtcaaagcagaaggtgggtcacaggatcgacaaggggcctcgggtctgagtgtgcccaggcaaaggaggccccgaatgaggatgaggccaaggtctgagacctccctgaaacctggcatatctgggccagagtaaagccccttactattggagcccagatctcagcatcgggccatgagtcttgcatgtccctgtccacactaggcagcctcctgggcccccagcaagcaggaccccctgacccaagctgcatatcattggttactggcaatggagaagggctctgtcgggggg

SEQ ID NO: 209715 - DNA, 273 bp, Homo sapiens
gaatttattcatcttataactgaaattttgtaccttttagccaacatctccctatttctcccaccccacagcccctgggaaccaccattccattctctgcttctttaagtttgattattttagattcatcatataagtgagatcatgtaatatttttctttctgtgtctggcttattttacttagtataatgtcctccaggttcattcatgacactccaaataggatttcctttattcccaagactgaataacatgcatatatatatggatgt

SEQ ID NO: 209716 - DNA, 376 bp, Homo sapiens
cggggagtctccccactaaaaacagctttgtcccttcaggcgtctgaccttagtgtctcagagggccaggaagcacaggccatgatgggctgccctagagctgtcagaagccagcccttgtcagagggttaaagctgctctccaaagcctgcccccagcagggcaaaatggcccaggctgcgcagccctggtggacacattcagcccaggacacatgtacagccgatgacttctgatgctgctctggggctcttagtctccctgtgttcaatgaaactgctgttggcttcagctcttgcatttaattttttaccactaaacaatcatttggatttgcccactgtggtgtttactgccagcatacagagggccagat

SEQ ID NO: 209717 - DNA, 578 bp, Homo sapiens
gctacatataaggatattctcctatgtgatcacaatacaaacaccaaaagtcaaaatcagaaactaatgttgccatattactaaaatcttatcttcaaaccctattcagtttttcccagttatcccaacaatgtcctttccagcatgaggattcagttcaggatcatgggatgcatttagttgtatctacatccttcgttctgtaacagttcctgatgtcttttgttggttactacaacattgacacctttagagatcataggccagttatattgttaaatgtcccacattttgtgtttgtctgatgtttccttatgattagatttactgtatgcatctttgggagaaatatcacataagggatgctgtattcttctcattgcaccctatcaggcaacacatgccttcaggttatccctgatgattactgatgatattcgctttgatcccttaattgtgatggctcctgtcaagcctctctactatgaagttactcatttcccctttgtactttttgaaataaatattttgcaaagagatgctttaaaaccatgtaaatatgccacatctcaccaaat

SEQ ID NO: 209718 - DNA, 700 bp, Homo sapiens
gacatatggcaagccaagtacaaaaggaaatttatatacatcaaaatccagttaactgtgcaattgtagcgcttccacgtactctttaattggaagtgattaatctacactacaatggcatgctaaaaagcaaatatcaagggaagaatctaacagaattctatatactccctcccaagcaataaatatcacaatgaaaatcatatgcccatgtactagtatctgcatttagcagtaccaatctgtatgaggacattttcaaaggggaaatctcattcgagatcaacatgagcaatccattttaatgaaaacaataaccttattaagtgatgcaattatccatccctccaaaattaattcaattcttaatgagacctgcattaccaaaaaaaaatttcaattatttttatttgaattttgtcaatacaaattggtggaaatttatcttctctcttgtaatataaatctgtcaccccaggctggagtgcagtgccataaggctcactgcagccgcaacctcccaggctcaggtgatcctcctacctcagccttccgcgtatctgggactacaggtgtgcaccaccatgcccagctaacttttttttatttttgtggaaacaaggtctcactatgtcactcaggctggtggagaattcctgggctcaagtgatcctctgacctcggccttccaaagtgctgg

SEQ ID NO: 209719 - DNA, 410 bp, Homo sapiens
tggaccacgtggccttttccccagtatagagtatactcttggccacagctggccaagtatgactagcaggccaaatccagcccatccagcccaccacctgattttttttttttttttgagatggagtctcactcactctgtcacccactgcccaggctagagtgcagtggcttgatctcagctcactgcaacttctgcctcctgggttcaaacgattctcctgcctcgggctcccgagtagctgggactacaggcatgcgccaccacgccgggctaatttttgtatttttagtagagatggggtttcgccatattggccatgctggtctcgaactcctgacctcaagtgatccagccccctcggcctcccaaagtgattttgtaaataaagttttattggaagacaacca

SEQ ID NO: 209720 - DNA, 823 bp, Homo sapiens
gttcattgccacagcactgttgtttctcctttgttaagtatttcagaggaaattctggacaaaggaaaggtatatgggtcttcaagtagagcagggatgtgttccagtagttgtcaactagactgagaaaacttggatgtcttacgaaacaatgtcagaaatccatttctgtgttctgtgactttctacaaacacaatttttaaaaatccaaatatagcttagaccatcagtagtctaattcagtgtttcccagatttgagatttcttttggaactttagaacgtcaaaatgaatcttgggacattgataagattgcagactttttattttataaattgattaaggatattaaacttgccactttcaatataaaaaattaaggaaggttataacctttgtgaaaaacttgctacatagttatttatctcatcaaagaccagtgaaaactttctcatagaccaacacttggaaactatcagtctaaataaccagtctatattcaaaaattcagtaaagatttcttcacttctaatgctcattgacttcagttatcttataggtggaaagaagtagataccaaaacagatcttgattacaaaattcgttgatgacctagttgactctttccccagtcattactaatcctaacctttgggagcaacattctactagtctgctccaactggccacttggcccgtcgaatcgagaaccggcattccatacgccgggtatgatccagcggggatcctacctcgggacaagggcccggtggacacgcggcaatcgctccgggctgacacgtccgagcgtccacttggttt

SEQ ID NO: 209721 - DNA, 1013 bp, Homo sapiens
gttcattgccacagcactgttgtttctcctttgttaagtatttcagaggaaattctggacaaaggaaaggtatatgggtcttcaagtagagcagggatgtgttccagtagttgtcaactagactgagaaaacttggatgtcttacgaaacaatgtcagaaatccatttctgtgttctgtgactttctacaaacacaatttttaaaaatccaaatatagcttagaccatcagtagtctaattcagtgtttcccagatttgagatttcttttggaactttagaacgtcaaaatgaatcttgggacattgataagattgcagactttttattttataaattgattaaggatattaaacttgccactttcaatataaaaaattaaggaaggttataacctttgtgaaaaacttgctacatagttatttatctcatcaaagaccagtgaaaactttctcatagaccaacacttggaaactatcagtctaaataaccagtctatattcaaaaattcagtaaagatttcttcacttctaatgctcattgacttcagttatcttataggtggaaagaagtagataccaaaacagatcttgattacaaaattcgttgatgacctagttgactctttccccagtcattactaatcctaacctttgggagcgaaaaatatctaaataagttctggtttacaaatttgcaaaatttttgtcaacacttcagaattcagaaaaaaacacaggacatttttactatataacttcctaagtttatatgatatatcaaaagtcagtaaggattataccataataatatttacatttcacagggaagcaaaatacttggagcctctccttgtctttgtctaaagatttgtcattcatttgcattcaaataaattctttgctttcattcatccagaatggttctcaatttattagctcatgagactacataaatagacttgtattcatacattttaatttcagtgtaaaatggctttcctcaatttttttt

SEQ ID NO: 209722 - DNA, 706 bp, Homo sapiens
cccagctgcaacaataaacaaaaaaatgcatgaaacaatgtttttttcaagacactagacatcaggtgacaaaagatagtgttcgagagatggtaaacgtgaggtgagccctgcaattgcttagcttacagacttgagagtttatcaggtcatcacacagggaaggagaactaagacaagagaccagctgacttccttggttgtaacagagctaagtccagaaagaacaaggtaactgcagcttataaggaagggtaccagagagagagttttgcacagagagagaaccccggagatctgcagaggaacccctggagtatgtagcagagtacatcagcatacacgtgtgacataatcacttgcttctagggaaagaaccatctgaatgcattggaatagtgcttgacactcagacagggccaagaacaatgcctgttcagaattcacaggtcattgggtagaggactaagcaaggtcttgcctcattagaggggaaaattagccttagattgcacactgcctaatacccacctaacagggcataacagcaagacttgaatgcatcaaatggttcccaagtagcttttttttttttatttttttgagatggaatctcactctgtctcccgggctggagtgcagtggcaaatctcggctcactgcaacattgtttcccaggttcaaatgattctcctgcctcagcctc

SEQ ID NO: 209723 - DNA, 838 bp, Homo sapiens
cccagctgcaacaataaacaaaaaaatgcatgaaacaatgtttttttcaagacactagacatcaggtgacaaaagatagtgttcgagagatggtaaacgtgaggtgagccctgcaattgcttagcttacagacttgagagtttatcaggtcatcacacagggaaggagaactaagacaagagaccagctgacttccttggttgtaacagagctaagtccagaaagaacaaggtaactgcagcttataaggaagggtaccagagagagagttttgcacagagagagaaccccggagatctgcagaggaacccctggagtatgtagcagagtacatcagcatacacgtgtgacataatcacttgcttctagggaaagaaccatctgaatgcattggaatagtgcttgacactcagacagggccaagaacaatgcctgttcagaattcacaggtcattgggtagaggactaagcaaggtcttgcctcattagaggggaaaattagccttagattgcacactgcctaatacccacctaacagggcataacagcaagacttgaatgcatcaaatggttcccaagtagcttttttttttttatttttttgagatggaatctcactctgtctcccgggctggaactataaaagaaagaaagagagagagagagagagaaaggaaggagggaagggaagggaggggggcagaagcaggaagcatgtaaacaggtggtatgtgattggcagggctaagaccagaaggatgagaaggagccagttgtgtcagagttagaggaaaagtagttcacagtaggaagtcaggagcaaagactgaggcaggaa

SEQ ID NO: 209724 - DNA, 705 bp, Homo sapiens
tccttgcctgccaatagtggcttcacccaacttggggtgcattcttctacagtttctgatttctcaacttcacctaacattcccttgccttcttggatccctctcttgcccaacactaccatgcatggctgatagggcactgttctgccccatatcccatgggttctacttaacccagagctggcttacctggaaaccaagcttattctgtagtggcagacctcacgccatcttgcttaatagccttcagttttcctttagttgattaatgtatcactcaatagattatgcaagacctactctgctaggcactgtactaggccctgtggtttatatttaaatgaagagggaatgatctctgactttaaaatgctggaagaagagatgagatgcatcaagaccgtcaaaccacaagtgataagtgctgtcagagatgtgtggatcactggctcagggagttccaaggatagagacatattatctgtttgggaagggcttggtgggggaaaggcattcagccgggccttgaaaatcaattaaagtttgaatatgaggaaagaaagaagagcatctcagacaaggacatggcatggatgaaggcacagaggtatgggcgtgcagggcatctgtggaaatggacagctcagttctcgccgagggagggagttggtgcagagcctgggggccctgccttcagaagataaa

SEQ ID NO: 209725 - DNA, 451 bp, Homo sapiens
tccttgcctgccaatagtggcttcacccaacttggggtgcattcttctacagtttctgatttctcaacttcacctaacattcccttgccttcttggatccctctcttgcccaacactaccatgcatggctgatagggcactgttctgccccatatcccatgggttctacttaacccagagctggcttacctggaaaccaagcttattctgtagtggcagacctcacgccatcttgcttaatagccttcagttttcctttagttgattaatgtatcactcaatagattatgcaagacctactctgctaggcactgtactaggccctgtggtttatatttaaatgaagagggaatgatctctgactttaaaatgctggaagaagagggttgacgggaactttaacacagatcgaccaacatcccaacatcactgtgagtgggaccagactgta

SEQ ID NO: 209726 - DNA, 552 bp, Homo sapiens
aatgatgtccttctaccataacattttcaggcagaggtttcacctctacctctcatgggtattctagaaagagattatcatactggattagaatacatgcaaggcttttccatctgggagagagataagaaggaaataatacaaaggagactgtgccatgggataggagaggtggcgaatagctttgttctgaaatatgtgcagttggaataaaacaaccacattgattggagagaagacttctttcatcatttgaggaaaaaatactctcaaaatatatccagaatgtcaaacagtgctatcaatagctagaagttaaattaaatccttcattgctagtgagcttactgtccttttgttgtttaattgaaatgactttttattgtttgcctaaattggtgtgctttttactaggatgatggatggggaagcatatctcattctacactcctccaccagttaattgactagaaaattatcatgggccattttctcattggctagtgctgaatacagctgtaccagagctttgcaaacaattccactaagaaa

SEQ ID NO: 209727 - DNA, 356 bp, Homo sapiens
agcaggcccagtgggctgctagaatcccagcagccaggagagtgatgtgtcccagcagaggaggccactggaacagagcaaaaaccacaggaaccgaaacttcccgggtgcccatgagtcaccaccctgtgagggctgggccctggggctgggtgggaactttcccaggccttgaccctcagctcaagggcatgtcccttgaccccatgacaacacaaagagagggctgcagcctggggttcacaccctggtatgtctctgtcttactctcagtatctctgccaagagatcatttgattcattaattagtgtaagtatgtatatctttagaataggaaatacaggcatattgcaaa

SEQ ID NO: 209728 - DNA, 623 bp, Homo sapiens
tttaaattcgtttcagtgagtgaataatgcccaagcttttggttttcagatataatcattgtaatatttaatcccttgaaattacctcttaatcttaaagtctatcagctttaaactctaggcagcaaatgcactgcaggcatgttttagggagttttgacttctttgggtttgtttgataacatttgataaataattgcctttctgtgttgaatttctttcttttttccctttttttttttttgagactccatctccaaaaataaaaataaaaaataaataaaaattaaaaaatttaaaaaatgccaaaatattttagagaaagaaaagactgactgaacctaaggaattccaacatctggaagtctggtaggccaaatcagatcagcagataagactcaggagtggcttccagagaggtggcaggaatgtgtactatcacagtaacctgtagtagtttgtgtcttgtgttcattttcttagtactgcctttttgaaggacagaagtttatagttttggtgaagttcagtttaccagctttttttttttttttttttttttttttttttttttttttttttttttttttttttttttttttttttttttttttttttttttt

SEQ ID NO: 209729 - DNA, 358 bp, Homo sapiens
taaaaaatgcacaccatcttccagcaactcatacaaatgtttccatttcagagaaatttaagaacttttgaaggctgtattcctcttaaatgtgagacttatacttcagaagtttctattaaggtatgtgttaatccacaccaagagaaagaacttggaaaaacttgctctgtcaaaactgttggaaaccatctcgagatggttcctctagctagataagtttaattaaaagtgcatgcaccactggtgtacatgtgcacggaccccaccaccccatcaccactggcacatacacatggaccctgctgccaccgtcctggcaaagtgcttttgctggcacccccacattggaatgtta

SEQ ID NO: 209730 - DNA, 294 bp, Homo sapiens
accatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaa

SEQ ID NO: 209731 - DNA, 399 bp, Homo sapiens
tgccacagtgactgaggaatgggcatgtgagactgagtttgggccactgaaacatgatggtatctgggaaaaggcttcttgcttctgtagatgggccatggaagcccgctggctccggctccctcctgtgctggatgtaaatgaggaagcatctggccccaactgctccactgccacactacagccagagaaggactcaccttaggcagaggtcgacactgtggagggcagtgtggtgacccctaagaaacctggacccttgggggaggggggagggaaagcattaggagatatacctaatgtaaatgacgagttaatgggtgcagcacaccaacatggcacatgtatacatatgtaacaaacctgcacgttgtacacatgtaccctagaacttaaatt

SEQ ID NO: 209732 - DNA, 204 bp, Homo sapiens
ctccctaaggaagttaacgttcactattcagtatcttttcatacttttttctttgtttctacagtaaacataaatagctatatatagtgtcccttttaataaaaatgtgattgtgcaatacacattatttttattctttcaacacgtgttcagggttctgggccggggtggacggtgggtgggatggaggcgaccttggagcag

SEQ ID NO: 209733 - DNA, 546 bp, Homo sapiens
ataagacactaactcaatttcatttcttcttctacgtgctgagaataaaacaaggtataaaacatgattatccacatcaaaaaacttatccaccactatcaaatagactttaatccctctgatgcaagattggttcaacatacagaaatcaataaatgtgattcatcacataaaaagaactaaacccaaaaaccacattattatctcaatagatgcaaaaaaggcttttaataaaattcaacattgctttatgttaaaaaccctcaacaggctgtgcgtggtggttcacgcctgtaatcccagcactttgggaggctaaggcaggcggatcatgaggtcaggagttcgagaccagcctagccaacatggtgaaaccccatgtctattaaaattacaaatattagccaggcatggtggcatgcacctgcaatcccagctacttgggaggctgaggcaggagaatctcttgaacccaggaaatggaggttgcagtgtgccaagattgtgccattgcactccagcctgggtgacagagtgacactctgt

SEQ ID NO: 209734 - DNA, 991 bp, Homo sapiens
  misc_feature (514)..(514): n is a, c, g, or t
  misc_feature (518)..(518): n is a, c, g, or t
  misc_feature (523)..(523): n is a, c, g, or t
  misc_feature (574)..(574): n is a, c, g, or t
  misc_feature (578)..(578): n is a, c, g, or t
  misc_feature (613)..(613): n is a, c, g, or t
catctccacacactaataaatcccacccatgcttaaggcctggccacagtctttgtgtaccccattctgtatgtgctggatctccccactcagatcagcctgtgctagaggagcagaggtgcttctgaaggaggtccatatggctggccaaccaagtcgtgttttcctaagaggctctctcttcatgaccaagttttggtgctcacggagatctatggcccctgtcccagctcaggcatccacatgcctttcaggggccgggctccaatctccaacccttattccatcctagctgccagaaggagctttctcacacagtttactgtcactcctctgctcaaatctgtcaatggctcccctgtgcctgcagggtaaagacctagccctttagcctgacattcaaagcccttggtgaggctgggcgtggtggttcatgcctgtaatcccaatactttaggaggccgaggggggcagatcaccaggctggtctcgaactcctgaccttgtgaaccanccanctcangctcccaaagtgctgggattacaggcgtgagccaccgcacccggactcggngctncttttctccctgaataacttctactgggctgatcnaacctcccatctcagaaagtccaccctcaagatgttccaggcacctcctttaactccgaagtttccagttccatggcgaatcccatgatggtgtcggcgccataaatgggtgccgtttttccttaaaccattatttcccaggggccccatttctcgaggggggagaatgctcagtggtcctcacacgcacttcacagcaaccccttcagggcgacacccggtccgacctcgttcctgtctgggcggcgatacgcgccggatgccccgccccggcccgccactggcgcccgcgcgcgcgcacacagacccgaacccgcagggcacggaggcaccgacaccgcaccccgcgccccccgctagccgccggccgcgcctgct

SEQ ID NO: 209735 - DNA, 742 bp, Homo sapiens
  misc_feature (514)..(514): n is a, c, g, or t
  misc_feature (518)..(518): n is a, c, g, or t
  misc_feature (523)..(523): n is a, c, g, or t
  misc_feature (574)..(574): n is a, c, g, or t
  misc_feature (578)..(578): n is a, c, g, or t
catctccacacactaataaatcccacccatgcttaaggcctggccacagtctttgtgtaccccattctgtatgtgctggatctccccactcagatcagcctgtgctagaggagcagaggtgcttctgaaggaggtccatatggctggccaaccaagtcgtgttttcctaagaggctctctcttcatgaccaagttttggtgctcacggagatctatggcccctgtcccagctcaggcatccacatgcctttcaggggccgggctccaatctccaacccttattccatcctagctgccagaaggagctttctcacacagtttactgtcactcctctgctcaaatctgtcaatggctcccctgtgcctgcagggtaaagacctagccctttagcctgacattcaaagcccttggtgaggctgggcgtggtggttcatgcctgtaatcccaatactttaggaggccgaggggggcagatcaccaggctggtctcgaactcctgaccttgtgaaccanccanctcangctcccaaagtgctgggattacaggcgtgagccaccgcacccggactcggngctnctttctccctggatacctctcctggctggatcaaccctccatcttaaaagatccacctaagattgtccaggacatcatttcgacgtgtccaggacaatgcagatccatagaggggtgtggagcatagcagtgcagattttaccttaatactgtcttttcccagc

SEQ ID NO: 209736 - DNA, 409 bp, Homo sapiens
gattagcaatcctacttcagtacactttcattgggagccagctcgtgcccaggggtgggatgggaagatgaagttgggaagctgcccttcagcggttcaaaggaggggtcctgcaggtgggccgcagtggcaggtggtgaaagacacaaggccaggggaagccctgacaagggagggcattcactttcccagtgtgaagacggcatttgtgtcattttctaattactgaggcagtttttctttgtggttaagtccacactggactctgaacccagactattacctgctgggtgtggcggctcacacctttaatcccaagaatttgggaagccaaggagggtggatcacttgagcccaggagttcaagaccagcctgggcaacatcatgaacctcctctctgaaaaaaaa

SEQ ID NO: 209737 - DNA, 319 bp, Homo sapiens
ccaataggttccaatgatgctcctgagatgagggatgttaattattagttgcttcatgggtagctgtccctgccattgttaaatactaaaactctactatataactgtggtaatgattcccctttgactagttatggcctttcccttaaaagtaaaatgacaacactctaatatttattgccaaaagcaaccagaaaactgtagcaaatatctgaaacaaaaacaaacaaagaaacaaacaaaaacagcacttcaccccttgtaaagcaaaagtcaaaatttttctatttcaaagttcaccaagctctcaggcctctta

SEQ ID NO: 209738 - DNA, 395 bp, Homo sapiens
atgtatatggaagccaagaaaagggtttccagaaggagaggtggtcaacactgctgaacatcagaagaggtcaagggaaataactgagaaaataagacaaggatgggctgttgggaaccctactggaagggaattagagtggtcaggtagccatctctcttttttttttttttaatggccatgtagaaggcatattaggagtgtatgctactttaaggagaagggaaaggtttgtctagaatgataaaggaatgaggatgttctgtagatgtgaggatgtagcttgtagcaagggagtacagatttaatagaatgatatctctgaacctgtgctatcctaaaagaaaagatgcaaagtgggcattttttcttcctgtagaatgtgtattattgct

SEQ ID NO: 209739 - DNA, 439 bp, Homo sapiens
aagaaagatcctccccccaatccggggtttgacagacaggtctatatggtgtgattccatggatatgtggtatataatatgccagaatgtttgacctaccaggtaggaatctaaccatatcttcctccacaagcactaacatttaggattttggtttttgtttttcctcaagttgttattttgaacatcttatttgtaagttctctgagggaaattgaaatttaaaatatctaagacaaagaggaaaaatctaattgagttgatcatttctgagattactttaagtctttgtaaacttagtttaaattttcacatttgttccaagtaaatacttagaaaacttaagaactgcatttgatgccacagttgatcttctggcagcagatagtaaatgggagaaaagtaaagccagtaaaaacggttcttaatagaaatgtaa

SEQ ID NO: 209740 - DNA, 158 bp, Homo sapiens
tgcaaaaggtaagacacttgagtatctccactcttaaccatgtaaagagactgggagacaagggaagcttcagccatagttaatgctatagtttccttgtcacaaatccatggagtacatgagtctattacaaagttttcacccatccatgataaaat

SEQ ID NO: 209741 - DNA, 410 bp, Homo sapiens
gatcttgcttccttatcctgtttgagaagtcagttgagactttccctggcagcagggcagcagctcctcagagccagatccctcactcccttatcttttgtttgttcctctggctttgaaatttcataaagtaaaccaaacacctaataaatgaacatctggcgcctacaatttaaagaccaaaaatagtgagaaccaattatgaacatttgatacatgcatttttaatgtattaatgtgacatttccaaaaatgtattccttggaaataaaatattaatgatggtttggtgaaaatggctccatagtcaagcaaggcatggggctcacacctgtaatcccagctgcttgggagactgagaggatcacttgagcccaggagttcaaggctgcagtgggctatgatcttaa

SEQ ID NO: 209742 - DNA, 658 bp, Homo sapiens
tcgaattcttgctgtaacagtgttgtgttggtatgttctatatattgtgtcagtctccaaaatgtaagtttctatagggcagcaatcatctgataaattaatcttaaaatgttttcagctgtgactaatcaaatatttgcaccatttgggatgctgactttcaagaagcaacaaataatctaatactactttgcctttatttgtttccaaggaattggaattgtaaatgcacttagagttatcatatgatgattatctcttagtcataagtcaggatttttcgctctataacaatagcaattatactcatttaaggctgtaagcaagaatcttgggcaattcctatggcaacaaacttgagtgttagcatgagaagtgggcagtcaagttttaatttagaaagtgccaataagaacaccgcatttttccattattaatttaaatacaatcaatcttacttcacaaaatatatttatgttttagaactttctagcaggaaacttagcaatgccttcccctctgtactctacacgtatacctacatttctccttcaatcataaaaagctacctcattccaccatagctaccgtcttaattgttaatgaagttagagaaaacaccagaggccaggcgcggtggttcacgcctgtaatccca

SEQ ID NO: 209743 - DNA, 412 bp, Homo sapiens
gggctgctgtgactctcatttcacacctaaagaaactgagtctaaggaacactcaagaccacaggcccagcgaggtggcgctgctggagtccagctactcatgctgcacctcgcctgcctccctcgattccttagctgattcctcagctggggccacacagcgcacccagctccctctgccctgggacaagccagccaagtccaaggccaagatcccatcatactcctgaggctgctccaggagtccagagcctggttctgttgggagattctggaaaagtcaatgaaccctactaaaaaccaggcactgttttatgtgcactgtctcactcgaatgtcccaaccatggaagaaacatactattctttttctttttttgaaacagagtctcgctctgtcacccaggctggag

SEQ ID NO: 209744 - DNA, 160 bp, Homo sapiens
tcacagtaaggagaaggagaaagagccgcatggagactccaaatgcagttacagaatgagaccacaggctaaactcaaaggagaacatggaatactttgccccaggcttagagtctataagtgagactttcaaaaaccgtttttccccactggtttgaag

SEQ ID NO: 209745 - DNA, 384 bp, Homo sapiens
aagccccctgggaaaggggccagcgtgggattactctccaacctgccagactgtctggcgattgctgcacaccatgggccaggtgtgatcagcagatccaagatatgcccgtcccccagaatgacccacagctggcatggggttgtataagtggcctccagcaggaaaggagcatgtgtactccattgccagttgcagcacaatccaccactcttccctctctaagtggcagacaggttgaaataaacctaaaacgatatccaactccttacccagaggatttaaagaatatggtaaaatctgttcaaaatttggtgggtaagccaagccatggagtgcgtgttgagaattcaaatccaactgctaacacggagcaaactgtga

SEQ ID NO: 209746 - DNA, 333 bp, Homo sapiens
tctggagaatgagacttccaatgaaatcaggtggaaatgacatctcgccgctttcagcatgctctattggttggaacagttatggacttagctagattcaaaggaagggaacaaagaccccctcctctcagagagtggggcataatgagagaatttagggccatgttatccaaccaccacaaatgccttctgaatttgaggttctgcctcaaaagttcatagttcctttgactgaaggacttctatatatccaagcatcgtcagccccaggtatattgttccatgtaagtgaccaggactaccttagtatttcgtatagggaaagtgacctga

SEQ ID NO: 209747 - DNA, 418 bp, Homo sapiens
tacagggaacccatcactcccagagctgcctcatcgggtgctgggtactctgatcatgagaaagagtttctttctgactgaggcatatactgttcccctctaatacccctccccaactcatggttcttctctctcaagccaggtgagggagcttatttcatcttttgtatggcagcccttcacaaattgaaatctgcttctgttgaatcacagaattttgtagctggaggaaacttcagacacaagtcctgttacagaagaggaaactggcacagagaggaaatggtgcttgcataaggtctctgggtaagttactggagaaatcagtgtgcaaacccagacttcttgacttctggatcaggaatttgtagtgaattatgtgaggggataccaggtctggttgtgcaggctgcgcatt

SEQ ID NO: 209748 - DNA, 307 bp, Homo sapiens
ccccaatggaatccctcctcctgggagccaaaaggaagtctctcaaaataggcaattaagtccttttctatggctaattttttttgtaagatgttacaatcagatctggaacttaaaaattatccagttcaatatcttactttatacaaggaaaagcagtcactgaacaaggacatgactgaccttgcaggtcagaactgaggtctctgtttttatttaaatgttctttcaccctcaccacactgtgatctgcaaagagagaatagttatccacactcactgctccatttcctcacctcctactcat

SEQ ID NO: 209749 - DNA, 345 bp, Homo sapiens
catgctagatagtgctattcaggctatagtcttgtttctggaatttttccaaatgggaggaatgtgtttcaaggatgcagagtattctttaaaaccgtatgaccaaactgacctctattgttaaagggatctaactaaaagggttcgtgtttcccactttgctttgtgaatgcctgaaaagcaatccaaaggttgagaacactggaaaacagagctattttattgcagtcctgagaatgcagtcattactgttttattccttcttatcttttgaagcaatactttagtaattctttagtaacagtatgctttaaagaaggtatctgacacatttttggcatgtgc

SEQ ID NO: 209750 - DNA, 535 bp, Homo sapiens
tcttatgtatgtttaagtatgtaatatatattatattaacatataatacataaaatatataatattaacatatatacagtaaaaatatcaaatgtgggatttcaagtaaatttcatgcaaatcttatgcaacacaagggctcaaatgcagaccctctggtgtaggaagaggggatttaaaaggaatgctaggtaatatgtgattttgattctccagctgagaacaggagaagcctggggagaggagaagtgattgccctgagtggtcctttggcccttgttgccaaaatacattttattggtttattctgattataaaatgatattggcacactaaagaacatttggaaaatgtagaaaaagaagtttgaaatacctccaatcccactgtcgatattttaacagactttcttctagacttttctatgtccatatattaaatgtgtatatatttaacgtttttgccactatgctcttaatacagttttatagtctgattttattattaaaattttttagaaaacataaaaaaaaaa

SEQ ID NO: 209751 - DNA, 142 bp, Homo sapiens
ggataattgttaagccacgtgggtgccctttctccctcggcctctcctcccccgacccccggggagagctgacccccacagctcctggccattcagcaggaggctggggaagtagctcccacctctgaggcaggatgggctg

SEQ ID NO: 209752 - DNA, 812 bp, Homo sapiens
cctggctggaggaacttaggaggggagagccccagcctgccacagggctccctgttccacagcggcacagcctcgagtagccagaacggccacgaggaaggggcaaccggggacagagaggacgggcctggcgtggccctcgaggggcctctgcaggaggtcctggagttgctgaggcccacggactccacccagccccagctccgggagctggagtaccaggtcctcggcttccgggaccggctgaaggtatggccaccccgccccgggcggtggccctgctttgctgatggcatgatgactgggagtcgggggctctggggccacgcagcctgggccgacatcctggcctcacctctgcgtgacctgggtgggccgtgtctctctgggccttggtttcctcatctggcaagcggggataacaacagccctcatggggctcaggaagattttaagagttcacagtagataggctcatgcacatccagccagaaactggccccatctcgcaccttctgacctgggtgggcggggctgtggcttgtggctacaaacccaaacttggagtgttgtcagggtcgcagctggctccatggaaggccccacacagttccctgtttgcctcatccacgcaccccgcactgaaccttctccacagggctcataccccggggctgttctcagttcacaggagggcttaggtggcaggtggctttcagaggtgctgacctaggcaaattattacattctcctctcgtgtttacacaaatttgaatgtacatcaaaaaaatgtataccactagtacctacta

SEQ ID NO: 209753 - DNA, 453 bp, Homo sapiens
taatagagcgtaaaagtgttcatagtttagtcttgttcagagatggaaaagactacttaaaagacaggatgagctgcactgacttgcctttggtaaccgcacagctctctacttaactagtcaagcgactttcaagggaacactgtgaatattacttaggattagaatcagtatgtatgcatatggtcactgtatctttaaagaactgttgagttctttttaattctacagtttctttatctttgcacccctttgaatgcctcgcacacctagtaggtgctcagaattcagaccaatgtgtcagtgttaggaaactagatttaagctccatttaagatcgtctttttcacttaggtttctggacacgggataatgggataattttgtctgtattttgcttttgctaagcttttaattattgacctagggtcatattatagtgcgaattgcaca

SEQ ID NO: 209754 - DNA, 523 bp, Homo sapiens
atatgagagatactgatgccaggagttgataccagcctggcgacatgccaaaatcccatttctaacaaaagatacaataattagtagatgtggtagtgcctgcctatattcctagctactagggatgctaaagtgagaggactgctagggcccgggagttcaaggctgcagtgagctgtgatcatgccactggagtccggcctgggtaacagagtgagaccctgtctcaataaaaaaaaaaataacttcccatttggagagttctgatgtttgtttttaaaaagccgtcctaggccaggcacagtggtgcctacctataatcccagcaccttggaaggctgaggtgagaggatcgcttgagcccaggaggtcaaggctccagtgaactatgatcttgcccctgctctctagcctgggggacattgggaccctgtttccaaaaaaacacaaaaattagagtaaaaacttcaagatgattttatgttatggaccatgagatctccctgcttggcctgtagtgctt

SEQ ID NO: 209755 - DNA, 467 bp, Homo sapiens
actctgtgggttgtctgtgaactctgctgattatttattttgctgtgcggaaggctttttgcttaattaagttccacttatctttgtttttgttacatttgcttttgggctcttggttgtgaagtctttgtctaagccaaagtctacgaggggttaatagttttaatataagtgtgggacatgtttatgtcactggaaaagatggaagggcaagaattgagtcatgactaaaattattgagcacaaagattccctttaagactgacttcttttctccagtcctattggcctctcagccaggtgttaattttttttttttttttggtaccatgagcccttttgccagtctggggaaatccatgggctccttctcaaaataatgtcttaaacttaataaaactaaatacataagattacaaggcaaaccaatgatatcaaaagacagttattaaaatatcaacaacaaa

SEQ ID NO: 209756 - DNA, 561 bp, Homo sapiens
gacaggagaattgcttgaacccgggaggcagaggttgcagtgagccgagatggtgccattgcactccagcagagcagggtgagcacctgtaatcccagcactttgggagggcaaggcaggtggatcacttgaggtcaggagttcgagaccagcctggccaacatggtgaaaccctatctgtactaaaaatacaaaaaattggacgggtatggttatgtgcacctgtaatcccagctacttgagtggctgaggcaggaaaattgcttaaacctgggaggtggtggctgcagtgagctgagtagcctgggctctccaggctgggcaacagactaagactccatctcaaaaaacaaaaacaaacacatttcataaaaacaaaaacaaaaacatacatgtgagatgtggagccaaaagaccttcaactgtcaaactggaaatgacagtagtaataattatctctgctcagcccacctcacatgcccatgatgtgaattaaatgagatcgcagatgtgatggtcctttgactcagtaaaggaatgtatttgtaggatacaggctct

SEQ ID NO: 209757 - DNA, 408 bp, Homo sapiens
cccaccccctcttgtcatttagttgagaaacatttgccctggaacagcacacagagtttgcattagcatccctgaggacagaactttgaccccacagactaaggaagctacaaatggaaaattccaagttgctgtactcttttattttcatgctaatgcttctgcagagagtatttaaggaaacagatgcacaagaataataaagagctgaggactaagaactcctctggcaactgaagttatgctccgtccagcatgatcctgtatctccctgtgcttgcacaagtccaggagggtcaaggtgaaaccctgatttcattttatgaaaaagctgaaccagcactgacatagagaacccaggattacatccagtcaggatttgaaaattgtttaagtttcatttcactt

SEQ ID NO: 209758 - DNA, 363 bp, Homo sapiens
ctagagcagaggctgtgacgtggggcagttctcttccatcaaagatgctttcgttagcaggtgcttgaggtgggactcagactcttatttatattttcgacattcatgtaggaaaatggaagacagtttctcaaagagtttgttgtgtgtgtttatttgtttcttagagaataatttgtaactctgggtcaggaagattccatctaaattaattaatcagaatagtagtgttaaggtaccagagtgcctagagattctttattaggacaaaaccgctggcccagataactccagcatttcattctcgacgtctgagttgtgctgacagccagtgccttggcttccatgggcagtgacttacgt

SEQ ID NO: 209759 - DNA, 560 bp, Homo sapiens
catagtttgctagactctagtatgaaagaactgtcttaaatgcccagtatcttattctatagttgaatagtctatataaaaataagtgccttttccagccgggtgcggtggcttacgcctgtaatcccagcactttgggaggctgagatgggcagatcacgaggtcaggagatcgagatcctgcctaacacaatgaaaccccgtttctactaaaaataccaaaaattagctgggcatggtggtgggcgcctgtagtcccagctactcgggaggctgaggcaggagaatggcgtgaacccgggaagcggagcttgcagtgagccgagatctcgccactgtactccagcctaggcgacagagtgagactccatctctaaataaataaataaaataaaataagtgcttcttccaacaaataactgaaccacaggccagcaaggtcttccctgccctcttaggtagactgggaagattgctgtgtgaaccaccgatctcgtgatgcataccagcagcaacaagtattgcaggactgatgaagatgattgttatttgtctgtttt

SEQ ID NO: 209760 - DNA, 528 bp, Homo sapiens
ttgcgcacaggctgccctcggtttattgccacatgggcttctccagcaaggcaaaaacacacatgctgagaaggcaatagagagagcctactagcaagacagaagtcttttaaaacctaatcgtggaaaatgacattccgcaacttttgctatattctgcttattagaaaagaggcaggaataccaggagatagggatcattggaactgatattaaatgactatcaaagttcaccctctggcctctaacgattttttatttccctaccaaatgtgaaataactcctctcaaggttctcagacgtctcattccattataacatcaacttgaagtatagaatcctcatcgttaaaatcagctctcactctttgttcagtgtctctcaacctgtgacctgtgactattcagaccagccccatgacacctatttatgccatatggagaaaagcaccacctagaaaagccttcccaaattcctgaacctcaagtgtgcagaatttaataaaatggttgttttttaaaaaaaaa

SEQ ID NO: 209761 - DNA, 182 bp, Homo sapiens
tggttggaaatggagctgaggacatcagaggaacggaacctggatatggcatctcgaaggggaggcaaagacagcaccttgggaaacaccctattctggtgcccagaggaggacccttgagtgattcctggctcccaggtggtgctcgagaagtatttgttgaaataatgaatgctgatggt

SEQ ID NO: 209762 - DNA, 457 bp, Homo sapiens
aaatgctatcttcaatgtacttttgtaattaaatgtatccttattgataatccaggtattaagtagaacattttattaattagggcactccagctctagccttacagaaaacaacctgttatatgtgatttcatctgtcagagtgtaaagagatgccattgatcgtcagatgctcaaaagctagtcctctggatggttccattgataccataccttttcattctcaggacaacattgacatacaaattaacatttcatctcaacatcctaatttggagaaaacaagattacatatccctgtgaaaagaagagatggtactgaaattgagagggtctacagagatattttccattggaacagcaccttttattggaaaacaaagcaagaacagtaaaaactcatattttcattccttatttacccacatgaataaaaaaagaactagataaccaggtc

SEQ ID NO: 209763 - DNA, 591 bp, Homo sapiens
tcaggagcaaattagaaagctgttgtaggtgtcctgggaactgatttcaggacctgtacaaggatggtagtttggatggaaaggaggagctggaaccaagaaagattttagtaaatatagtcggcacaactcagtggctaattacacatcagagaagaatgagaaggagccaagaaagaatccaggcttctagtttggggaactggacggactgcaaccctattacccaaaagaggacatacagaagcattatcaactatcatctaactgtgttttgaaagcaaaagatcttggtaggacccatcattctagacaaaggactctgtgaccttccttctgtgacaactacacactctctctctcaagtgcctcaaacccttttctttctatagactccttcccttacaggattgtaggtgatcagagatgtgagaaggttccagcagcatttagcctaatgccttccttatacagttggaaggtctacagatattaactgacttgtgcaaaaccatatctttttaatttaagattgccctaacatcaaaatgaaaaacaacaaacacatacgtatacacttttccatcagct

SEQ ID NO: 209764 - DNA, 1289 bp, Homo sapiens
tagataaaaccaagaagtgacagggctggaagggatcttaggaattagttcataaagaacttcaggctcagagaagacatgtgagttgcctaaggtcacacagcaaatctgaagcaaatcagggctagaaacccatagacgatggtcatgagcactggttttgagtcatccatttgaacacacctgtgttcagattctacctctgttacttatgagctgatttcttacctgtgaaagtgggatacctacccaaggggttcacgggaggatttaataagatgatttggattaggaaaaactgacaaatttccccttccttcttctccctgccttcccctcacctgttaataaatagatccttgtgaaaggtcagtgagcagcatcagccagaaaggctttgttttcagcaaggtccctgcatgtatgattacaatcctaagtaatatcagctgttgcttgcgttggtttctcagctctctcttggtgatctctctctttagctgttgaatgagttcaaagatctaggaagagctttgaaacccctctagcagcatttctgtctccagtcccagcacaggtctttggaggatgagataaaaagggttttgcccagggtcaaatgctgtgtacacgcttggtcactcttccctttcttgagatgacatgtccccttcttggagacccaagatgattgacaacaataacattcctttacaacgttttcttctcatctagagcactgggaggctgccttttaacagagatatcacagagtagcaagcatgcagacattctcatgacatcctggcagatatcaagaccaaagaacatcccatgttccctcttgaaggcttgtaataactgccataaattatcttgtgggaatggagtggccctggcctaagctgtgctgtaccggactctcctggtgacagttttagtggctgcatatgtttgcagaagaaggaagcgtggtaacttggcaaacagctccaaacgctcctggcttgctgccacaggattgtccttgagacttgggcacagtgatgtgtgaaaaatgcccacctttgctcttggtgtccagtgggccttctatgggccctctatagaggtcatcacctggggattcctgactctggccaggtcctgaggtctttccatgttactctccatgttacttgagtaacataagagcttcttatggctcttatgttctgcaggacggatgaactaggtacccaggacaggtctgtttgtgcacaaggctgtctccttctccccctccttgg

SEQ ID NO: 209765 - DNA, 513 bp, Homo sapiens
gtggaagccccaagccttggcagcttccacatggtgttgagcctgcagatgcacagaaggcaagaactgaggttcgggaacctccgtctagacttcagaagatgtatggaaacgcctggatgtccaggcaaaagtttgctgcaagggcagggccctcatggagaacctctgctagtgtagtacagaagggacatgtggggttggagcccccacacagagtccccactggaacactgcctagtggagctatgagaaaaaggtcaccattctccagaccccagaatggtagatccactggtagcttgcaccgtgcgcctggaaaagccacagacactcaatgccagtccgtgaagggagccaggagggaggctgtacactgtaatgtctgtcagctcacccctttttatattcaagttattggttatggttattggtttatatgcccagttattggttatgcttcacacaagatgaggaaatcagggctgccataagggcagcttggaaaatcac

SEQ ID NO: 209766 - DNA, 482 bp, Homo sapiens
ctcagttttcccatctataaaatgggaagaccaattggctgatcgctgaagccttctctggtctgtgaaatggtaacaccaataatgatgctgaagtattttgggaactgtgggggtggaaggctattagcccaacttgcttttaagcttagcagaagaacaaatggctccaaggaatctattagaccttttgcataattaagtatatcctgtaatcagtgctaacaagaaagagctaatctttcattaaattagtttttaatttaattctatgctaatttaattttgcatcacttaaaatgtatgtttttaaatggatgtttacacgctgttgcaggcggctgtgaaattaattcattcttcgcttaacctgccaacctgagcgcccggtattccagttccttggcaattgttgccaacgccacaattctcttaaagcatttcttagattccctggtgatttggttgaatgcttaaaaaaa

SEQ ID NO: 209767 - DNA, 572 bp, Homo sapiens
aaaagcaaaaacccaagcttacagtcagggaatccaactaactgatttgcactaccagatgcaggaattagaagcaccgtgtacttctgaagatgatagcaactatgttaaagaatgaagaagctctctatatactaacacataaagtcctccaacgtgtcagataaaaaaaagcaagaaacaaaactgtgtgtacagtgcgacacctttattgtaaaaaggaagataaagatacgcatttgtatttgactgcaaaaatttaaataagatttgcacataaaactctataaaagccgggcatggtggctcatgcctgtaatcccaacattttgggaggctgaggcaggtagatcagttgaggtcaggagttcgagaccagcttggccaacatggcgaaaccctgtctctaccaaaaatacaaaaattagccaggtgtggtggctgtagtcccagttatggaggctgaggcataagaatcacttgaacccaggaggcagaggttgcagtgagccaagatcacaccattgcattccagcctgggtgacagagcaagactctgtctcaaaaagaaa

SEQ ID NO: 209768 - DNA, 536 bp, Homo sapiens
tcatttgaaattattgagtcagagtaacaacagcaacacaagaatgaagaaaagtaaagaaagcctgaaggacttatggtgtaccatctggctgaccaatatatacattatgggagttctagaaggagaagagagaataggacagagagcttatttgaagaaataatggtcaaaaacttccaaaatctgaggaagaaaatggacattcaaattcaaaaaactcaacagactgtagatatgatgaatcagaagaggtgcacactgtgacacattataaactgtcgaatgtcaaagacagaatctgcaaagcagcaagagaaaagcaacttgacacatacaagggagctcccataagttatcagtggatttctatcagaaatgttacaggtcagaaagagttggaagatatactaaaagtgctgaaagaaaaaaaactgccaataatactgtatctggcaaaattatcatttaaagatgaaggagaaataaagaccttcttggataaacaaaagctgagggaattcatcatttatcat

SEQ ID NO: 209769 - DNA, 388 bp, Homo sapiens
tgcagggcgccttctgacgccacctccagccgccatccaccagacgccagcttccccgctgccctgaacttcctccagcgcaccaggccttcctctgtcctgtctgaggatttgctcatgcaacgtgctgtggccaaacaccctgccctcctcccttcgcagatgtcttcctctcctttaaggcctggctcaggtgtcgtcttggtggcttcgggtgtcagctgctctgttttgctcacgcacctgcttgtgcttctgttgttgcctcctctccctggctgggctcgagctgcttcagggcaggaaccacgtctttacagtttgatgttcccagagctgacccagtgtttggcataggggtgtgctcaatacaatcgagttgacatga

SEQ ID NO: 209770 - DNA, 815 bp, Homo sapiens
gaattacttgaggccaggagttcgagactagcctagccaacatggtgaaaccccatctctactaaaaatacaaaaattaattggacatggtagcaggtgcctataatcccagctactggagaggctgagacatgagaattgcttgaacccaggagacggaggttgcagtgagctgagatcgcaccagggcactccagcctgtgcaatagagtgagactcggtttcaataaataaatgaacaaactggaaatgacattttttccaaccatttaaattcatgttgaaaaattttagatgtctgtttaaatgtgtgagggcatatatagtttataaaaatttaatttatagcaggtatatgtgcagaatttttttgaagatgactaatctatagcagggtttctcaacctcagtgctattgattttttggactgggtaattcattgttgtggggaggctatcttgtgcactgtaggatgtttatgagtatccctggtctgtactcactatatgcccctagcagctccccagtgacaactgaaaatgtttccagaccttgccaaatgtcctctggggagtaaaaatgccccagttaagaattactgattttactgagttagggctagttacatcatggtggctcacacctgtaatcccagtactttgagtggctgaggcaggaggatctcctgaggccaggagttccagcctggccaacatcaaaacctcatctcttaaaaaaaaaaaagaattagtgatctaaaaccatgttgatctcctttcagtgacatagaatttatatcaacatttcagacttt

SEQ ID NO: 209771 - DNA, 337 bp, Homo sapiens
ttgaaaggcctctcagattaagagagaatattgtgtcttggggaaatcaatcatattattatgaatcatagaattatgagtcatgtgttataggttgtttcaggcaacaagacctcagatgtccttcacttcaaccactcttgggatactgaagggtattgccattgcaatctgtggccaacatctacttccacatctctccctcttggggctttcaagtccaagcttggagtcatgtttgtaggagcctcaaatctctctctcaagaattttcatttgttttccccagttctcccctgtggaaccatggaaattaaaatcgaaaccctgttctatt

SEQ ID NO: 209772 - DNA, 380 bp, Homo sapiens
tttcttacagtagaataaagatgcagatatgtctcggttcacagtcaggctgtaaacattctatttaggtgttcagcaccacttcaattatactaaagatgaaattggtcagatcagaaatttaaccatcatttgtaatgttttgcttgtggttttaaatacgttattgaaaaattacaaatataagattgtttataggtgaattataggggaaaatgtaagttgatttaagctattttcattccaatataatactttctgctccagtgctacttcaggggaaaattaaagcattaactcttgactagtacagttgaaatataatggaatctgaggaagtacttaatatgtaacatggattaacagcagatctgtgtcat

SEQ ID NO: 209773 - DNA, 169 bp, Homo sapiens
ctctagaggaccccgacggcttcaacggaactttacatgaaaacagatgttagattctttatgagataaaaatacgctaagacttggtctcttttctcagtgtagctggaaaccaaaccactccctggcttcaaaatccacttcttacattatgaaacctttgtaagtt

SEQ ID NO: 209774 - DNA, 267 bp, Homo sapiens
cgatccagtcctagatcctgcagaccctgcattgcatttgccatgtctctttattcttctataatctagaaacattcttcagcgttttttttctttcattacatgaagagtcaagaccagtggttttgtggaatgcatgataatctgggttcttaaaaatcatttcttcttgattagatttcccattgtcttgaattgactcagtcagcctttcctcaccgctactccaggttcactaatgatctccctgttgcccaaccaatggtt

SEQ ID NO: 209775 - DNA, 351 bp, Homo sapiens
tctcttcattctttactttttttcttaatgagttcaaaaatgcttgagaattcatttgtatttcatattttaaccttcaaagctggaaactattttgagaaggggcaacaatttttaaaaaccagggggcaattagaaaaaatgtttaaagggaggggattaccatttttagcttatactcctactctataataaaggcggcggggggtggggtgtaaggaaaatgatctaatctacttgatcaagaaaagggaatgttaatagccctcagaaaatatattcatttactgaacagttatatcccttagtttattgtgaatgagaatgggggcatcttagagattgggaggg

SEQ ID NO: 209776 - DNA, 547 bp, Homo sapiens
attcagaggttccatttcttggagctcccattctacttgcagacataattattacattgatctgaagtcttatgtgaggcaaaagaaggaaatatgacttcttcttgggagtaaagcatggtactaatttttgaagaagactcttgtcctaaaccatgacttggattactaagaacaaagtcatttgctaataacattcagtgtgtgcttcccaaaatgatgcacatttaagtcacccttctgcactgagttcaagactcaggatataaaacacacattcccacaagcatacaggaagataacaaatacaagcaaaccttggtttcagatatctcaataaagcagatcacacaaaacttttggtttcctagtccatataaaagttatatttacactatactgtagtctattaagtgtgcaatagtattatgtcttaaaaaatgtatatactgggccaggcgcgatggctcacgcctgtaatcccagcactttgggaggccgaggtgggctgatcacgaggtcaggagattgagaccatcctggccaa

SEQ ID NO: 209777 - DNA, 313 bp, Homo sapiens
tggtgtaggctgttgcttttaaataaaaatttcaggaaatagtttataaactaatctcaaaagagactcatggacgctgaaaattgttagatatagaattttttagttttggatgtgttgtattaatctatttcagtcagctaaccccagagtctaaattgttataagtacagtattttcttggtgcattttgagaggtacctttttggattgcataacagataggtttatatagtatatatatgtatgttacttgtatttgaatcaggtgttggtactgaataaaaggttatatttcttaggtatatgtaaa

SEQ ID NO: 209778 - DNA, 787 bp, Homo sapiens
  misc_feature (41)..(41): n is a, c, g, or t
  misc_feature (79)..(80): n is a, c, g, or t
  misc_feature (82)..(82): n is a, c, g, or t
  misc_feature (93)..(93): n is a, c, g, or t
  misc_feature (108)..(108): n is a, c, g, or t
  misc_feature (201)..(201): n is a, c, g, or t
  misc_feature (203)..(203): n is a, c, g, or t
  misc_feature (225)..(225): n is a, c, g, or t
  misc_feature (758)..(758): n is a, c, g, or t
ggagacgacgagcgggcgaggatgagcggcggcggcggacngagagcgaagtaccgggcgcgggcagagcgcggcggcnngngtgtgttccanagaacaagccttcanacatttgctatattgacgctgagctgtcaggggactcaggcttatgaggaggtatgttacacaaaacagtgtctagtgaagacgacaagaaanangggaaaggatcggaaaaagaanctaaaatactatagaaaaccatagagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggncgaattggagaagaaggatggagaaaatg

SEQ ID NO: 209779 - DNA, 435 bp, Homo sapiens
cgagggtgacgtctttgttttttgtgtgtttcgttttgagactgtctcaaaaaaacaaaaaaacaaaaaaaaaaacaaagaaaaaaatgtagttttgtgttagcatgctgaaactcagttttccctactgcttccctgctatctcctatcagtttaaagtaccttttaaagactcgagaaaaataaattttttttttttagttattgagctgtgcatgggttttaaatgctggggaaaaaaaaatttctctcgattagagcaaaactgatttctgttaggaaaaggagaaacctactgtttttcaaaaaattacagcgtttctgaacagactttctcgagtcatgtcatttcaagtggttctgtttcagctgatgtgcctctgggctgatgtcagaaacaaggaaattgaccacagagagaagcagtcaggacgc

SEQ ID NO: 209780 - DNA, 979 bp, Homo sapiens
gctgggtatgatggctcatgcctgtaatcctaacactttgggaggccgaagcaggaggattacttgagcccaggtgtttgagaccagcctaggtaacataaggagatcctgtctctattttctttaaataataacatttttaaagttaaagttaaaaaaaatttttttaaagatttggggaggcaaacagttaatgccaaataaatgcgtgctcaataaactgttaccacaatggtgattaggtcttggggccaaaagcagaaaagaggaagttttacatgtggttaggaaccctcagatgtgggtttttaaagaaaaaaatggggctgggcgtggtggctcacgcctgtaatctcagcactttgggaggccgaggcgggcggatcacgatcaggagatcgagaccatcctggctaacacagtgaaaccccgtctctactaaaaatacaaaaattagccaggcgtggtggcgggcgcctgtagtcccagctactggggaggctgaggcaggagaatggcgtgaacccgggaggtggagcttgcagtgagccgagatggtgccactgcactccagcctgggcgacagagtgagactgtctcaaaaaaacaaaaaaaaaaacaaagaaaaaaatgtagttttgtgttagcatgctgaaactcagttttccctactgcttccctgctatctcctatcagtttaaagtaccttttaaagactcgagaaaaataaattttttttttttagttattgagctgtgcatgggttttaaatgctggggaaaaaaaaatttctctcgattagagcaaaactgatttctgttaggaaaaggagaaacctactgtttttcaaaaaattacagcgtttctgaacagactttctcgagtcatgtcatttcaagtggttctgtttcagctgatgtgcctctgggctgatgtcagaaacaaggaaattgaccacagagagaagcagtcaggacgc

SEQ ID NO: 209781 - DNA, 806 bp, Homo sapiens
gttggctctgagttgagcacgggccctcagtgacagggtgagaggtgggctagcctgggcactgaagccagacttctttattaatgagttgtatgtagtcttgggcaagttactgaacctcccttatcctcaactttctcatcaataaagcggggaagatgcagtaatggctactattggttgagtgataactgtgtaccagacactgtacctaatgcttttcttggaatgtcccattttacagatgaggaaactgagctaagacatcatctcctaaggttaggtggtaattgaatgagataacatgtaaagctctcaatagagtgcctgggtcacatgaaccgctccaccaatcttagccgttagtgtcatcaatgagaggaggctggatccaaattgaaaggccaggagcatcatgcagagtctgggcttcagcctataggcagtgagagccctggaagattttgccaagtgaatgctcaggtgggaccttgtttaagaaacttggccgggcacagtggctcacacctgtaatcccagcactttgggaggccgaggcgggtggatcacctgaggtcaggagttcgagaccaacctggccaacatagtgaaaccccatctgtactaaaaatacaaaattagcggggcatgatagtgcacgcctgtaatcccagctacttgggaggctgaggcaggagaattgcttgaacccgggaggcagaggttgcagtgagacaagattgcaccactgcactccagcctgggcgacaggtgagattccatctcagaaaaaaaaaaaaaagaaa

SEQ ID NO: 209782 - DNA, 385 bp, Homo sapiens
tgggaacacttcgagatgtgcttcaacactgcttgctacatgatgcatggtgatcttcctcctacaaaatgcttgaagacagtagttattttatgtgcattctggggaagaggctgggttttatctttgagttgggaggctttagaagagacaatatgaattgaaagatgaactcaagtcagaggtaccataagaacattgttacattccagaaattcacaaataaatctggtagactgtggacttcctcagtctgtggaaaattgagatgaggcaattgaatagaggtctcagtggactagaagccctcagtggataccaggttccactgtgtgggttttttgtaatagaattggtttagtaacaaaatattcttttttagaaa

SEQ ID NO: 209783 - DNA, 160 bp, Homo sapiens
atcacgccactgcattccagcctggaagacagagcaagaccctgtcttggaaaacaaaacaaaacaaaaaaaggttgaaacacagcttagaatctgctcaattactttttgaatttcaaagagatctgtccctgtcataaagacctgcgaggccaggcgc

SEQ ID NO: 209784 - DNA, 448 bp, Homo sapiens
ctgagtcacaaaatggaacagctggaactgagtcttcaaaaagctgttcaagagttctgaagaccagctgcttctggatgatggaatgtacagtaagaccagaacgtagatggagctggtggccattattcttagtaaactcatgcaggaacagaaaaccaaatactgcacgttcccagcttacagggaccaggtggagataattgaatcatgggggcagtttcctacatgctgttcttgtgatggcatattctcagtttgggtgtggtggcgtgtacctgtggccctggctactcagaaggctgaggaaggaggatcccttgagcctgagagtttgaaggtatagtgaactatgaacatgccattgcactccaacctgagcaacagagaaagatgctgtctctaaaaaaaatgataaatgaaaaataaaaataataggccacgttta

SEQ ID NO: 209785 - DNA, 750 bp, Homo sapiens
ggattgcttgagcctaagagttcaaggttgcagtgagctatgattgtgccactgcacttcggcctgagcaacagagcaaggctctgtcgtaaaaaacaaaaaacccactttgagtttgctttcttctttcttcctaagcctttggagcttatcttcagcattatatcaagacatttattcaacccagcaatcccattactgggtagatacccagaagaatataaatcattctaccataaagatacatacacacaaatgttcactgcaacactgttcacaatagcaaagacacggaatcaacctaaatgcccatcagtgacagactggataaagaaaatgtggtacatatacaccatggaatactatgtggccatgaaaaagaacgagatcatgtcttttgcaggaacgtagatggagctggtggccattattcttagtaaactcatgcaggaacagaaaaccaaatactgcacgttcccagcttacagggaccaggtggagataattgaatcatgggggcagtttcctacatgctgttcttgtgatggcatattctcagtttgggtgtggtggcgtgtacctgtggccctggctactcagaaggctgaggaaggaggatcccttgagcctgagagtttgaaggtatagtgaactatgaacatgccattgcactccaacctgagcaacagagaaagatgctgtctctaaaaaaaatgataaatgaaaaataaaaataataggccacgttta

SEQ ID NO: 209786 - DNA, 721 bp, Homo sapiens
gacccttagacttgagagcagacaggcagaatgaccatgtcttctgtgtatagtacaccatcacagtgcacatggaaatgacatgctggtgtatagttcctatttctccctcatatttcagaggcggaagcccctcccagaagtttcctctgagttccccaaagctggattcagtgttcctatagcccttcgattcccctgattgtgacatttaccagcctgacttggattcgtctgtttcttttccaatatttctcacctgaccttcctgaggacagagagtgggggtgagtccctgccgcatggccagcacctggcaaggtcatggcaggaaggaggtgttcccgatgtgtgtgtggaatgaaggaaggcacaaacgggtccgtgtgaggaagggacagacctgccagggaaactgaggtatagagtttgatgagtacccccaaatcatctgcttaaaagcaggtataaaatgtaaggtcctctggtgcctaaagcacactcatcctgtgtacacgtgactattaataatatatagcattgataattctgtgaatctagtcagagtacatgaacattgtgtcttctggttggtcttaaagttatgtcccttcaccctagtccaattccatctattaatataaagagcttgcagatataaggaatagcttcaccaatatcactcctgagatcctgggcgatgctgctcttgttgggactg

SEQ ID NO: 209787 - DNA, 127 bp, Homo sapiens
gaaacaaagattgacaaaactgattactctgccagggactatttttggtgctataccaaactaaaggtttcattcttgacctttttcctgagaatgcataatttatactattaaaatggtacacgtt

SEQ ID NO: 209788 - DNA, 204 bp, Homo sapiens
aaaactaacatttcccagacttgtgtggcccaacatttaaaaataagagttggggagttcctgaccatcctggccaacatggcaaaaccccgtctctactaaaaatacaaaaattagcctggcgtggtggcacacgcgtgtagtcccagctactcgggaggccaaggttgttggatcacaaggtcaagagatccagaccatcct

SEQ ID NO: 209789 - DNA, 168 bp, Homo sapiens
acacctggcctatagaaactatttgtgaatcatgtatctcttaagggtctagcatccacaatatataaagaactattacacagaaaaagccagtccaattaaaactgggcaaatgacttgaaaaacttttctccaaagaagatggagtggccagcaaacacaagaaaa

SEQ ID NO: 209790 - DNA, 427 bp, Homo sapiens
tgctggtaagatttctgaaatgactgtagccattgtcccaggtcaggatgtaggcacacacaaaatagatattaatgaatgagtaaggttgacagcacagttcaggatagggagctggataagctggtagaaggaaggagaaatcagaaagctggaaactgagactggccttttctgctcttctgggatgtttatgactcatttctaggttttaatatgccctgtttacatccatgcctctggcaactaatcttggggtcaagctttactttgtttccattccattccatcacttgatcctaattccccatggcttctgcctttccctctttgataatgtcatctattggagtgatgcccaaagaccacgccacagactggtgccaggctgactgtcatataataaaaaataaatatttgttcttta

SEQ ID NO: 209791 - DNA, 474 bp, Homo sapiens
tgtcttcaggaaaggaaagctgccgcatcatgtcaagaagctgatcaatcaagaagcaaggagatcctggcaccttgactaactacagacccatgctgccgactctgcctggatccccagagccaccactgctacttcagaaagctggagaatcaagaagctgctgactctagaaccatgatactcttgtcactgtctgtaaaaccagaacaatgcttatatcctctcttttgcaccactgactcagttccaagtcagagtctctcatgagtgcatctgacttgtggaatctaaatcacgtccagaactctactacaaaggagttgagaacatttaagttttagctttccaacttttgcacagtggaaggggactgaagtgggtattgagcaagtcattccacagtatctgccacagacagtatttttctccaatcataacaaaaataaatgagacatattgatggaaagttgg

SEQ ID NO: 209792 - DNA, 167 bp, Homo sapiens
cctgggggacagagcaagactccgtctggggaaaaaaaaagaatgagacccatttaaaaatgtaatttgtttttgctgatttaaaatgtttgatcacagtggttttcctgagttaaatagatggaatagctattacattttatgtatattcagatatctttacctct

SEQ ID NO: 209793 - DNA, 146 bp, Homo sapiens
ggatcaagtacagatacataccaaatagcatgtttggggctcatattgcagattgaatgctaagtacagatggttgtacaggaatctaaataatgtagtaaacttcttcactgctattaaacctttgaaggtttattctgggatga

SEQ ID NO: 209794 - DNA, 164 bp, Homo sapiens
ccctggtttcactgcccccactcccaccccaagaaatcttcaacactgaaggaggctaatggctaagaattcaaaagccatagaattctaaaactggaagttacgttgaagctcaatagttttccatttgttttgttttccattcattttctccacgagttatc

SEQ ID NO: 209795 - DNA, 368 bp, Homo sapiens
ttcaaaatgatgtttaaatccaaaaaaccccccagataactgcaagttaattttctttgcaaatgttaaccattttcccttaattaaatcacacgaaatagtataaaattagaagtctactgccaggtcaccacttaaggacacttaagacaggagatatatccttaattatacatctgtaaacaagccagataccccaaaccttcaatttttcgggatagttatctgtgaggaagcttgatctctatgatctcacctgaattttatgtactaaaatacaggtcactatgaaataacgctaaagtactctgtccatcccacagacaatttatttttcaaatgtttctataagtgcatatatagcgttg

SEQ ID NO: 209796 - DNA, 354 bp, Homo sapiens
catggacatcaaaattaaaatatgatgccatttataatggctcagaaaataaaatacttcagtataaatctaacaaaatgtgcacaacttgtatgctgaaaactgcaatgctaaaagaaataaaatctaaaagaaatagaggaaataaaaacaatctaaataaatggagaagctaacatatcatgacttggaagactcaaaatagtagagatttcaattctccctgaattgatatccaggttgtaatgagttgagtttggcccctcaaaagatgtgtttacagcttgcagcgagccgagattgcgccactgcagtccgcagtccggcctgggcgacagagcgagactccgtctc

SEQ ID NO: 209797 - DNA, 393 bp, Homo sapiens
actttatttaatggggtgaaggagtatattttctgattttctttttatgactataaggcagatctgacaccattagttttctttctgtcataaatatagatgaatgtaatttgacaggcgtcactacaaaataggttatagataagttcaggcatctctccttccacacagaccttttatactcagttctgatggagctgcttgaatagaatgaccaaggtttgattttaggcttctaggtcacagtttcaccttgacaacagttctttcatttccagcagtaacagttgctaggatccctaaggtgctttcatttttaaaaaaaaaaaaggatagaaaaaaagataaatcttaattcacatgctgcaggactatctctgtgtctccggccaa

SEQ ID NO: 209798 - DNA, 468 bp, Homo sapiens
tgcaaagaaaaaataagagttttttaaaggaaacaggattattcatgccaataaagaaggaggtacaattccaaacagaaagtcatctaagaaaacacatacatgcatacatgcttagagctggagactgaaaacattatcacaattaagtgctgtctacatggtaacattgaaaatgttcttacaaaattgcttaaaaattttttgagatatgtaaattataaagatttattttatttactatggaatatagcttttaatctctaagcccttttatactcatttgtcatcataggtaatgatatgaaaattcccacttaacagtttataaaaaataaaaaaaatcattttctttgtcagacacgtgagtcataaactttgagtcataaagtctttgtgtcaaaatataatttttggaaagctacaaatatgatgcccacaaatatagaatgatatatatgttaactt

SEQ ID NO: 209799 - DNA, 367 bp, Homo sapiens
  misc_feature (12)..(12): n is a, c, g, or t
  misc_feature (24)..(24): n is a, c, g, or t
aggatagtcagnagaattagaatngtgaagatgataagtgtagagggaaggttaatggtcgatattgctagggtggcgcttccaattaggtgcatgagtaggtggcctgcagtaatgttagcggttaggcgtacggccagggctattggttgaatgaggggaagaagaaaggagagaagaggaggggaagggaggggaagagggaggaagacagggtgaggccgcggagtcccaacagaaccagacagtgtagggctttgtaggctaccttggagggggctcaagaggaacagcaggcatagacaactctttgaggagctttgctgtagctgaaggagagcagagaaattggatgatagctgaaggt

SEQ ID NO: 209800 - DNA, 1457 bp, Homo sapiens
ctctcccaggccctgaccctcaactcccttgggacaactctcactttccactttccatccaaattgtttatgatgagaaccataataaagggctaccatgtattgagtgtcccgatggtgccaggcattgtgctaagtagttcatgatattaaatgtcattaatccttacagtaaccttcccagataggtcttagtgtccccattttagagatgaggaaaccaaaactccaacagtaaaataaattggccaaggtcacacagctagtaagtaactggtgatgaaaccatatgatttatttggaggaagggggattctagacccccataatttctatcagtgccctctccacttacaaccaggctacccccctcaaaccccaatgtagagaaattccagtgccaacatggtaggtggcagatccaggcctggctaactccaaagcactgccctattcatttatgtatatgtcttatcacccagaaaactctaagttcttgtgtccaagtcatttctatcatcttcacagtttagaaaaatgcttagcatggtcataagcattcaaaatttatgaaggtctatcatttgattcccagtataccctattgagtcttctaatcattcatccatataattgccaagtgcgattctaccctcagtcttgagaggcaatgatttgttcatttatgttgcaggtgcacttgggtaaatgactgctgtgttttatgcatccgtgatggtgaacagacactgcaaatgtgcacgtagagatcatgagtacaaaaataattatagtgcaactttcaaaacgttttaacatacagtatttcacaatggccctgtgaaacaggcgaggcatgtatacccattttcatgcattctactatctgacgccaatccttagcactgaggattttttaatgaaggagtttatattctagtaggagtgacagataataaatgtgcaaatcatcaaaatatatgttagatggagaaaattgctacagagatgaagcagaggaggagggcagatgcaccagggtgaagagctgctatcttaaacaaggtggtcaggaaaggttttcctgttagagtggcagtgagcaaagaggtaaggaggtgcttgatgtggtgatgggatgtgttccaagaggagggaacagcaagtgcaaaagcgacaaggcacaagtgtgtctgatgagttggaggagcagcagggaagtccatgtggctacagtgagtgaatgaggggaagaagaaaggagagaagaggaggggaagggaggggaagagggaggaagacagggtgaggccgcggagtcccaacagaaccagacagtgtagggctttgtaggctaccttggagggggctcaagaggaacagcaggcatagacaactctttgaggagctttgctgtagctgaaggagagcagagaaattggatgatagctgaaggt

SEQ ID NO: 209801 - DNA, 524 bp, Homo sapiens
gaccagaactggatggagacatagatggcttctctgagagagtcacaactgaactgagtgttaaaggatggacaaaagtcaatcgagcctagagagtgaagtgatcattttcaaaagaaaaacagcatggacagaaacaagtgtgtggccaaagatcagagagggatactgattccccgctaataagaaatgttagtgcagtttcaggtacacttgaaatatctatcggtatatgttttgatatctaaattataaggagccaccttagggagagtgtgtcacactttgatattcaaattaaagctttgtgctcactaattgcctttgttgactttttttgtcatcagtcggtaactgtcagcatttgtatgtcttgcagcggattggatcctgcctggatcttcattgtcaatagctttgcttaattccagggcttctccaatatcacttgtactgaccttatgtaatcttgaaaggtatacaaatcacattgcaattgatttgctcctgtttatattggatga

SEQ ID NO: 209802 - DNA, 419 bp, Homo sapiens
atttaaaatgaatttgaattataaattttctcaattagaaacttcccaaactaagttataacaataagtcaaatttgggacttatataaactttatataaacagtttagattcctttatttgcattatctcagaacatttagtttttttatggagtattaaagtggaggagtatatgttttatcaaagctgaagtttttggaaactaaagaaggttgaggatcagtcactgatgggaatgcagtgtttttgaaattcagtaaataaaaacagaagcaacattgagctactcacaaccttgtttggaatgggacatgtaagataaggtttgtagtttgttttttttcctcttcatttttatttttcctttaaatcgtaaccatagtgtctatagcttctttggatattatgtagaagaaa

SEQ ID NO: 209803 - DNA, 373 bp, Homo sapiens
tgataatgaaacaaacaaatgtgaagagaagacgcttagatgatgttggccctgaattggaaaaggctgtctgggagctcggctgcccacccagcattcagtgtctgctacctcctgtctgttatgcttgtgtctggttttttcaagttttaattttttttttaattcttagtttttgtgggtacatagtaggtgtatatatttatgggttacatgagatgttttgatacaggcatgcaatatgtaataatcacctcatggagaatggggtacccatcacatcaagcatttatcctttgtgttacaaacggtccagttagactcttttagttattattaaaatgtacaattaaattatttttgactatagtca

SEQ ID NO: 209804 - DNA, 563 bp, Homo sapiens
ctcagtttccaactctgtaaaacagggtcgttactgtagtcctctcacatgattgatgtgaatattaatagattttacacttaacatacttagcacaatgtctggtacataataaatgcaaacaaaatttttaactattggccaggcatggtggctcatgcttgtcatcccagcactttgggaggccaatgcaggcagatcacttgagcccaggagtttgatactagcctgggcaacatggcaaaaccccgtctctacaaagaatacaaaaattatccaggccttgtggcatgggcctgtgttcccatgactcaggaggctgaggtgggagaatcacttgaacccgggagaccaaggctacagtgagctgtgatcacaccactgcactccaacctgggctacagagagagaccctatctcaaaaaaaaaaaattgttaaccgttattattatattgatctgtacccataaaccttaccaaactctcttattcaaagctttatgaagatacaaagatcttcagtaaaaggaaacacataataaaatataaaaatcagaattatt

SEQ ID NO: 209805 - DNA, 530 bp, Homo sapiens
ttttccctaacatctccatgctaaaagttcccaactgtcccactcctctcaaaatgtcagtgcctccagggagtaaagttctagttgatatttgaaataaagcacataaatcataaaaataatttatgatatatagatcatttaaaaactttcagtttgcatatacattaagagctactgtctagtaagagcttagtacgtctttggcatggggtcatgtacactgtatgtatacagatcttcatttaatccttagagtaaccctgggaggtaggtacaatcatccccattcacagaagacaaaatagacttgacaggcgaggtgaaccaacctgcccaaaggtcacaccactgggaggtagtaacgcccaatttcaagtctgaagtgtcagactccaaagctcatgctcttaacctttttgacatatgttaaagaagacgcttgttaccctaaacttgttactctgttcagtggcacttgacaaggataaataagaaaaactccaacagcaagcaagagggcaggaaag

SEQ ID NO: 209806 - DNA, 631 bp, Homo sapiens
agaggcagtgaatcgagctcggtgaccatctcgtgaccggcaatttgatcccaacttccattttaccatttacctgaattgtggtttcctgcttgtctggtttctcttttccccccatttttgttccttttagtatttccaagccacgcaccagtcttagctaaaaaccccttctctttgatactgagctttcttagtatggctactatgtgtttcatctcattattcctccttgtctatcacagtgcttggtgctaggtaaataccccattaacattttaagaaaattaatgaataagtcatggcaatttagtgggctcttttggtggattctcatagtgattgctactctaggaaattacataccatagttgtcaagagaatggactttggaatcacatggccctgggtttgagttcctgttccatctccagttttagctgtgtaatattgtgaaaattgttgcatgtctatgaatatgtttcctcatatgtaaaattatgacagtaagagcatctaccctacaagctttttttgtttaagacaagtgcagtagtgacaagaggggaaacagtagaacaaggagttcaatatgtaactgtgaataatcaattgagataacttggtacct

SEQ ID NO: 209807 - DNA, 822 bp, Homo sapiens
acacatgaagaaatagaacatcttaatagttctgtaactcttaagaatttgagcctgtagtttaaaatcttctcaaagagacaactcctgtttgggatgacttaattggcacatcctaccaaactcctaatgaaaaggaaaatccccaattttaaacatcctcttccagagaagtaaaggaagaaagatttcacaatttgtttttaaggccagcaaaagctgcatgacaaaaccaaggaagaacatttgagaatggaaaattataggccactctcagctgtaagactcagaagatgcataagatgattataagatgcaaaaatcctacacacagtatcaggaaactgaccagtcattagcaaaaaacccaagacgataagcccaggatgatacatcatgacagagttggttatatccaggaatgcaagatccgtttaatgttacagagtcaatcggtgtaattaatttaccatggttaacaacaggaaaaaaaggatcatcccagtgcataagatgggtttgatcaaattcaatgtttcttcatttaaaaaaaaaaaaaaaaactcatagaaaactaagaataagaggggcagttcttaatctggccaaaaggaaaaaattcctatggaaaacattatacttactggaattgtaagccaccttctctttgagacagaacaaaacccaaatgactgtttctattcagtattaaacaggagatcatagctagtccaccctatgggtaaaatattcaaatcaatagtgacgttagccaaactacaggatccaaggcctgcaagtaaaaacctgttctatttcagg

SEQ ID NO: 209808 - DNA, 969 bp, Homo sapiens
tccttaatgttaaaaagaacatctctcaagctaacagccaacatccaacttcatgacttcagaaggtttctttactgtagaaaatgaacttgtatttctcaagaatgttcctaagtgcatttgtctggggagagagtccatggcttattgactgtagattactgaagcactctgtgactcaatataggttaaggtactgagtgaaacactagggcagtcctttcacaaagacaagacaagactcactgtgatcacgttcatgttatcactaacattggtccatatcttctaaccatttcaatgtcaacaaaaagaaacgggtcgttcattttagaaaggagaagacaaaattatccctgtgtctgactgacttgcttaccacctgaagagaaccaactgaaaaattagtagaaccatcaggagaacccagtaagatggcagcaactatttagaaaatctagtggaagaaagattcacattcatagtaccaacaaaagaagcttcatgaggaataaactcaacaataaacacataggctctgtatgaagatgcctataaatagtaaaagtcttgtgtaagttaagaatcagatcatgttcctgtattaaaatgttaatactataaagataacaattcccctgttgaaaattagttttaagtttaatgcaagcctaacaaaaattccaaagaaacattttgttgagaatggaacttaatgttttaaaatttcatctggaagaacatcaggtaacgaaacaggttatgaagccacagtgattaaaacatggtattggtgaaaaaacgcacagatcaatagagcagagaagagatcacaaacaaacaaaaggaggcgtgagcatttggcatatgacacaagtcatgggaaagggagaagaagtttaaacaaatatgatgtttagataattgcctaaccatttagcaaaaaataaattaaattcttgcctcacg

SEQ ID NO: 209809 - DNA, 634 bp, Homo sapiens
tcctacacctcctataatactggctttctggtgagtaaagatgccattctcatgtgtaatcaggtggcaaatggagatatgaccaaagtaaccacctgcctacactcataaccctgtacacactcttcctgtgtcgattcacattcatagtaccaacaaaagaagcttcatgaggaataaactcaacaataaacacataggctctgtatgaagatgcctataaatagtaaaagtcttgtgtaagttaagaatcagatcatgttcctgtattaaaatgttaatactataaagataacaattcccctgttgaaaattagttttaagtttaatgcaagcctaacaaaaattccaaagaaacattttgttgagaatggaacttaatgttttaaaatttcatctggaagaacatcaggtaacgaaacaggttatgaagccacagtgattaaaacatggtattggtgaaaaaacgcacagatcaatagagcagagaagagatcacaaacaaacaaaaggaggcgtgagcatttggcatatgacacaagtcatgggaaagggagaagaagtttaaacaaatatgatgtttagataattgcctaaccatttagcaaaaaataaattaaattcttgcctcacg

SEQ ID NO: 209810 - DNA, 375 bp, Homo sapiens
tagtttggatcgagcttgtacccacaagtagtggtttcatgttgctctttgttctgttttcaagtggactgatttaatttttttagtggttattttaggaaaagtattccttctttaatagatcacaaaatcttccttagttttacatcaaagctactctattttgggccatccaaatcctgactttttttgttctgtttttttccctgtatttttcccacggtccgtttatagactttgctaaacatttggcctagaaaaattccaaacaaccactacttgctgctgccagatcttttctgattgacttcaccttggtccgctattttttctttgttgttcatgttgtgctcatcacattccttcaaccattta

SEQ ID NO: 209811 - DNA, 920 bp, Homo sapiens
gtagcccgggtgcggtggctcacgcctgtaatcccagcactttgggaggctgaggctgacagatcacctgaggtcaggagtttgagaccagcctggccaacttggcgaaaccccgtctctactaaaaatacaaaaactagctgggcgtggtggccacctgcaatcccagctacccaggaggctgaggcaggagaatcgctggaacccgggaggccaaggctgcagtgagctgagatcgtgccactgcactccagcctgggtgacagagcaagactctgtctcaaataaataaataacatctgtgtttagcaactggctctcaaagttcttgacaaggagacttcgtgagcgctcagggtctggcggggtgtgggtgaggcagaaggagctgtgtggtggggtgtgtcgggggcgcctgggttgccgggcagagtccctggaggtgcagtcagtggacatgaggggcctgcaggaaaaggcggtggtgcgggcccaggccctgctgtactgtgtgtggactcaccgggtccttggggggcatccgggcagccggcttccccgtgactcacaggctggctacgccaacgccaggatgtttccctggagcccctccccgctctcctcacagagccaggtcagtgcgggggtgcagacggcttctaccaggaagccgtgggtctgcgtgggtgaagcctccaaggacacttctctgtttcagggttgcctgggaacaagctctccggctcccagtgagaccctgatgtggtgcggcctgggttgcagcgcaggctcctcttctggttccagcagccgccagaggccccagtgacgccacaggccacacgctgaccagcagcctcgtcactcactcatttttccaacaagtctttgccaagaggcagccgggtgcccacctggca

SEQ ID NO: 209812 - DNA, 791 bp, Homo sapiens
ttgtgttaacagcttagcagatggagaaacagaaggagtagcctcagcttacctgaatgatttttttccagcaccaggcacattgacttgctgtctctagtaacttgataggagttggagcaattggaaaatgggaaatgatatatgacttctgcagtgttatttactaaaacaattggcatttctttgttatcattatatcttctttcccagtctcgtaccaggagaaagcagaattatagcagcctatctggtttgggctataatgaaaataaaataaacaataatactaatattgctttgggcatagattagcatgttcataatggttccaggacagtagcggtgatttagcagcagcagtggctttttgaaacacaaattgtgagagtctgtggcaccattttttttgtaatagcattgttctttttacacaggaaaagtgatttttttttttttaattctgaagggactttttactgaggcacagtcctagagagagcaaagcaaggctttgaagcaaggagggaggacagttaatggtgtgaatacccttatactagctatattttattcacttgcagctttaaataaactggatgtgctcaggtctgctagcagattatttaaagatattgatcagctcactacgttttctttggttaaaagaggaaaacttgtgaatgaagcctgtgagttcctagttagagtctgtgtggttttccctttggagataagagcaagaagcgagagatgaccatctgaaataaaaataatggggtgtggatata

SEQ ID NO: 209813 - DNA, 269 bp, Homo sapiens
gaatccctcaagtcctggtttacctcaataccaatttgaggagaaaaagcgaattttctgcttttgtttttgttttgcattgacttgcctttgattctgtcagaaaggatttatggaaaagaggaatcttattttaatcttctatactatgttatatatatatatttttaatttatatatagtattacattgttgtaagtttacacttataataaactatccaaaatgctaactaatttaaagattaaattattagtcccatatactgt

SEQ ID NO: 209814 - DNA, 467 bp, Homo sapiens
tcaaaatacacaattgtgtttgcaaactaccaccgttaatcccgtgctggacacttatggctccttttagtcttaatttggccaggaaacaataagaacatttcatcaggtctagtcagatgttggagacttcgcaaaataccagttcactgtgcattcctggagcctgagaaaatgctgatgtaaggtattcaagcgctagtgattcttgaactgtgctttttgctgtactctagctgatatattatgtcaggagagatgccaaactggataaaagaatgtatggtgtcatttgacagtcttcctctttgatacagcaagatgaaacaagcatataatgccacagaaagagctcttccagcattattctttctcagactgagatgcactttcaggtgaggtgttgtcttcccccacagtgctgcagcgaatattagtgcttactcagttggttcccgctgagtgat

SEQ ID NO: 209815 - DNA, 257 bp, Homo sapiens
acttctttaacacaaatgccgagattagggtttcctctgtgcaattgatgtgatattaaattggcattcctgtcattgggcactgttaaggaaattgagaaatgggtctcttatgtgaagcataatctgtgtttaagtataaacaggcaatacatttataatggcctacggaaggtgtaatttgattcataaaaaagaaaacagctggaaagggctagaaatgttaaatcaaagattcacatgtacttagatctttg

SEQ ID NO: 209816 - DNA, 186 bp, Homo sapiens
catcttacaaagctatggaaaaatatcaaaagccaggaaactgacattggtacaatactatcaagtagactacagaccttattcagatttcaccagtgcttacatccattagcttatttgaaaaaacataattgggccatagtatgaaagaagggtcagcctagcaaaaacacgcattagttacag

SEQ ID NO: 209817 - DNA, 766 bp, Homo sapiens
cgggagccagcacgagcaaagacataggtagatgttggaggaagagggccacacgttcctaagggacagaacataagtgtgcatcccaggtttctgttaatgcatagcaatctaattcagcaaacgtgaacatttacacttcataaaacttttcaaaatcttacaagttcccgtcgatttgtatgaagcttgctatcacagggatcctttgtttccctttcaagactcaaaatgtacgttttagatatttttattttgtgatgtaaaatctatttttatagttttgaactaagttggtcactttgagttcttattctaaaactaaggaggcatgaaagccgcctttattagttttgtttttgtttttgtttttgtttttgagacagagtctcactctgttgcctaggctggagtgcaatggctggatcttggctcattgcagcctctgcctcctgggatcaagcaattctaccttagccttctgagtagctaggaccacaggcatgtaccaccatgcccggctagtttttgtattttgagtagagatggggtttcacctatgttagccaggctggtctcaaactcctggcctcttgtgatccccccgccttggcctctcaaagtgctcaataaagggtaggtatgtaccgggggaagcgattaataaccctattttctaaggaatgcacaacgtcctctgggcccctaataaaaggtttcagacgataataggcaactaattaactagacgattctatgagccact

SEQ ID NO: 209818 - DNA, 310 bp, Homo sapiens
ccatgttctctgttgttcatgtatttcccatctgtagttggagggtaagctgttgtaacagctcccacctagattccagtgtctgacatattttgttctggatcctttctaacaggatgctttctaacatcaccgcctgccattctgattctgaacagtcatggcagagtatatgaaaaagtatagacccaataaatgtgctattcaggctctcctctatcatcttcatctcttcatcttcctatctcctatgctttaattgtagggaattactactccccaaatataatacaccaccgaattatctttc

SEQ ID NO: 209819 - DNA, 497 bp, Homo sapiens
aacactgctggtccatagtgagttgagtagaaaggatgtgaggatgagctgaggaaggagacaatggtgggatcagtgagaaagtcaatgggccagaaacaaaaagagctgaggtttagatgccagttttccacatgttatttgagctacaactcctccaattagctcctgaagtctgtttacccaactgttaaattgtaataaaaattctagtttgccttacccacatcagagagttgagctgaggctcccgtgagaagacatacacactcaatgtatgacgtgtgcgacagttaaacaaatatgtgaaggtaatgctattgattttgtatagtaccttgtttctggaaagagattatgtgagcagttagaaactcctaaagcttaacccactttaattaatctgtaaaaacctaacagcatactgcagtgtgtacacagcaagagctcagctatatagattgcacagaagaaaaaaaagatagaagaaaaaaaaa

SEQ ID NO: 209820 - DNA, 264 bp, Homo sapiens
gggtggtcaggaaggccagcctgaagaatctggagtgtatcctctgtggcttttatggaaaaggtgatgtcaccagagttgtgggtcaagaactgtgtaagcagtgcacagaacatgttagaaataggagtaatggaggtgaaaaatcaattaaaatcattgcaacagtgaccagctgaaaagcaacaaaatgtctgaaccagcacgctgtctgacagcaagaatggggaggggacacacaggagtcgatgaagaggcatggcc

SEQ ID NO: 209821 - DNA, 952 bp, Homo sapiens
ctttctgattttagtaaatctgatggttataaaattgtctcattttaatatgcatttctttgattagtgtagaggttctgcagctcttcatatgctcactgcctattgtatacttgttaagggagtcattcaaatggaaataggtgaagttttgggaaaagaataatctaaagaaggcaaatccaaagagaagaaaacagaggactgagcacaaaatcttagagcacattcaaagagcagggaattggaagtgggagaagaatgagccagtggacaccaaaaaaaaagtagtcagataaataggagaaaacttagggcagtgcaatgccaccaaagccaagggagacacatgttccaaggaaggtgtgtggaaaggttgcttaacaaatgacgaaagttgagaagacaaaggaaaatgaggatgattaaagaataaaagtaaatatttttcccacatttggcttccttctgtagatataaaaaatacatatttatttgtttagaagttgtggcaaatgttaatgccgtgactgcaaagtgtatccctaacttacataaatgcacatcggtgtgtggattcattcattttaaataaatactgagtaaataaaaatatttttacagcaaagttgcaggatacaaaatcaacaccaaaacaagttgtatttgtatatcctaaagatgaaaaatccaaaaagaaaaataaggaaacagtttcattacagtggcatcacaaagaataaaataggaataaatttaaccaaggaggcaaaaaaaaaaaaattctacattgaaaactgcaaaacattgcagaagaaattttaagacttaaatggaaagatatactgtcttcatggattggaagacttgctattgttaagataacaatatttatcaaagccatctacagattcaaatcaatctctatcacaatcccaacagtagtctttgc

SEQ ID NO: 209822 - DNA, 252 bp, Homo sapiens
tcaccaaatctctttggtctttgttgctgttgctgccatcagtccttttggtcatgtgggactcttgaaactgtgctctccgtaaagagatagatgctgcttatcctttctgatggtctagtcctgctggcccaattccccagccagaactctgcaagcttttgaggcaagatgattctactgcctatgagctaagccaagtcaaggggactttgtctggaataacgggttagtagaactcagtgctcagct

SEQ ID NO: 209823 - DNA, 538 bp, Homo sapiens
gaagctccaggggagaattcgttttcttatgttttccagcttctagaggccaccaacattccttggcttaaggcccacttcctctatctagtaagcaatgtggcatctctctgaccattcttctgcggtcacatctccctctgactttaaactcagccaggaaaggttcactgactttaaggacccatgtcattatattagtccaacaagataatcgcccccatttcaaggttcttaactttatcccctttgcaaagtcctttttgccatataaagtagcatcgtcctagtttccagggattaggaagtaaacattggttgcagggccatcattctgcctaccttgaccccccttctatcttaagcttccttctttctgagagatactcagtgaaggaaataatgtatacagtggtccatttccaagacaaaatgccttgaattggcttaggtaagcaaactacagaagaaacaggatatactaggcccctgcttggatagatgatgcctgcttgtcagcctcccgctttctcccttt

SEQ ID NO: 209824 - DNA, 145 bp, Homo sapiens
gctgctaacatcagaaaaagagagataaccaaatattcagtgcctctgatgaagacagatgccccacagtgtgacatattctagctgaaataaaatagagctgaccaagcagggagagttgcattatccaatagaactttttgtg

SEQ ID NO: 209825 - DNA, 604 bp, Homo sapiens
cagtagagagaaacatttaataaaccagtgaccagtcttgtctcctctgtatccccactttcctcctccaaccagattattttcaagaaaatctcaatcatatcatttcataccctgccacttttataaactagcaagttttgaattaggaagcatgtttgttattgaaaaatattttcttgtcatgatggatcattgtaaataaaccacttgtttagtgttcagtgtcttgatatcgctgagccagaaatttaaagtagattgataactgtcctgaatatgagacaggtaggcattgagatggaactcagctgagtgctgatccattgtagtatgttaaaagcttaatgaattgaattaaatgaagtagaatttactaaggcaggcaccttggcttctaggcacccagcatagttctgagatggtggaagaacattttggcttttaaaaaactgaactttgctgggaagtctacccttgccaagatctcgttgcacagttctgagttctctcagaactgcacagcttacagaacacaaattaaaggctttttttttctttcccagcaagagattatgttttacctaaaccaaattatttaaag

SEQ ID NO: 209826 - DNA, 776 bp, Homo sapiens
caaaagaagattatagtactgttctttccttttgaacattggctcaattcccattctttaattaatctgcaagaggctgacactattgtctttcctaattttcttgttttggaattgcctaatggatttcctctcttatctctgtactcacatcccattgttcctactatgttattgcatataatttatacaaattctaattgcatgtaatttattcaaattcttagttttcctgcctttatttcaattccttaatactaaactttatgcttacctcactcctaggttctttcttcataatgctaatctacagatattaagagttacacacacacacacacacacacacagagaggcagacagagagagaacagagagaggtcagaaatgtgtatatcacattttagtcaagaacttaaatttttatcagaaatggttcagagattacaaggtaaaaaatcatttaactaagttgtaaatgtgtcttgaagcatgttatcagccaaagcaatggggtgcgacattataatgatggtacactgaagtaagaaattgttcatgaatgcattttccctaggccttctgtgatactatatggatttcattgtttagaaagaggcttttaaaaactgttgtgtttttgattaggcaacttaaaactaagagctcatttgtgccttggataggagctttgttaaataaaaaccagttcgtattaactttatgataaatgaacctcaacaatattatatcaaggcatgtaagcataactacaa

SEQ ID NO: 209827 - DNA, 216 bp, Homo sapiens
ggcaaaaccccctcccccacatgaagcacattccactcccctactccagtgggggtgtgcaggcatgcccttctgctgccaataaataactcatggtggctgcgtaaacccagaggcaaagtactagtgagtgtagacatgcaatttgacttgttgctatctgggggaaagaccaggaaggagtggcatcccctggaggtcaggaggagggggttt

SEQ ID NO: 209828 - DNA, 350 bp, Homo sapiens
actcgcacagaatactatcagattgcatcccagggcagtcacactagttgacacttacaccaatagtgcattaagttagcttctcccacattctgtaaactgatatcttcatagtttcaatttttatttctctttatcactaggaatgttgggcatctcttcaattacatattaactgttcatcttacaccttctttgagttgtctgttaatatcatttgttcatttgtcttttgaatctcatgcctttttcctcttgattttcagagttccttttacagttgatattgtaatccttagccctttgagaagatgcagtgtcttttgcaagtcctttcccctttgagtagt

SEQ ID NO: 209829 - DNA, 565 bp, Homo sapiens
ctgtcatgagacgaccttagaactgtgactgtaaaaccaggtaagatatggaagacatgcaaaatccaggtgggttttattttaaaatagttaaacatttaaaatacttaaaaattgtggcctgccaaacaaaaagaataaaagaacacaggacagaatcaagtaacagattaaataaaataagtcagccaaacatcctgggtgtggggctgaaggcccatcacacaggaggattcagtgatggggaacttgagtccacaggtggcaggcttggagaacagctcactgggaaggcaagacctagagtcactactggcagaggtaatacaactaggctcaacttatcccaatttcatgagaaaaatcacccagacatctatagctctagaccccacatgttttcacaagattcaatctcagttatctgagaacatgaccccaaattggctttaaaagagtaacctctagccaggcgtagtggtgggcacttgtaatcccagctacttgggaggccgaggcaggagaatcacttgaacctgggaggtggaggttctagtgagccaag

SEQ ID NO: 209830 - DNA, 572 bp, Homo sapiens
gggagaactggagtgagccgctgtctgtcagactgccttggcctgctttggtcactctgccacttctaggagtgatgcagttcaagggcagccctggttttccagactaagccagaggctctgcagtccttgagcaaaactggaggtgggaatgttctatgcctgagctgtgggctcctcaccctcttcactttggtagtaactgtgccaccttgggccacagtccaccagagaggaagtgtccaggttcaggttatatccttaagattccagctggtgatccagaacagagttaactgactggcgtggtcttgggagataggctgggtttgggggaagagcatgagctcagagttggtgcacataggtcggctcaagctctgaggctatgggcaggttggcctccctgcacctcagctgccacatctgcaaaatggaaataatgatctgtctaaggttcctactaggccctcaactaagtgttggccccagtccctcctttatgaaaacagcttctttcataaatcccaagaacaaaataattaccattttgtatttctataaatattgtg

SEQ ID NO: 209831 - DNA, 504 bp, Homo sapiens
atcatgaggtcaagagatcaagaccatcctggccaacatggtgaaacccgtctctactgaaaacataaaaattagccaggtgtggtcgtgggcacctgtaatcccagctactcaggaggctgagacaggagaatcgcttgaacccgggaggcagaggttgcagtgagctgagatcatgccactgcactccagcctgggtgacagagcgagactctgtctcaaaaaaaaaaatcagtgcatcttttccatctcaagaggctttgaatgggaatccctgggcagcttttagagaggtataaagaatctgctgtgccaggaaaagatgagaagacttctttcttgcaatatttcaggaacttcatggtatcggtcagttcactgtcagcagaggcctaagaaaataaactggccgggctcagtggctcacgcctgtaataccagcactttgggaggccgaggcgggtggatcacaaggtcaggagtttgagaccagtctggccaaca

SEQ ID NO: 209832 - DNA, 201 bp, Homo sapiens
tacagatgtgagccatcacacttggctgtggatttctgcttcagtttctgtcctaagaacttagatttttcatttctttttcaccttaaaattattttttaacatatactggtttcatgaccttttatttatttttttcttttatatttaaagaagcttagcagaggctgggtacggtggctcacacctgtaatcccagca

SEQ ID NO: 209833 - DNA, 293 bp, Homo sapiens
atagaaaagaaacttggagtgaagaaagaaaacccaggatttcgtccagttcaaactcttccttatgaattagttattcaaactcatattgttgatatttcttaatattgtggtaacgaacattttttgccacgttacaccaaatgttgagggtatgaagttttttgtacttaatttgtgcttacttctttagtgtgtaactagaggaattttccataccagtagctgaactcttgaaaatatttaaagtacaacttaaaaaaaaaccaataaacctgtttctttccactcaa

SEQ ID NO: 209834 - DNA, 773 bp, Homo sapiens
aaaaatacaaaaaaaaaaattagctgggcatggttacaggcgcctgtactcccagctacaggtaggagggaggtaggagaatggcatgaacccaaggaggtggagcttgcagtgaaccgaaatggcgccactgcactccagcctgggtgacatagtgagactccgcctccaaaaaaaaaaaaaaagacacaattgacaagaaaatttgcttatttctgtggcatataacaatttaacacaataatcatatgaatcataacataggccaagacatatcataattttaggaatctcatacaattttggagcacatattaataacacatttctgcaaatgtaactcaaagttaaatgccacttctatttgacagtgttttccatatgatttttatataccaaaattaaaagttagtttcaggtcaaaaagacttaattttagaatataaaatttgattttgagaagtttgtcaactattaaaggcttaaaacacttgataggaaaataagaaaggtttcaaaccctggatcaaaatagaattacacataagtaatccttatcttacacaaataagttactcatttagccaaagtgataattcaaagatttcaaaaagcaaaaacccttactctttgatagagaggagactcagttctctaaacagtcaaaaagacaaagacagcatgaggcaaactctcttttttcttttgcaatgtatttaaaaggtgaacaaaaaatcttgcatttgttatctctttttttttttttttttttg

SEQ ID NO: 209835 - DNA, 134 bp, Homo sapiens
taaatgaattcagcaaagtttcaggatatgaaattaatgcacacaaatctataaaccactatataccttgctatacaccagcagcgaccaagctgagaagcaaatcaagaactcaaccccttaacaatagctgc

SEQ ID NO: 209836 - DNA, 117 bp, Homo sapiens
atgctagtggtgcagagatgccctgtgatatatcaagacaagtatgagtttcttcctgggctcaactctgccttgtgctacatgctgggtgtgtgaccttgggcagtttacttgttt

SEQ ID NO: 209837 - DNA, 395 bp, Homo sapiens
gaggtagtaaagatgctgaattgttttttgcattttatatttcacatgacctgggactcttctggctaatttggagatgtatgagggaagcatgctcggtaaagatgttggttaaaaagaagaccgtcttttttctgcatataaagttaatacatagtcataattgaaaagaaaattagagaacagaaaaagcaaaaggggaaaaattagctttatttcagtatccagagaaaattgatttatttcctttttgtctttttttcttatagttccgtttgcaaagctggtaacttaatgttagttcatttatgtcctgttttttgtttcacttaatcttctaccattaacattttctcctgttattaacttggcttaaaatagttgcatgctcttaa

SEQ ID NO: 209838 - DNA, 557 bp, Homo sapiens
tgaaacctggaatgaggaaaatctagtctatatgattattgagtaaaaagaaatcctactgacagcccgagatggtgagcaggaggtgatgggcaattagccttcctgcacctttaatcagtctttgcttgagtgagtcgcgccgtcagctcagtggcatgactcactcgccttactcagactcaggtcgctgaattgtacagagaagagaatcaggctcaactgacagcactcagcattgcgtcacctgtgccgtggaatactatgtagctttttaaaagaatgaggtaaatcaatataaattcagatgaaaagatagctatagtatatattaagtgaaaaaggaacttgtaaaatttacatatatttcattttatataaaatatatagtttgcgtattttttgaattatgtatgctaaactcttaaagtaaataaaatatctttggggtggaatgatggataacttttactttctccattttgtgttttaaagttgtttgaaattttactgttaagatttttttataattaaaatttttttctgtttagataact

SEQ ID NO: 209839 - DNA, 487 bp, Homo sapiens
tccttgtagcaataacatgctaaattccaacctgactctagcatagcatcacatgacagataacaggccctgaaagaaatcaaagtattttactccaagatatatttctttgtatattttgaaatgaccctgcaaagctgtctcttatgagcaaaacctagaatatatagaatctccttcccttttcaggtcttttcctgatcccggagagaattaactaggagtccggtacctttttaagtctgataaaagacatttacatctattttctctgaagcttgttacctagaggcttcacctacataataaaaaccttggtcttcacaacccctcattttagacactccacagcccctcattttagaccaggtctttagaaaataactctttcaaccaatttctttttttatttatttttatttttgtagagacagggttttgccatgttgcccaggctggtcttgaactcctgggcttaagcaatact

SEQ ID NO: 209840 - DNA, 556 bp, Homo sapiens
atgatcggtccctatttcctccctaacatcacctcctcccattccctagcccctctccagctatactgaactacttactattctggcagtttcccaccatagtgctagctgttttacaccccggtgtctatagagctcttagaaggcaatatacaaaaacccattaaacaaggctgtttatggtgatacatattaaaccttttttttgaaaccaaacatttatttcgcatttgatttcattggttcaaatgtttaaaagctggagtaaatccacctgtctttcttctgggctcttcctccaatgtgtgttaatctggccaagtatggcatatgctgttgctgaatcctggtcctctaaggcctaagaggctcatccccaggcagggcccggagtcaaagcaaatgcagaaggcggccacaggtacagtctcagtagcatcagacattgtttgggctgattcctgagtatctatcctgtccctcaggacagccagggtttggcactctaagtagctactggctcacgatcataagatcactgcaagaacaccaaccc

SEQ ID NO: 209841 - DNA, 1001 bp, Homo sapiens
tgtgcactgcgttatctccacttcagctctgttttcaaaatatttcacagcaagtcgcggccgcgtcgacggtgaaaggcagtgacaggagtgacgtttatagtcatgctgcttcaaaaaaccctaccataacttttattctgcaccatggaaacacactcggacagatttgcataacgtaaccttaaggctcagggaatccgaaagagtcccttaatatttaatagaatgagattatggtatttctaaaaccctgaacaattcaaaagccaccagtgtgaagataggaaggttatttggagatatctgtgcctgctaaacacaaatgcatcggcccacagaattgccttctctgctgttaaaatgcttggcaaatggaactcctagctgagggggtaacaacaaaaaattcagaaatcgtttagcggtggcagtatgtgcgaaaatggaatttcaaggcctgggaagttaatagattcagtggtctttatttcacacacgagggaaagttggggagagaaagggcctccatggggatgccagtagataaataaaaattacaaaaaaaaaaataataaagatagattgtactggccgggcgcggtgagctcatgcctgtggtccagcactttgggagactgaggcgggcggatctcgaggtcaggagttcgaaaccagcctcaccaacatggtgaaaccccatctctactaaaaatacaatagttggccgggcgtggtggtgcgcgtctgtaatcccagctattcaggaggctgaggcaggagaatcgcttgagcccgggaggcagaggttgcagtgagctgagatcgtgccatcgcactccagtctgggcgacagagagagtctccgtttcagaaagaaaagatatattgtacctaggaagcagtatttcggaaaggtggtgccatggcaaccctggggcgtgaaggtgtcgccaggttacatgtaagccgtccaaactccagaaacctttcgtcccccg

SEQ ID NO: 209842 - DNA, 1720 bp, Homo sapiens
  misc_feature (84)..(84): n is a, c, g, or t
  misc_feature (87)..(87): n is a, c, g, or t
cgcccggccgggtgtgcggagagcgagggagcgcgctccctcccgacgcgcgggccgcagcggccaagcccgagggtgcgtggngcncccgcccgcccggcccggcccggccatggcccccgcccggggccgcctgccccctgcgctctgggtcgtcacggccgcggcggcggcggccacctgcgtgtccgcggcgcgcggcgaagtgaatttgctggacacgtcgaccatccacggggactggggctggctcacgtatccggctcatgggtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtggcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcaggtaggcggagaaactccgtcccgcagcgtcctggtcccccagcttcccctgccccagacccatccagggatcagagctctgccggggacgtgctgtgggcctttaggcaagtgcctctctggccctgcgctcctcaccaggacccagagctggaggctcttcattgcctttagaaaagtggaacacattctataagtaagagaaatcccaaaagctcagaggcaggctagtgtggccgtcgaaagcctaggttccagaactttccctctctgtgcctctgtttcctccctggt

SEQ ID NO: 209843 - DNA, 1124 bp, Homo sapiens
  misc_feature (84)..(84): n is a, c, g, or t
  misc_feature (87)..(87): n is a, c, g, or t
  misc_feature (1056)..(1056): n is a, c, g, or t
  misc_feature (1116)..(1116): n is a, c, g, or t
cgcccggccgggtgtgcggagagcgagggagcgcgctccctcccgacgcgcgggccgcagcggccaagcccgagggtgcgtggngcncccgcccgcccggcccggcccggccatggcccccgcccggggccgcctgccccctgcgctctgggtcgtcacggccgcggcggcggcggccacctgcgtgtccgcggcgcgcggcgaagtgaatttgctggacacgtcgaccatccacggggactggggctggctcacgtatccggctcatgggtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtggcctgtgagctgggcttctacaagtcagcccctggggaccagctgtgtgcccgctgccctccccacagccactccgcagctccagccgcccaagcctgccactgtgacctcagctactacgngagcctgaccgcgtctcagctgaccggcacctcggacagtaactgattcatttaatgganagtatttg

SEQ ID NO: 209844 - DNA, 875 bp, Homo sapiens
ggtctggctcccagcctcccctgagatttccctggctcaccagggggctgtgtctggtggcagagagggctttggaggaggcattgccctgaaaccctggcagagcctgggcacctaagagagaatgagcaacagggctaggaagtgtgacagggagtccacaacctcccaggatcttgggagggcagggatgaggcactgagcacggcctggaagcccacgggaagcagggacccctctgtcgagggctacacctactgctctcagcatcaagcctgcagccaggtactggcaccaactcccagtgcctggcagagccctggcatggatgctaggcacagggtgccagacacgggggtgggcagggtggggggccactgggccacacacaagcatggagaccttcacacacgcaggcagaaaaatccacccacactcataccacttattttaccccctgggggttcaggggagcaaggcagggaccaccctgtcctagaggctgccttcaccgacgtccctctggcctggctcttggggttggcgggggtgggccataagtaatgggagacctaggtgcttcctctgacaccccaccctccactgacccccacacacatacatttgtgaggcaggaagtggggttgtgcgtccccaggtttaagccctggaaggaaagggaaagacggggcagagactccaagaaccgggagcggtcgtcctgttcccccgccagcccctgtcccaggcaggttttgtggccgcgagctgctcaggggtgagcgcgccttagggtgtgtgcgccagggacctggcgcagccgaccacgtgggagtgcggcgcgtgtacgggcgcgggcggcagcggcagcggca

SEQ ID NO: 209845 - DNA, 1033 bp, Homo sapiens
  misc_feature (26)..(26): n is a, c, g, or t
ggctgtactggtctggaattttgggntcggctcagtaccccggttccggcgctgccgggtctcggttcgggttcgttgccccggtgccgggaccgggccggtctctccggccgccccagccgggcgcagcagccggaggtgtcgggaccctctggacccaccctagcgggccccgccggcggtcggcctccggtccgggctcccagtcgcgccgtcctcgccgccccatggagtcccagtgcgactactcgatgtacttcccggccgtgccgctgccgccgcgcgcggagctggcaggggatccgggccggtaccgggcgctgccccggcgcaaccatctgtacttgggggagactgtccgttttctgctggtgttgcgctgccggggcggtgcggggtccggcaccgggggcggcccgggcttgggctccagaggagcctgggcagaactggcaaccgccctggccgccctggcctcggtcagcgccggaggcgggatgccggggggcggcggcgccggcgaccaggattcggagcccccagggggaggggatcctgggggtgggggtttgttccgaggctgcagcccccttctcacccacggcccgggccctgctacctcagggggagcgaccacgctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgt

SEQ ID NO: 209846 - DNA, 1165 bp, Homo sapiens
gcggagcggcggcgggctgcagctagcggggtggtcgcgtgagcggtatggtgcgacgctcggtgttccccagcggagccggtctctccggccgccccagccgggcgcagcagccggaggtgtcgggaccctctggacccaccctagcgggccccgccggcggtcggcctccggtccgggctcccagtcgcgccgtcctcgccgccccatggagtcccagtgcgactactcgatgtacttcccggccgtgccgctgccgccgcgcgcggagctggcaggggatccgggccggtaccgggcgctgccccggcgcaaccatctgtacttgggggagactgtccgttttctgctggtgttgcgctgccggggcggtgcggggtccggcaccgggggcggcccgggcttgggctccagaggagcctgggcagaactggcaaccgccctggccgccctggcctcggtcagcgccggaggcgggatgccggggggcggcggcgccggcgaccaggattcggagcccccagggggaggggatcctgggggtgggggtttgttccgaggctgcagcccccttctcacccacggcccgggccctgctacctcagggggagcgaccacggtgaggagcttagggggacctggcacaggacggaggggcggataagctgggggcctgaggcaggaggcagatgaactgacggactaaaagggaaaggctgcaggctgcctctgacttgctcctgacctctacaccccttttccaaacccagctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgt

SEQ ID NO: 209847 - DNA, 1184 bp, Homo sapiens
  misc_feature (26)..(26): n is a, c, g, or t
ggctgtactggtctggaattttgggntcggctcagtaccccggttccggcgctgccgggtctcggttcgggttcgttgccccggtgccgggaccgggccggtctctccggccgccccagccgggcgcagcagccggaggtgtcgggaccctctggacccaccctagcgggccccgccggcggtcggcctccggtccgggctcccagtcgcgccgtcctcgccgccccatggagtcccagtgcgactactcgatgtacttcccggccgtgccgctgccgccgcgcgcggagctggcaggggatccgggccggtaccgggcgctgccccggcgcaaccatctgtacttgggggagactgtccgttttctgctggtgttgcgctgccggggcggtgcggggtccggcaccgggggcggcccgggcttgggctccagaggagcctgggcagaactggcaaccgccctggccgccctggcctcggtcagcgccggaggcgggatgccggggggcggcggcgccggcgaccaggattcggagcccccagggggaggggatcctgggggtgggggtttgttccgaggctgcagcccccttctcacccacggcccgggccctgctacctcagggggagcgaccacggtgaggagcttagggggacctggcacaggacggaggggcggataagctgggggcctgaggcaggaggcagatgaactgacggactaaaagggaaaggctgcaggctgcctctgacttgctcctgacctctacaccccttttccaaacccagctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgt

SEQ ID NO: 209848 - DNA, 191 bp, Homo sapiens
caccactctgacctccccagcgcctgccctctggtatgtttttctctatacatacatacctatgataaagattatttgttaggctaataataaccaataaaatagaaaaactataacaatatattataataaaagttgtgtgacgtgctctctctttttcaaaatatcctgtattcttatgatgatgatgt

SEQ ID NO: 209849 - DNA, 207 bp, Homo sapiens
gttcttttcctctgggtggtggtggcctgggctcgtggttgggtgttggtgatgtggtcacttgagaacacgatcctgttctttgggatccgttctagactttccactcttttggagcagataaaggctgtgtgtttgcccaacaaaagggcatataccttacatgaacttgaggagatggtaccttttttttttttttttgagatg

SEQ ID NO: 209850 - DNA, 690 bp, Homo sapiens
atacattagtggtataggttttcccaagagggtggggtgattccaatatcagtgaccagaggagaggcaggcctttagacacacatatggaagaagtctttaggtggggtgaactggggacttagcttctttttcttgccctggtttccaaggattctggagttggaattacttctagtaagtggggtgaaaagggctctgccacatagtagataggttagaagccaggatagagggattccccacagtaagtctgtaagtgaagaagcatttactgtgttttgtaagttatattgtctccattagtgatactctgtgtttgctgctcttctgttgttactctaagcctgtaagtaaagcattttgttgaatgttttaacctaaggattcttaatggggacacaggcctgtgttggtggaagtgagtggtacagtcatgacagaaatgctaggtgttttttcaaatcattatcctccctcacatccttgagatcttaaagcagactccccttgcctttcctttaagactcactcatgtgctaagatgggagatggatcctcagtaaaagtatgttgatgggaggctgaggcaggagaatggcgtgaacccgggaggcggagcttgcagtgagccgagatcccgccactgcactccagcctgggcgacagagcgagactccgtctcaaaaa

SEQ ID NO: 209851 - DNA, 139 bp, Homo sapiens
aaattagagaaacaaagtgtatcacaccaggttttgaactcaggataaaagaactaagaataatgtcctgcttagatttcacaattaacgttaagtacacataaaggtaaaaacaaaaccctaacaccaaacaatggaa

SEQ ID NO: 209852 - DNA, 465 bp, Homo sapiens
atggggtatgctgcgtgttgccaacaagtgacttattttatcatctacattgcaaacctagaagatgcctcttcaaaaggtgttgttcagagaacccctgatcccgcggggctggaacatggacgtgacagggatggcatccttggcatggcagagagagcagggggagcctgggtccctaacaccacggagtgcccattgcttcgtgcagaggacaccggacttgttgcagagtgaaaacatacttctagcttgtttcagctgctgcggttgggggactttgtaacctcagtgggacttgtatctgattaatatacaacctgaagtgagaacaagaaccaaagagaagtaggaaatggttaggatttttttagccccggaaggtgaatttatttctgaaaacaatcttttgtttttctttaaataaaaagcggctttttaaaataaagaaacagccaaactaaa

SEQ ID NO: 209853 - DNA, 379 bp, Homo sapiens
cgatctcggacgcctcacgacgaggcttcatatgcctcgtattttaactgagtgtagctctttgaagcaggtaccatatattttacatccttttatgtgttcacagagtttccaatatagtagacactcaaaaacttttaaagaatagtatacaacattattttgttgaggaaagattaaaatatttggaaggacttccctaaatttaggcaaagccttcacttggacccatcttccactttactgttttcctgttcaagcagtggtctgagattcagggatcagaggaactcctggtagaattccaatcattagactacatgagtggccatgaaacactttggaggcaagaccaagcctgttctgttcactgcctgca

SEQ ID NO: 209854 - DNA, 602 bp, Homo sapiens
ccactgttttttctactaaagctttattccaacttcttctaaccctttcttcccccacttttaaagatatttgggatttgtagtgttcaaattgggttaacaaacataaaaggatgttttctggacataaaggaaatttgatttacagactttttccaggatttgttaataaacaaacgctgacatcttagaataaattaagtatcaatactacacgaactgaatttaatattctttgtgtttttttcataatttaaaacaatttaacaaatttcaaaatgtttaatgaaaaagttaataaaattctcatatttttgtacattatttaatgtaaaaattactgtacttcctacattgtatttgaaagtatataatgccagacacagtcgcttaggcctgtaattccaacactttgagaatgtaacagccaatgtagtgaaaccttgtctccacaaaaaaatgcagaaattagttgagtgtgatggcatgcacctatagtcctagctactcaggaggctgagatggaaggatcccttgagcctgggagattgaggcttcagtaagctgcgattgcaccactgtgcaatctaatttaatctctt

SEQ ID NO: 209855 - DNA, 651 bp, Homo sapiens
ccacactggccggcacctttgctactgtgtgctccatctccagaatgtcctgggaatcactctgtgtgtaggtttctacaacctgtgttattcgtgtctgtttgtgtgtttgttttcgcttctctgagggaggagccaagtctcatccgtgtagctccacgtgtaataaatgtgagtcgagtgaacgaatgaaagatttccccaagccttgtagtggacgtgcttggaccatggtggtccatcagtgtggcagtggagtccctgagcattgaggattgggagacgtgtgactagagaggtagaccacacaagccatgaagcatctaggggtgactgcaaactgagtgaggcaggtcttctggtcctgtgctgctccacacagaaggtttcagggatgacttggaagcaagaaacaggtaaatgcagtgctgtgtgctaagcgttgcaacctcctgcacaaactgctctgggcgcttcaattaatttggactgtgggggttggtctgggaagactggcgttttgagttgagtcttcaagagcgtgcagttgcccaccaaatggagaagaacaaggagcatgtttcagaagcagcatgtaccacgctgtagaggtgggaattgtcattttcttgagaagttgtaatggagctt

SEQ ID NO: 209856 - DNA, 481 bp, Homo sapiens
  misc_feature (21)..(21): n is a, c, g, or t
tttgaacccgtttcgaattcnagctcggtaccccgactagtcccaaccataccttggaccatggtggtccatcagtgtggcagtggagtccctgagcattgaggattgggagacgtgtgactagagaggtagaccacacaagccatgaagcatctaggggtgactgcaaactgagtgaggcaggtcttctggtcctgtgctgctccacacagaaggtttcagggatgacttggaagcaagaaacaggtaaatgcagtgctgtgtgctaagcgttgcaacctcctgcacaaactgctctgggcgcttcaattaatttggactgtgggggttggtctgggaagactggcgttttgagttgagtcttcaagagcgtgcagttgcccaccaaatggagaagaacaaggagcatgtttcagaagcagcatgtaccacgctgtagaggtgggaattgtcattttcttgagaagttgtaatggagctt

SEQ ID NO: 209857 - DNA, 549 bp, Homo sapiens
aataccgtaaaaaagaaaaaggctgtcaaaacacaagcagtgtttgaaacgaagctttgtaggtccccctacaccaccaccgtcgtgggcagcatagcggatgagttctgggacaccagctaaaatgtgggcaagagaagccagggcgcgtagcagatgtgtgtgtgtatctttatgggattcaagtcatgtctctgttttgttgaccaacttccgctagaattcatagccatctagcctatgtattggatttttatttctgtgatgtctgcttcttttaaaaatatcagttggggccgggtgtggtggctcatgcctgtaatcacagcactttgggtgaccgaggggggtggatcacttgaggtcaggagttccagacccaacctgcaatatggccaaaccctgtctctactaaaaataccaaaattagctggacgtggtggtgtgcacctgtaatcccagctactcgggaggctgaggcaggagaatcacttgaacccgggaggcagaggttgcagtgagctgagatcgcgccactgcacttcagcc

SEQ ID NO: 209858 - DNA, 126 bp, Homo sapiens
cagacatgcactgagccaggagagcagcagtgagcacagaaggaacagcaaggtcaaaggccagtgaatcaaatgagagctggagcctatgggaaaatgcctggcacatagcagatgctcaataaa

SEQ ID NO: 209859 - DNA, 202 bp, Homo sapiens
accaagtctccatcagagagtgaaatgacgtgaaaccgcagtgtgtggtgagcagatgggcataaacttgcttacgccaatttccttcgtatacttgtgcatcctgaataagttgtccaaggttggacgttttgtatttgtaaagaatattttagattttcttattaaataagctgatttctcatttgtcaccgtttgagtc

SEQ ID NO: 209860 - DNA, 447 bp, Homo sapiens
aaatgtaaccctttctaccggaagtgaagcagatgaatgaatagacccatcagttctgcccagaatggaggtgaagaaatcaggaagctcagatctgtcccagtctcagcacttgacatgctctttgttgctgtgagcacagaagttgtttaatgctcctggttttcagctgtggaggagccacactaccagttaattgctttgcagcttatgctctgaagactcctgagaatattggacataaattgcttttgagctctctgtgtaaatacaaagcatttgtatcctaagtgtacaggagtcgtgatccatcctcaaagatgtaaacagccaatctcagtttgacagcactgttttggtcaagccagagctccctttgagaaaatcttgctgttgtctgttctggaaagaggcaggaatatgtctccaaaactccatagtagccat

SEQ ID NO: 209861 - DNA, 479 bp, Homo sapiens
cacagagcaagactgtctcaaaaaaaaaaaaaaaagaaaaaaagaaaaaagaaaagagatgaaggtcgtagaaaaaatattcattccagaaattctaccatacgactctttttccagattcaattatgtaacttaaacaaaaaactatgatcaaagtaatatatgcacataatttaaaaacaaaatagataaataagtttttaatgaaaagcaaccattccctccttccctacctctagtcttgaattacagggtcaaccatttttaaatgttctgttttcagtttttctggtgcttactgccatatctgtaagtttaatctcaaatagggctaatgaaaaacagccctgaaaaataatgaagagtcataaaatatgtaataatcattgttcacatggaatcattcttactagtttcattatgaaaatcattaaaaatattctagacaaatgccttctatgtaatgatattgttgaatt

SEQ ID NO: 209862 - DNA, 195 bp, Homo sapiens
cctggccttaatttttgtatttttagtagagacggcatttcatcacgttgcccaggctggtctcaaactcctgacctgaagtgatctgcccgccttggcctcccaaagtgttgggattacaggcatgagcctccttgaccggccagaacggtttatcttttttatgagtgaataatatcccattgtgtagatgga

SEQ ID NO: 209863 - DNA, 924 bp, Homo sapiens
ggaaagttattttcctgcacaagggattcagggtttccagaacttagctgtcaacttagactgtgctttttttgcagatgtaatgatccccgaaagccctgaggcctatgtaaaactcacagaaaatgcaatcaaaaatacctccggtaggcacaacaagccggagccagcctccctccctcccctgtatagcaatcctcctctcttagcacatctgctgtctctctcccagctttgtggctctagcatgttaaggcacagccttcctctcttactgctgtactagaaaaaacagctggttaaatccacaccaagaataagatttcactaattgagcgaaataaagtaacttctcaacttgttaaatggtgattggtctcattaggtatagacctctcatgtccattaactgcagaaaatatgagaaggaaaacccagtcatcagcctctgcgccctagtgttctacgtggtgtggtaatttcagcttcactgcatgcagacctacctgtggctggagactcagggtgcaggctctggtcccaagtccgccagcctgcatgagtgacctttggcccatccaccactttatcctcctcatctcaagaatcccgtatgagacaaggggtgagaacacacattcacgctcacacaacaaaataggacgccctccccaaggcgccaccacacgcccgcacgcttcacacgagtgcaccaaagagaacctccgtgcgaacaaacacagcggcgccgcacacccccaatcgctacacccgctcacacgaaggacccaaacacacaccacactcacgcgaccaccccaggctatatgtcagggaaaccatatgacaccgctccaccgcgcgagccgccactccgcacctccccatcccaccacgcccgacacccaccctagccaccacacc

SEQ ID NO: 209864 - DNA, 561 bp, Homo sapiens
tgtccaggtagatatcaacaggaggtaaaggagtatagtgcttgacccataataaatattcaatatatgttatttgctgataaggtgattgcagatgtactatttttttttttaatttttgaggacctaccagatgtcagatactatgcataaaatcccctgttaattctcacatcgcaacaaagcaggcaatattactcctattttgccagtaggaaaactgaggctcagagaggttacaaaacttaattttaaaagtcatgtatctcatacatggtggagttaggcttaagatttagctgtgtttgatttcaaattctgtcttcgttccaccatgctgctgttgtttcttctctagcagttctcagagcctcaagagaaggcttttccctctaggagtgtactgcatttgctccttctggcctggagacctgcccctttaataggtaacctggatgaaagaccccagagcgacctccccacagtcacacctcctagttcctttctggttctcacatgggcaggcactgataaatcagctcacggtacacaggctcagtt

SEQ ID NO: 209865 - DNA, 621 bp, Homo sapiens
ttcccttttgatctcactgttgccttttcattttagctcctgattcacagagtccacgtcctcccgcatccaacatcgaatgtagcagtttactgagactttcttctagatccttttgcagatatatttcagagatctgttctctgtgtatcctgaaggcatgcgtgagcaccccatctcacctggccatttttgtgatttgcaatctgtgtgcttagttggagaaagatgttgggaaaatggcagaatatcagatggcaggaaaagagcctgcccatctcaggaagcatgagaggaatggctggcagcccaccagtcctgggactctgagtggagaccccgagaacggagaagtgaatgcttttactcattcctcattgaggcatttggtccatgaaccaaaagccaaggcagggtcagctgttcctctacggctccttctagtctcagttcctcctcttcctgacttggcagtgtctgtcggtctcactctggagtgttgtgagtttgggtccacatcgatgcctccctgcatggagcccccctccaaaaacagctttgaggccaggcgcagtggctcacgcctgtaatgccagcactctgggaggccaaggcaggtgg

SEQ ID NO: 209866 - DNA, 396 bp, Homo sapiens
aacccctagcctccctcccttccccatccagcagtgatgctgcctctgtggtggtaggtggggagctgcaggggaggagataaggcctctgcctgagtttgggagaccagggccctcatagcttctttcagaggatggagtcagaaaggatccacagctactctgtcacctgcccccatcactgtgtcatgctgtctgccctgttgtcatcagccaacacccaggcatagccaggagcccacctgccctaccgccaggatacacctctgtcctcagaaggttttctcctggatgagactgagccaatgggaatgggaccccttcatccccctggctcgccccagccctgagtcccactctcagccgatccctgagtaaacccagcacagactgact

SEQ ID NO: 209867 - DNA, 361 bp, Homo sapiens
ataggaagcatgcaattcctgactgtctctttatgatgttaacagtaattagtatataatgcatagatctattaatccattgggggctataaatggtattattctaattttattaccttttcatttaaaagttagaatacttttgtacatgatactacctcttatctattattggttgctgttcacatagtttacaaaggaaaatcaggacaaatgcttctttctctttatttgccagttttcatttataatgaattgtttctctgttattctccaaatttggcagattcttttttaaaaaaaatatcattatgaatgtatggattaaataattgatgtatttcagtctcttgcaatcatt

SEQ ID NO: 209868 - DNA, 296 bp, Homo sapiens
gctcagctctgtgctttctgacatctctatttgcattcagcctatccacagaggtatgcattccaatttttttccttccatatatttaggagcttgttcctgtggggaaggcctattgttgtctatcatgcttgtgactaggtgtgtacattgtttagttaagaggaacatattagaaacttcattataatcatgcatcctgtgttttccaatatctgttcaataataaaaataatgtttgatttccatgtaagtgacttttatgtctattctcaattggctctgaaatcatgaaa

SEQ ID NO: 209869 - DNA, 239 bp, Homo sapiens
tgtcttacacttcttacagtcccctctttactacacgacaggttaacttaatcaggacagactgtataagttacagggcccagtgcagaatgaaagcatggagcctgttgtatagaaagtaggacaaaggtgccattaaaggtggtaaaatataaaatatttttcttctaggggatctctctcaactttttatggtgttttaaattagctgtttaatgttgctttaagtgaggaaaaat

SEQ ID NO: 209870 - DNA, 359 bp, Homo sapiens
agtgttgaggtgcttgtttccatgcatttgagaaattttagctgagcctgtgcttttgattttgatggcatgaatattaatgcctgacaaaaagcattgtacactaggtcctcgaataaggtcattttgttcaacaccatttcattaaatgatgagaaaaaaacatcaattactggtagggccactgtattgagtttgcacattctccctgtgtctacatgggttttctccaggtattctggtttcctctcatatcccaaagttgtgcatgttaggttaattggcgtgtctaaattgtcccagtgtgagtgagtgtgtgtacatgtgtaccctgcaatagaatggcatcctgtccaggg

SEQ ID NO: 209871 - DNA, 824 bp, Homo sapiens
gacattccccaaattccgatctttgcggcctcggctcagtgggaccgaggacagtgggaccatctttgggtcggtgggaccccaccaggctcccttggacttccgcttgtggtgccacagggaagctgtaaccgggctgagagccagggaactatggggcgcacacctcctcctcttccttggagtcttgcactacctgttgttcacacctgaaatcagttgcctcataaatgttgtccaattttatggttgtttaatgtgggagggtgagtccaggaccgaggactctgtcagagctggagaccaaagcccacccaatatccctgcagaagctccttttcacctgagctcagccagaacaggcttctattgctggcagccaggagccccgcctgagccgcgtgataaataatgtcctctagaacctccctggaggcaggttccagggcacctcctgtggccccttgggacccatggatcgcacagagtgcaattcagcaggggaagttttctgtacggaaggaaagatagagagaaaatgtatatattaggttggtgcaaaagtaattgcagtttttgccactgaatgtaatggcctatcctcctacaaggccgagtttagggagacatttcaaagatccagagcaacagattccaccctacagaattcatggatagtcacatcctgggaaaccatggagctatcgcgagggtcccacgaatccatgtgatcctaagaattcgctatagactcaatactgggctgtttccaggtatgcacagaggctgctgcattttataaaataaaaatccattttaaaact

SEQ ID NO: 209872 - DNA, 346 bp, Homo sapiens
attggtcatttgaaaaatattggtttcctgaattatgcagattttgtaaacacttacccattttattatacagtgttaaaaatcattaatatcatcacagatttctaaggaaaaaattttaaagtattgggaagctgtcaagcttacagtggtttgacagcttgaattttatcactgataacaatactgttggttattttccttgaattgttaggcccagttgtttatgtttgagaaaatgtctgtcaaatatccaaatctgaatagttatagtttgtttcatttcacagaatttaaaaaattattgttctcaagggttgagatttaataaagttaataattttta

SEQ ID NO: 209873 - DNA, 519 bp, Homo sapiens
ggaggaggtgatgctgggcttgagtgagtgtggttctggccaaaaacctgtaccagttccccaggccagagttctttagcccagagtttccaccctctcactgacctgcatttgactggcctgaattcttttttcctttgtttttcctcctgcaaaagacccagagggcagagatgtggccactaagtggagtaaagaagaaaagggctggcaatacccaaattgtttaaaccagccctgagtatgaaggagcccaggaggagagacactgcgggctggagtgggagttttgtggaggtgatggggagggtgtgtgcccacccacagtcaggaaagacagtgggagaacattctagaaggactaccaaatcttctccattgttttctggtgaagcagcatggagggttacacccaccgtcagggtggagtcccagggcttgggtttagggtccatctctgaccctgctgtgtcagagcaaatttgctgctataaaaaagagtctgcaaatctccatata

SEQ ID NO: 209874 - DNA, 149 bp, Homo sapiens
tcctgggaagctgactcttatcaacaggctcccttgttttttggattccagttgtatttagccaatggggagcactaacaaggagaaatgtgagattaggctatctatttccaggcaccctgcctgagaggttgctgggcattccttga

SEQ ID NO: 209875 - DNA, 567 bp, Homo sapiens
tttagtggaaatggggtttctccatgttggtcagactggtcttgaactcccagcttcagatgatcctcccacctcagcctcccaaaatgctgggattacaggcctgagccatagtgcccgccctggtacaaatatttttatctgctttgattttaagctgtttggggtcaaaaactatatgtattgtcgagaagaatatggaaataatataaaagattgctaggtgcttcttgtggctccttttattatttccttatattttatttattttttttttatttgagacagaattttgctcttgttccccaagctggagtgcaatggcacaatctcagctcactgcaacctctgcgtcccgggttcaagcaattctcctgcctcaggctcccgagtagctggtattacaggcgtgtgccacttcgcctggctaattttttgtatttttagtagaaacggggtttcaccatgttagccaggctggtcttgaacttctgacctcaggtgatcgcctgcctcagcctcccaaagtgctgggattacaggcgtgagccatcatgcccggcctat

SEQ ID NO: 209876 - DNA, 331 bp, Homo sapiens
taggaacagaggcaatgaaataaataaacatggacttcctcacatcacagctgatctgccactgtcactgctgagtgcccagatttctaaaacggaaggcaacactgaacccttatttggcactatttcttggaagtatcagccacccaggttgataatatcagaccactacattatggaaggggcaggaatttgtcttcatgggaataattacatatactggagagtaacttccctttcctgtgcatgttgcttccgccagcactaccatatgtggttgataggctgccttattcatccccatggtgtcacacacagcattgtcactgat

SEQ ID NO: 209877 - DNA, 382 bp, Homo sapiens
cacctgcccatttcaaacagcagaggtcactaaatgtggagttggcaagagatacatagacatagtactctatacagtgtttctatcatatagatacagtagatataagttgccccaaaaacataataatacaaaatgtagccaaatcattcagaagttatgagttttgaatacttatttccattgtttttaatataatttgtttaattatagttaaaaatttttatgtaatttaatttttaataactgttgggtattaacaactgacttataaatactcctaaaaatgtaacagaatgtagtgagggacaaaatggatgcggtctctgctttcatcaagtttacattctggtagagaaagacagaaaataaacaagttaac

SEQ ID NO: 209878 - DNA, 474 bp, Homo sapiens
cgctctagagtatccccagtcgcgtgtgcttcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagggaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcaca

SEQ ID NO: 209879 - DNA, 560 bp, Homo sapiens
gttttctttctttctttctttttttttatccccgaggtggagtcttgctctgttgcccaggctggagtgcagtggcgtgatctcagatcactgcaacctccgcctcctggatttaagcgattctcctacctcagcttctggaatagctaggattacaggtgcatgccaccacacccggctaatttttgtatttttagtggagacggggtttcaccgtgttcgccaggttggtctcgaactcctgacctcgtgatctgcctacctcggcctcctgaagtgctgggattccaggcctgagccaccgcactcggctagattttcagatcagctgggtatatacctaggaacacaagctggattgtgtttgtcccattttgtattctcaccagcaatgaatgagtgtgtggcttcaatccttgccagcaactgatattgtcagctattttgtgttttaggcattctagtatgtgtgtagtaatcttgcttttctcagctttatccagaccactcttggacagttacgtctggttctgggtgcctcacgtgaggggtgagggtgg

SEQ ID NO: 209880 - DNA, 534 bp, Homo sapiens
  misc_feature (33)..(33): n is a, c, g, or t
tatctctacattatagacatttattttagtttnattttcaaagtcattgacctcttgtatcagatttaaggcaaagaagaagatacatgtcccaggactataggccaggctgttgactgcactgggatttagatggtgtaatctcccttagttctaccagggagacctcagcccaggtcttgttgccggggcacagttgagcactggattcaggtagagggctcccaggtcagtctgagagttaatgttagagatacttattttgctgtcttttctgtattgtttgaattgtttttacaatgacagtgtatctttgtatgcgtgtgaaaacaatagtcattaaagaaacaagaattggagaaaataaatttttgaatccagctaaataattttactgtaatacttgataaccacaaatcacaaacttatccattttgctttaaaatcaggggaatgtgctttttttaaaaaaatttgaagacattatagttatgtaggtagaaaatttatgtctgtattaatgacttaacagtg

SEQ ID NO: 209881 - DNA, 148 bp, Homo sapiens
gactccttgcttgaggggcagagtcctcttgctctaaggtaagaaattggttcttcctttcatctacttttcctgccagtgtttatttgctagcccatatgttcctgcacagggtcactcctattgtgaaataaatgctgaataaata

SEQ ID NO: 209882 - DNA, 268 bp, Homo sapiens
aatactgcattatttgttaacagcaagaaatttaaaacaactcaaatgttcatcagtaggtacacagaatatatatatatatagaaggatcttcatttcttctgtatcacagaagaaatgaagatttccattaacttgtttttgagacagagagtctcactctgtcactcaggctggatgaagtgcagtggcataatcatggctcactgcagccttgacctcctgggctcaagtgatcctcccccctcaacctcttgagtagctggga

SEQ ID NO: 209883 - DNA, 172 bp, Homo sapiens
atttttagtagagatggggtttcaccatgttggccaggctggtctcaaatgcccgacctcaggtgatctgcctgcctcagcctccaaaagtgctggcattacaggcgtgagccaccgtgcctggtcctgtccttcattttccagttaaggaaacggaggctcagagtgggga

SEQ ID NO: 209884 - DNA, 739 bp, Homo sapiens
ctagaatgagtgctttgtaaacaaactgttgattttatgatggcattagagtctgtcaaattgccaatcttccagatttatacagccttagaaatcatgtgatttaattaagcattccatgattttgttcttattgctatctccaaagtttatgttcttgacctaacaattagttgtcagagttactgctctgaaagaaatggtgaatattgcaattggaatgatagcccccttattttataactcatcttaccttccactacagtgtggtagactggatagctgtctagccttagtcaagccacttaatttctctgtgctttagttttcttacctgtaaaattgggctgctgaaaaccatctcagattattatcaggattaaatgcaatgtgatatataatgtgcacagcactgttcacatagacacttagtaatttatagattcctttcaacttctcaacttcttttaatatgagtaagtgttcttcacagttccctcttgataatttcctcccctcaccactgttaacctttttgggttcttatccttcttgcagaatctgacgtaagcagtgacccctcctcccagaaaaacgcacatgtctattaaattttgcctacaactttgggacttcatagaactccccccgcccagaaaaaaatcccccaatctcatgtgtggaccaggttaaggatcctcttacccttggtagacttactcagttttcctagctttgg

SEQ ID NO: 209885 - DNA, 151 bp, Homo sapiens
ccattgaaagagacccgtgacaatatgaaaagacgtgcagatgaaacgaaacagagccaagattaccaggcaaatattagacacagttgcctgcttctcattccatatgaatcaagccaccctccgatagaagtgggaaaacaagagtttc

SEQ ID NO: 209886 - DNA, 210 bp, Homo sapiens
tatatagtttaattctatcttttttttcttggtagagataaggtcttgaactcctggcctcaagtgatcttaccaccttggcccctcaaaggagggactgcagaagcatttagcaatagttaattgtttaataattgttgttatttgttactgtagtattatcatgtatcagtagcaaattaaaagtatacactttttgaagaatgtcat

SEQ ID NO: 209887 - DNA, 427 bp, Homo sapiens
ttgtgctcgtgactacgatgagtttcactgtgaatatccatttccttctagcgtaggtccctcccactccaagcctttggttgggcagtgtggtggagtcttttccccttcatctcccgccttttcttccttggtcttcatcctttgtagcaaaggcagtgtgactccttgtatctagccacaagatgagcaagtgggtccttcatctggttctacactgtcaaagagtgaagacgtctatactgtgaccccagggaaatttgcaggaactcttctgtgtatatattttaaatattttttatttacacaatgtgcaaaaattctgcatgctgcaaaattgttttacctaatttatttttgcaagctaattgaaaactttaaaacatcttgctaacagactgtatgtagttggctggccataagttgt

SEQ ID NO: 209888 - DNA, 232 bp, Homo sapiens
tcaccacttttattcaacatagtactggaaattctaacaagagcaattaggtaagagaaagaaacaacacccaaattgggaaggaagaagttaaattctctttatttgcagataatatgattttatatttagaaaaaatctaaagatcccaccaaaaacgaactgtaactaagaaactgattttatttataaaaccaacatacaaaaatcagtagcacaaatgccaactgtg

SEQ ID NO: 209889 - DNA, 343 bp, Homo sapiens
ggaatagagatgttgagtttcaggttcatatgagagatgtgggtggagatatccactaatctgtctagagcttttaagagaggctgggctagaggtctgaaagtcacaggtgtaataaatgtagcaaactatgacagtgaagttgcccagagagaactatgcaagtgaggacaggggagatgcaacaactggagaagaaaagtggggtgactaggagaaggaggttcaaggagagagttgttttttgtcttttttttttcttttttgagacggagtttcgctcttgtcacctaggctggagtacaatggcacactctccgactcccgggttcaagcgattctc

SEQ ID NO: 209890 - DNA, 392 bp, Homo sapiens
gatgttttccaattgcctgagtattccagtttgtaaatttcccattttcgagtaattacagattaataaaatatacttgacactaaaacttgtctaaataaaattaaacttttacgccaggcacggtggctcacgcctgtaatctcagcactttaggaggacgaggcgggcagatcagctgaggtcaggagttcgagaccagcctgaccaacatggtgaagccccgtctctactaaaaatacaaaaattagctgggagtggtggcatgcgcctgtaatcccagctactcaggaggccgagtcaggagaattgcttgaacccaggaggcggagattacggtgagccaagactgcactccagcctgggcaacaagagcaaaactctgtctcaaa

SEQ ID NO: 209891 - DNA, 345 bp, Homo sapiens
atttttcagcaaggatttgatttaaagttgctggacaaaactgagcctgacagagctgaggggctccagggaaaccccccccccccacaaaggaaatatttgctgaagaagaggattgaagttcaaaagttccagaagccttggtggtgctgttttggtcggggaatagagacacagagggaggcaggagagctcccgaggccgcagagcctctctggctcttcccttctcatctcactccgcatgtatttagggggggcctactatgcacctggcactgtgcagagaccaaggcagaccccgtctgtgcccttgtgattgtcaccatctatggaggacacagcc

SEQ ID NO: 209892 - DNA, 419 bp, Homo sapiens
aaattctgaacatccaaaaatcaaatgaatttgtttaattaaaatatactctgacatagtattgaacttttactataaaagaagtttgtgacatgcaaaggcaaataaaatgttcaagtttaaactgtataatttaattgcctttgtaatttaaatggaatcactatctgttagaatttaaaatacatttattttaatgcttcctttagcatttttattttacctatcgaaaaaattatgtcttatgtcatatagaggtcactgatatactcattgacataattgttgatatcataattaatatggtattttaagtatattctttgtctccataacaattatagataaaagaaagatcatgtttcaaaaaattcttaagtatgtattttattttcattgaaggtcacagaaacaaaggc

SEQ ID NO: 209893 - DNA, 387 bp, Homo sapiens
tgcctgctgtcgctaaatgctctcttcacttagtccaaactatgagctttcacactctggctgcccggcctgtgaagctcttctcctggacccagctggaaccctacccacaccctaccctcctactaaggtttcttgacatcctgtccagagggctcatctccccttctgaactctagggctctggggccattcatctggcactttatcatgtggcacttaggactcttagttcacttctcaagtttgtgtgattagacccacatttaatgtaggagttctgtggctggttgtttaaaacaaaagtaaattctcccatacaaatgacgtttttaagaaaccccaacgaggttccatggccagtccacaaacactatttcaataaac

SEQ ID NO: 209894 - DNA, 407 bp, Homo sapiens
ttagtttttagagagctcactatcctcattttccaatgaggtcactgaggcagaggcagccacacttctccaaggttacatgtaatccaaaactaaatgcctagactctgggcccatgattttttttttttttttctaaatgaaagtcttcgcccattggccaggtgcagtggctcatgcctgtaatcctagtactttgggaggctgaggcaggcagatcacttgaggtcaggagtttgagaccaccctggccaacatggtgaaaccccgtctaaaaatacaaaaattaggcgggtgtggtggcgcacttgtaatcccagctactcaggaggctgaggcaggagaatcgcttgaacccaggaagcagagattgcagtgatccgagatcgcgccactgcactccagcc

SEQ ID NO: 209895 - DNA, 510 bp, Homo sapiens
aattagagtctcactctatcgcctaggctggagtgcagtggcacaatctcggctcactacagcctctgcctcccgggttcaagcaattcccctgccttaccctctcaagtagctgggattatagacatgagccaccatgcccggctaattttttgaatttttagtagagacagggttttgctatgttggccaggctggtctcaaactcctgggcctcaagggatctgcccgtctcagtttcccaaagtgccaggattacaggcataagctaccatgcccggcctcatattattatatggttgaactgcatggcatgcctactgttggcttctagctaatgaattacttccaaagaatgagtgattctttccaaaggaaactgtaacatgtgctcttaaccataggcaagggctgaatatttgcagatacagttcatcaaaggcccaagaatggacaaaaggatgcccaggccagtgacagaatataatttatgtgttgcccagagctttc

SEQ ID NO: 209896 - DNA, 382 bp, Homo sapiens
aagcaagaagtgtcttgagaagtgattacaacagggggttgctttctcttgctgctgtgacctcttccactaccacgaggataactcctactaacctaatggatgatgacagacacatagtcatcaccccatctgacatctgaccaactgccagacatgtatgagtgtggccccttagaccagctagcctgccagcaactaccagacatatgaacaagagcattctagaccatccaggcccagctaagctggcccagaccagaagacttccccagcaaacccacagactgatgaaaaagaataaatgcttattgtttaagagtgaaaccagtaagttttgaggtagtttgttctgcaataaaaactgaaacacaaagcatgt

SEQ ID NO: 209897 - DNA, 308 bp, Homo sapiens
caacgcatgtgccgctcccagtctctctgcctcaccttctgggtgtggagaacttggtcagccactgcggaagcctgagctccctgcaaccaccagttcctctcttccctgaaacacgagcactgatctcagcactttacctctattcatctgtgaaatcctcccagtagccctctgaagtgagtactgtaatatcctcatttcagagatgaggagacataagcccagagaaggtatgtgactcctccaaggatacacagccagtaagtgatggagccaggatttgaacccaggcagtctgaccccaa

SEQ ID NO: 209898 - DNA, 210 bp, Homo sapiens
tattaatctaaaaggtactatgttccagacactgtttggtactggaaatagagttattaaaacagtcgctgtctcttccctctgttagtgaaggacacatatgttaaagaatcacaaaaacatccatataatcacaattgtgacatctgtgaaggtggggtctctgttcagtatctctctgtatattgcccaccttccatcttcccaccc

SEQ ID NO: 209899 - DNA, 900 bp, Homo sapiens
tcctatatatccaacaagatctggacatgtgcctgcctgcccgagttacctcatacagctaactaaaaattcatcactttccttcccaaagtcctcttccagcagttcctttttctgccagtggactcaccatcctcctagtcatccaggccagacacgggtgtcatccttgactcctccctttgccttagacccctacccaaattatcaagtcctgcaattctctcttcatttcatctccgatctccactgccactaacctagttctggctgcctttggatctcacctggactactgcattagggcaggtctctctgtctccactttctctccctcatttccttctctcttgacattgtagtcaagtcaccttttgaaaatgcaaatctgatcatgtgattctctctataaaacccttaactctgggccaggtacagtggctcacacctgtaatcccagcactgtgggaggcccacacgggtggattgtcaggagttcaagaccagcctggccaacatggtgaaaccccgtctctactaaaaatacaaaaattagccgggtgtggtggtgcacgcctgtaatcccagctactcgggaggctgaggcaggagaattgcttaaacctgggaggcgaaggttgcagtgagccgagatcgtgccattgcactccagcctgggcaacaagagcaagactccatctcaaaaacaaaacaaaacataaaacacttaactctgtacactataaaagggtgaatattatggtatgtgaattatgtctcaattaaaaaaaaataaaacttaacctggtttacaaagccttctatgatttggtctggctcagcgtctctcattggcttccctcccccgcctcccgctttcctcttagctttaccatgcta

SEQ ID NO: 209900 - DNA, 560 bp, Homo sapiens
cacaggggccaccatgcccagctgtagatcttcttcgattgaccactgtgatggaaactgaataatcctatacaaaatggcaaaaaccaaactttttcccatttgacattgctttttaacaatttcttaatagttttctgttggctggccagctagaagtatcttgcttttcatctgttttcaagccccagttgttccagcagaattgcacacttttcccagctgattaactatcctttaggttataaatttgtcatgggaaatgctaacccacactggcttcctcttaccccttcacttgctcttgggccctttcaccatctagcactccagtctgggcaacaagagcaagactccatctcaaaaacaaaacaaaacataaaacacttaactctgtacactataaaagggtgaatattatggtatgtgaattatgtctcaattaaaaaaaaataaaacttaacctggtttacaaagccttctatgatttggtctggctcagcgtctctcattggcttccctcccccgcctcccgctttcctcttagctttaccatgcta

SEQ ID NO: 209901 - DNA, 498 bp, Homo sapiens
catggccagggctgaccagtctcttaacatttgcacagtatttgatacaaattaggtacagcatactcgattaggtatttacttcctaggtcatgagtatgttttagacctttgtctgctctttttttttaacctaggtcctcttgattggagtttcggatgttcccaaacccctcagtcatcccctaagactctggaattttgggttattctctaaatgactaatctcattctttgtgtgtgtgctttagaagtttaactgtgagaaggaaggcataattcctggtcgcaggaggaaacttaaaatttccactaataaaggatctatgttgttacattgctgtgtctcctacagtccctagaactgtgacttgcctttaataaatggctattggtagtaagattaatcatcctaaacttgggaatccaccactgaagcataaatgtgcttgaagaagactttgccttgtaataaacttgtgaaatgaaagagggtcc

SEQ ID NO: 209902 - DNA, 132 bp, Homo sapiens
tacatatatcctcaaaataatataggtttctctaaataactagggtgccttattttgataatcaattaatgaactgtactgcaatgcagttatgtttcaggggctacaaaagtatgtgggactaagcagccc

SEQ ID NO: 209903 - DNA, 656 bp, Homo sapiens
gaaaagagcgcatgacccattgctctgatggcgctgggcagaaaacagcaatgaagtgaatgcaactgatgcctcctcaaaagtttgctacctgccaagactttcaagcatgaaaatatctttatttttcccttttaaaattgatgggtaggccatatgggagagagggaaatactgacaaagagggcacctcaagaaaagcatgcctataaaaataatgtgacaaacaatgaaacaacacacaaacagtttgacagataagagagcaaaggatcaccacacgcccgtgattctagagcaagtggtgactttagtgtgtggctgtgctcatgcatatggaccttacacaactgcaatcagcatctgcatacctacacccagtaacctgctttctctacctaatatgatataatgagcatttttctatattgctacatagtctttataattactttaaatgactgtataatattccattcattatatcactgctgaatatttaggttgcttgtagtttttcctttgctcatttttatgaattaacaaatgtaaagtatttcacccactaccttcaaattatatatacttggtcggcactttatttccttcccgttctgcccctttatataaataaagaaaagtatgaaagattcata

SEQ ID NO: 209904 - DNA, 507 bp, Homo sapiens
taggcactttcaaaaatgatcttatattactgatttcaaagagttattattaagctcccttaccctctgatttctcccattctgacacatcttcttaaaaaccgtcaaagagtctgaaaacatatccctccccaccctttttttcagccaagacctcactcttacaatgtccaagaaatattttatattaaaattaacaataaggggccgggcgtggtggctcacacctgtaatcccagcactttgggaggccgaggcaggcggatcatgaggtcaggagatcaagaccatcctggctaacacagtgaaaccctgtctctactaaaaatacgaaaaaaaattagccacgtgtagtggcgggtgcctgtagtcccagctactcaggaggctgaggcaggaaaatggagtgaacctgggaggtggagcttgcagtgagccgagatcaaaccactgcactccagcctgggtaacagagtgaaactccatatcaaaaaaaacaaaaaaaca

SEQ ID NO: 209905 - DNA, 233 bp, Homo sapiens
aagtctgaataattatactttgtctttcagctgtactttcaggtaagaatggtgctccatgagtcaagcgattacttcagctcacaactcaatcacttaaggttttttcctcgataaagtcatcatactttgatatgcagcgtaactgtttatgcatccttcccattttgtcacacaaactattaaaaagatgtgtatctaagagttgaaatttaataaaatttgtaacttct

SEQ ID NO: 209906 - DNA, 562 bp, Homo sapiens
tcttaaaagatatgtcaggaaattatcaaaagaaagtaaaggtgacggctgggcgcagcgggtcacgcctgtcctcccaaagtgctgggattacaggcatgagccacctcgccctacccatttttgttttaaaaaataaaaatagatgtacccagaattcaggtcaaagttaggagagtacaacaaggaggatacagaaaaaatgataggtgtatggtacaacatggatgagtcctgaaaacactatgctaatgaaagaaaccagtcacaaaagaccacatattatatgattctagttacatgaaatgttcagaatgggcaaatctataaagacaggaagattagtggttatctaaagttggggtgggaaggaaggagaaaaggggattgattttagtggaagaacaagaatgttctgaaattgattgtgatggctgtataatcctgtgaatatactaaaacattgagttgtgcactttacatgagtgaattgtgtggtatgtgaatttatatctcaataaagctatttttaaaatgataaaagcaaatgttaatgaactgt

SEQ ID NO: 209907 - DNA, 531 bp, Homo sapiens
ctagaaactgtgactatgttgtggtgtcatgcctgtgagtatgttatgctacatggcaaggggtactctgtagatgtaactaagttcactaatcagttgtcattaagatagggagattatactgaattatccaggtggacccaaggtaatcacatgagccatcaaaagaagaagagcagatgaaggcagaagaggaagtaaaagtgacttaacacctgtggaaggatttagtgggccatggctgcttcgaggctggaaggtgccacagaagaagaaatgtgagcaatttcagggagccgaccactggtgaggaaataaggatctcagtcctatagcctcaaggaattggattctgaaaactacttgaatgaacttggaagtggatttttctccagaggctccagataaggacccagctggctactcgcttgattttgaccttgaaacgtgagcagaaaactcagccaagcccactcagatttctgacctatagaaactgagataataaacttgtgttgttttaaactgtta

SEQ ID NO: 209908 - DNA, 212 bp, Homo sapiens
acaggcccccgtgtgtgatgttccccttcctgtgtccaagtgttctcattggtagacttttcaatgtaaagaatgatgtcatcagttctgtgtatttatgtcattggttgtagtagcaataatagtattgttattgggttattacctctattacattatttttcttcctttgaaatgagtattaaaatttggatcaatgttgtcttttaatt

SEQ ID NO: 209909 - DNA, 212 bp, Homo sapiens
tttgcaataaattcaagactcttcttattggtaattttccacacaatccctctgaaataagggagaggatatagacctttttaactttatagttagaaaaattggcctcagtgtgaaatttttccagtcccatagctcatggatgccaccagcttgcggtagtagcaagatgcttactaccacaccgttttcctcggtggcccaatagctcg

SEQ ID NO: 209910 - DNA, 648 bp, Homo sapiens
attttcagtattttatagatgatgtgtaagcagcaagcttaataggatgttacccgacactttgcgagactggcagctgatttgatccagatgtctctaattcttttttctttttctttttctgtttttttttttttgacagagccttgctccgtcccccatgctggagtgcagtggcacgatctcggctcactgcaacctccacctcctgggttcaagcgattctcctgcctcaggctcccgagtagctgggattacaggcgcgcgccaccatgcccagctaattttttgtatttttggtagagacagcatttcaccatgttggccaggctggtctcgaactcctgaccttaggtgatctgcctgcctcggcttcccaaagtgttaggattacaggcgtcagccactgtgcctggcccagatgtctctaattctaacatgagatgtattgcaggatcatagcagagtgagttgctgatgtatccagaaggaaacgagcatggaacactcacgacagctgtcctgagaagtgtgtgtgtgctgtgcttgaatatctcactgctcatttatacacaggctttctggtgactgagttaacagtatctgtttcataaataatgtagccctctttctttctttctctctctc

SEQ ID NO: 209911 - DNA, 361 bp, Homo sapiens
tgagcacctgcaagccatgtgaagaccatgattgctttcccttcagccttccacctttgtaagtttcctgaggcctccccagaagcagaatcctgcatagtctgcagaactatatcaatcatgcctaggtaatgaagcctccataaaaaacaacaacaacaacaacaacaacaacaacaacaacaaaacagggttcagagagattctggatagctgaccacgctgaggttcctgaagggtggtgcatccaggaagggcagggacgcttcatgccttttctcccatactttgccccatatctcttcatctttatcctgtgtaatatcctttataataaacctataaacattagtaactgttt

SEQ ID NO: 209912 - DNA, 243 bp, Homo sapiens
gttgacatttacagaacattccacccaaccacagccagatgcacatgattcccgattgtatatggaacatataccaagaaagaccaaattctgggccatgaaacaagcctcaatacgtgtaaaaataatccaagtcacacaaagtatatcctctgaccacaatggaattaaattagaaatcattaagagaaagatctctagaaaaatccataaatatttgaaaactaaataacacacttttaa

SEQ ID NO: 209913 - DNA, 555 bp, Homo sapiens
cagctcccagcgagattgatgcagaagatgggcgatttctgcatttccaactgaggtctctgaagaatctccataccatcttccacaattgttgaactaatttacacttccagtaacaatgtgaccaacaacacatggaagctgccaaggcttggggtttacaccctctgaagcaatggcctgagctgcaccttggacctttttagccaaagctgaagcagctgagaggcaaggccccaagtctcaggcttcacacagtagggggcacctggacctagcccaggaaactatttttcccttaatggcataccctcccatcacaggcccagaagcctaggacataacctggaggcattttcccctttgtcttggtgattagatgcagcacccccagggggaactttgcccctcccatttgggcacaaccactgaagacttcctcatctttgccacataaaagccccagaacacagccccatttctggcaaccctctttgggtcccctctctttgctgagaacttttctgttgcttaataaaactttgctctacatta

SEQ ID NO: 209914 - DNA, 167 bp, Homo sapiens
aggttacaactggaacattttaagatttagtatccagaaattaaatgcatcatgaaacgataggtggagtttaatgtacaccttatcagtgtgggtcagtgacctggaacattttcaggattagtatgaatagaaaatattcccttctattttctctccatatagga

SEQ ID NO: 209915 - DNA, 238 bp, Homo sapiens
agtccagaccccagctctggtacttactagctgtgtgaccttaggcaagtgctttcacctctctgatttggttttctcatctataaaacggtaataatgacagtatcttaccccttaagaggattaaatgagctatacatgtaaaaacctttagaaaagtacctggaattagtagcataagtgatggtagtggttgttgttgttttaattgaaaaaccacttagcactggctacatag

SEQ ID NO: 209916 - DNA, 381 bp, Homo sapiens
tgctgtctccttccccaaaagagggagagagaatgggttgcagggtttaacctgtacctccacaaatggcatttatctacaaagaaaacttaatcttagggaattttattctccttctataagcactgatcatagtaattaagtacttgacataatttcatactctataaaatgtaacctgtagtgggaaaatcactggctttggagactgtgcttgaattccagctcagatgattacaaacgctgtatgaccttaggcaagagccttcctctctgagcccagatgtctaaaataaaaaatgagccacttgctccaacagcagcatttccccaactcctttacatcactgctttttctactcccaaaagtcttgatgtaat

SEQ ID NO: 209917 - DNA, 149 bp, Homo sapiens
tttggaggatctgggtaagggccagttgagttgggtttagtgggattgtttatgtgggtctcactgtacacctctgtgtatagtgatgaacttggacaagaaataaaggaaggttatttatatgctcccccaccgacctcaccccagtc

SEQ ID NO: 209918 - DNA, 362 bp, Homo sapiens
  misc_feature (13)..(13): n is a, c, g, or t
gacgatcccaccntaatgctgtctttgagaaaagaacaaacagctaggaaaacacagggtggttaaaagatgtttgtgatgtttgtgccgtatggaacaaaagaggcattcgggagactcagcattgttctgcggagtgaggacgaaacagccctcggaggcctcctctcatctgggggcatccagctcattgtcgtggaatgtagctccagccatcgcttcattgtcaggccatatactctgtgcggggcccgggctaggagtgtgtttacacttgattcacttggaatcctctcctggtttctgatccattctttctgtcttcttgttgggaaaagtggctcatgttatcacccagtcac

SEQ ID NO: 209919 - DNA, 227 bp, Homo sapiens
aaaattagactcccatttgaaaaattacagaaacgatggctctggagatggaaaatgggagatgagcagatttatatgggctcctctgaactgatattggtgccaactcacagaagccactgtgtgtttagctcagctgctctttgtgcatgcctccaggggttaatagctaaagctacatctgtgaaggaaatataatgacaacactgtccacgggaagagacatt

SEQ ID NO: 209920 - DNA, 139 bp, Homo sapiens
ttttacagatttattcatccaacaagcattcattgtcctctatgtgtcaggcattattctagctggtagataggcagcaatggacagatctaacagccctgactcatggagctgacaaactgttggggggtatgtgggg

SEQ ID NO: 209921 - DNA, 371 bp, Homo sapiens
ttttaacaaagtacagtgttaatttctattctgatttcctttcagttaagctttactaagaaaaccagtcctagaattgtccctaacaacacccaactcagaacaaaccccaaacttcctggtatactcccccaagccacccattccaagcccaaatccaatcctcccggtcctttccaacctcctcttcccaagatgccccactttactgaagtttcccatggtgtgtgctcaccattgctttcctggcaatacactcagctgacctgctacaggtgtgtgccctgagacctttagctggaaggtactgacaatacaattatattttctatctaaaaagctactgtagtaatttagaatgacctatttta

SEQ ID NO: 209922 - DNA, 174 bp, Homo sapiens
cacagaagagaggcatcttggggtgaaggtttcatgggagaagccttcctggaaaaagtggtggccgagctaaaatgaagtataacaacaacaacataaataatggcaactaatatatactgagctttttaatactatatgccaggctcatgttaagtactttgcatatatttt

SEQ ID NO: 209923 - DNA, 591 bp, Homo sapiens
aaatgaccttcacagtggcaaggctagaatttttcctggaataaaaaatattcttctgttggaataagggatacaaattacattcttagggcttttaggcactcttcagactccttatgagagataaacaccctccctacccctttgacacttttctatctaatcaaaagaaatttgggggaattagaagggtgattttttaccatcttaattaagacaccagcctccagaaccaaacagcagctgttgtattagaaataccactatgaatcttcctgagagaaatagctctccctccttaccatctgatgttgtctcattcagcttaacacttctagtacctatcatggtgcttgacacatagttgatactcaatgattaatgaatgaattcctcattaagttatctcatccatgcattcaataagaaagagggaaattcaccctttgctgtagcacatttccttcttagacttttgggaatgaaaaagcatacatgatatttatttatgtacaaggaagcatgaatgaaccatgagaatacagacatgagtgaactgcttttgtaaataaaaggagctttaaaaaccta

SEQ ID NO: 209924 - DNA, 232 bp, Homo sapiens
cctgagccaccaggtaacaccaggtgagcccacaccgcccccccaccccttcaactccagcaagcatcaagtcactgttcccggcgccaactccagcatcgccagctgctccacaattacttctgccttaaatttagacccatctgttatctccagggggtgggggcgccagcaaaggaggaagggaggctcctccgaagacagcacaagagggggtgaagctgcagctggt

SEQ ID NO: 209925 - DNA, 312 bp, Homo sapiens
ctgttgaaaatgaggagggggaaggggacattgtggtcaagtaagtttgggatttcagtaaggttaattggtttctgttgctgtagactctttacatgctgccctgaatggcctctgttcaacaaggaggtgttataggcagggtttcccaaacttcattaagcatggagcacctcctttcatgctaccactccttcaattttaaactactttactagtttaaactactaaaaacaactttaaactactttagtttttaaacctattaccatattgttctgtggaagatagtttggtaaatgcagatttaag

SEQ ID NO: 209926 - DNA, 533 bp, Homo sapiens
actacaaatcaaaaccacagttagatactctatggcaagatttggccactttggaaaataatctgatggcttctaaatatattaaacatagaattataaaaataaataaataaataaataaataaataaataaaaataaaagcagtcaccaaaatgtcttaagtgaataaaacattaagattttcatgagacatggagctggttccaaagaatagaccatcattactcttcctctctatcaagaaattagttaactagcacagagggagaacataattaagagcacttccattacccagggtctgatgggcttcatctgcaataacaatttggagacgtttgccaagcaatccacatacttctaaccagtgacatgcccagtatatttgatactcagagaagatcatttttcagtaacctcttcctctgtatgacaaaattattttcagcaagaactatcatatgaaactaaaataatgtcctggaaaaaatacaaggaaaatttttctttattaaacttaatatacataata

SEQ ID NO: 209927 - DNA, 240 bp, Homo sapiens
cgggattcgctcacattcaccaagggaagaaatttagacttgaccgttccacaagagattatacatgcagttgctgagataaatccacaaattaaaagataacattcacctcggtgatcactggaccataaaggttgtggtggactaagaatacgcagttcccttggaatagcctgatcatattgaactgttttcatgccttaagcattaactccttaaatgcaaatatttaacacttgc

SEQ ID NO: 209928 - DNA, 597 bp, Homo sapiens
aaatcattactcttgtggctgtatacctgtctatatgtttttgacattctgtacatttttacataagtgtctgtttcagttgtaccaaggagacatgtgtgggaaagtggagaaagggtgagcacttccaattttatatgtggctatagaaggtacatttcctagaacacttgctacagaagtgggacattgcttctgaatgtcctacatgtatgagccagaggatcctaggggacatatgtgtttgacttagaaaccaagagtaaatgactgtgtccagtcaggtatgctgagctgttcaggctggctggagacctgtatgattttggggtatggtgctgggtgcagtccagtagctggaagttggccagaatgccaagtgcttgatatatgtcctgggatgattggcattaccttgaatgtgacagagagtagaggagtgacataatgggattgcattttaggaatatcaccctgggggactgtgttttggtttaattttttttttaatcgcagaataagacacatgtataaacaaaagaatggctgaagaaaaacaaagtctgtgatacttacatatatagcacaagttgacat

SEQ ID NO: 209929 - DNA, 269 bp, Homo sapiens
ctcccctctgatcaccatggtcacatcagaggtctcctcttcttaccttgccgaacatttctttcaggattggaggaagcagcaatgtgcaggaagcactgtctccagcaggccctgctaaaatacaagtgtgtttttctgagaggctgttgcctttggacgtctcctcatggccagagactgtgttaagtacaccctatgtaattaacatggttcctgtcatatgatggtcctgcagtaaatatgtgttgactgattggcttaggcta

SEQ ID NO: 209930 - DNA, 339 bp, Homo sapiens
tttcagttttattttttttctcttctgtatattaatatgtccctttcaggataactttcatctgttctaggcaatgacacctgctattaggtgttttctgcctttggcttggtcctcagttgtgctcatcttagaaccagcctccttttttctgttgttcagcagcagttccccagggttcactctgacacaaatcagtggtggaggaagacttgggaatagggaatgtggtctctgccctggagccgtgtgtcctttaggagaaggcacttcaaagcagcagctgttcccattacaccagccgcagctgataccaggagttcatacatgtcccaggtt

SEQ ID NO: 209931 - DNA, 441 bp, Homo sapiens
cagtaagtcagacaacatttgccacaataatgtctgtcaaagtggcttgccataaagccattctcatccaccttatagtatttcaggacagccagcttaaccttctttctcttgtgcttattcttcttgggagtggtgtaagacttcttcttccttttcttagcaccaccacgaagtctcaacacaagatgaagagtagactccttttgaatattgtagtcagacaaagtacgtccatcttccagctgcttgccagcaaagatcagtctctgctgatcaggaggaattccttccttatcctggatcttggcctttacattttctatcgtatccgagggttcaacctcgagggtgatggtcttccccgtaagggttttcacgaaaatctgcattttggtggcggctccaccgaaaccggggccgatagcggccgaggggaac

SEQ ID NO: 209932 - DNA, 798 bp, Homo sapiens
cagtgggagtggttttgtagaacaaacaatggcttatttggagagctccacacaatagattatcctctcctgtgggagccagaaagagatgagctcacagataatgggtttcttccttcctggtagttacgaataaataatagtgtgacagactcaccctctagtggttgttggtagtactgaaacaggaagaattgtctcctggtttgatttttcttactttcaattgctttctctgttcctagtggctgggcttcccaaatgtgatgttggtgaataggcttcattttgaaagagctggaggtattgtctttagaaattggaggatggaatcttacctcttaacacatttgttgagtagcagacatgaccttggaatgactgtgaaaattacttttcaagtttatacctcatcagtaccaaagccagatcctcctgtgatgtagcaggaagccctttattagtttttctctatcaatccatcttttataatttccaaaataggataaggagaagcttaaatatgaaatgtatttaaaggtcttatcctaccagttgtttcctgtgtgtaaatgcctaatttcctgtttggttaaggaactgttctcagacttctgtggcattgagtcagttgctttggttaattctgttctctgagagtttatcctgatctctacctagacaagttaataactgtcagatatcattcaaataaatgataagtagtaaggatttggttctttctttttgattagcctttcctgaatgcttgttactttctaagcctgcagacttcaa

SEQ ID NO: 209933 - DNA, 539 bp, Homo sapiens
taccaaaagaagcatcataaattcagactgcctggaggcatttagatgtagacgaacatctgatttatagaatgattctctaaaacatactttaataaatttaaactatacacaatgactagaatcaagctattagaggatcagagaagacccattccttaattattaagttgctctgcaactacaatttaaaattttaattccttcagcaaatgactattgaagtttattatggccagttttacttttgtttttttaaagacggggtctcactatttttcccaggctggtctcccactcttgggctcaagcaatcctcccgcactcagccagcctcctgagtaactgggattaccagttactgtagccagctcatattatggccagttttagagacaactgccaagatataattgtatatagctaatgatagatataaatattttaaaatgctatttggagccaggttttacatgcttaatttctcaattttttttttctttttttcttttcttttttttttttttttttttgataga

SEQ ID NO: 209934 - DNA, 830 bp, Homo sapiens
gcctcttctcttgtctcctcctcctcccattgtttcccttttgccggtttgcactgttccagggagtcctttttcatgtctttaggagttgcatgagaatcgtcaatatttgcacttcatgtatttatttttcagcagactgagctgaaacattggttcaatcgatgtctcagtcctggagtgtgggttcagggaagcaaagccatgttgaaatcgctgtttgccatactagaaaattgggttttctgaggcaaagtccattaaggaaggctagatgcttataacattgcccatcattggtgatggtgagggaggtgggtataatagtataaagaagaaagctcacctgctttggcgtcatttcggattggtttgggtaggatgagagagtggagtcacatttatatccatctcagccttagtttcttcaagtaatgagacttaccttcaaaggacttataaatttttgtaaaatactttgccaatagtgaacttcccagaaaggttagtttctttcccttgttcctatgaagttttacctgattctaactcagaaataactgtattgacattttttgcttttgtcatgcttgagaaaaagcacacagatgaggcgaagtggcttgggtgtgaattttcttactttgtcaggggctttctcattattgaccttttgtctacttgtagataatatctctgcagcttgaggcatacttgcacacaccgtgtttacccagcagggagaacttcaacccactttattgcagtagctacttgacatattttggcagggatttaaaaaccaaaggttttgaaagggaccagcaatt

SEQ ID NO: 209935 - DNA, 656 bp, Homo sapiens
tgtagttatagattttagaagcagaagaaaattttctaaaacagccaaacttagattcaggttctagcagagccacatgctgaatgactgcaggcaagttaccaaacttctcagtctcaatttcttaatatgtagcagtgggacaaaatttctggaacacaaagttttgtaggggtgtttttcaaaatgtgttcaattggcaaatgtttctcaaatagaattttcatagttaaataacccatagagcgtcactctaaatgttcctttactacatgctatctcagtgtgcgtcacaagtttttgcgcattgagaattttcaacaaagtagaaaagtattcagcacttctgaagcctattagattgcagatttttttccccacagcatcttgacagaccagtgttccacagatcatcctcaagggaacacaggtatgatcatgtgaatctcatcccataatagtgtacaagacatcttgcattgtgcttggcacatagtagccactcaataaataattatgtattctttagagtaaatttctaagcctcaattttcttacttgtaaaatgaaggtaatattatggactttatacatttactatgataattaaataaaatcatggcatagaaaatgaaataattaataaaagtcctgtt

SEQ ID NO: 209936 - DNA, 114 bp, Homo sapiens
gtgctgctggctctcccaaaacccagcccgaaagaatgagaggagggacaagatgtagaatgcaatggcatggcatttattgagcactactgaatgtcatcaccgcatatttca

SEQ ID NO: 209937 - DNA, 201 bp, Homo sapiens
aaatgattaacccacctcggcctcccaaagtgctgggattacaggcgtgaaccaccaagccccgccaggatttcagttctttggaaaggcttagcagtgctttccttggtaccttgctagctttttcttcttcttcttcttcttcttctttttttttttttttttgagacaaagtctcactctgtcgcccaggctggagtg

SEQ ID NO: 209938 - DNA, 541 bp, Homo sapiens
gtggagaggtggggctagaagcccagttggattggttttaaaagagactatgatgtaaggaagcaactgttgacagttcttgcaagaaagctgtgcaaagaaatgggcagtgatgggaagatgtgatcagaagtggtttaagtcttactttgtttaatcatagggaagtatggcattcttccctattacaatgtgttgatggcaggcactgagtcttgctagtcaatatccctgcgttctggaatgggcatggcacatagtaggtccagtgacaaatatcgagttaaactagccaagctttcctttttttaaaacaatgctccatcttatgtatagtgattttgccttttcagaatactttcatgtttataattttattttaattacaacactctgcagtaaataggacaggccttgttccctgtttgacagaagagtaaactgaaacatggaaaggttaaaaaccttgttcaagatccacagatatgccaattctttactcttctcactagaccacaccacccctaatcattagagactt

SEQ ID NO: 209939 - DNA, 180 bp, Homo sapiens
gaagccaaagcaaaataacatctcaaagactcactattttttgaatactatggatgagtaccaagcgaaacaaaaacaaacaaacaaaaaacagaaaagaccaactccaaaactctgagtatataaaatggatgacaataaattacaaaggttgagaatccctaacccaaaaatccaatc

SEQ ID NO: 209940 - DNA, 394 bp, Homo sapiens
agcatgtattaattcatatattattcatataaaatggactaaacttgttagtctatgtcttagaggccaaatgaacatgggttcaaatatgagccacttgttattggctagaccctgatgagagactgctagtcgtacccaaagtctcatcgccaactgttgaacattttagtaataacatcttctacacacttgtctgtaaagaagccctatgcagccttctatgtagctgtgtataaccatgaccaaattttacccactgggatgttggtgtaagtaagatgtgcaactttggtacaggacattaagaaaaaaactgtggcgaattctgaattccttccactttgtccctgtttctttttctccctcttggctggaacagagcaaaatcagc

SEQ ID NO: 209941 - DNA, 115 bp, Homo sapiens
tacacttctgtttaaaccctggacctgctccaagttctcttctgtagctttgtgtacactgttttctctatgctgtcctctcaccgattttcttttccccgctaactccctatgt

SEQ ID NO: 209942 - DNA, 293 bp, Homo sapiens
acgcctggccaagcctggcatactgttatgttccacttggaagctacagttgtagagctaatcacttgggaaagaatcaaggagatgctcaaacagaagcagatgtactatggcaatggaaccctcaagagagagagcaggagtagaactgtctttataagaacctgatgtagaactcataaacattcaagtgccatagatggtttaaggaaaactttatgaacagtgtgggaaactaccatttatagttttctcaacaggatcaaatcagccaattagaagggtacacagat

SEQ ID NO: 209943 - DNA, 397 bp, Homo sapiens
tgggcacttagcaggtgagacgctgccacacacgcgatctcgggcgtctctggcctccgcggggtgctcttgtacccccgtctccccttaccatccgtgggcacaggcctggcccccctcgcatccgccaaggctatcgaccccgaaacgacgcggtgcgcaagtggccacgacacctaggcactaagtcattttcccgaggtagcggtaccctctgctccaacgaagccaatctccagaaaacctaacagactcaaggtaagggaggctggggaaacccttcgctagcctttcggtggccctaggcggccgaccagtcccgcctctctggggagacccctctgcgtcaccgtgacgaaccattcccacgcaggtgtccctcttctcaaggcggccg

SEQ ID NO: 209944 - DNA, 612 bp, Homo sapiens
actttacccccagtatatattttaggtgcatacatatctccatttctacttacagcaccaaaataagccactatccactctcacctggactactacatagcataagttgtttctcttgctacctcttatctcttgctaatcaattatcctaatgctattcaaagtaaagttttaaaatctaaaacaatcaatgacttgccatcaaatatcaaataaaacccaaactccttgccatgacctagctagttaagatgttttgtgttggcaagctgcagaaaacccaattccaactaccttaaatggtatcaaaatgcactgactcatatcattggaaatccagaaactacagaggcttcagggttgacttaacatggctctggcttggatttactttgattctctaggttttatccttctttatgtggctgcttatcctttcagatggcagcaagataactgtaagagttccagttttacatccttcacaagagagtagccagagaaagaaataaaagttgcctctcataatcttccagagaatgaggaggttcccagaagcctgaaggaagccatttctggggcctcaccggctgtgcaccggtttctatcctg

SEQ ID NO: 209945 - DNA, 474 bp, Homo sapiens
ctcgtccactctggggtcctggagccactggtgaatctgctcactgccccagatgttaaaattgttctcatcatccttgatgtcatctcttgcatcctccaggcggcagagaaacggtctgagaaggaaaacctgtgtcttctgatagaagaacttggtgggatcgatagaattgaggctttacagctgcatgagaaccgtcaaattggccagtcggctttgaacatcatcgagaagcactttggtgaggaagaagatgagagccaaactttactgagccaagtcatagaccaagattatgaatttatagattatgaatgcttagcaaaaaaatagccaagctccctacctcctaaaccaacaacccagtgctaaaggataacttctttaagaagcagcagtcctctatcttagtgtaacccaaatgtgaagcttttaaaacttgacattaataaaatgttcaacactttcacg

SEQ ID NO: 209946 - DNA, 728 bp, Homo sapiens
catggatgtcatcagcattgacaagactggagagaatgtccgtctgatctatgacaccaagggtcactctgctgttcatcatattacatctgaggaggctaagtacaagttgtgcaaagtgagaaaaatctttgtgggtacaaaaggaattcctcatctggtgattcatgatgttcacactatccactaccctgatcccctcatcaaggtgagtaacagattcagattggtttggagactggcaagattactgattttatcaagttcaacattggtaacctgtgtatggtgactgaggggtgctaacctgggaaggataaccagggagagacatcctggatcttttcatgtggttcatgtgaaagatgccagtggcaacagatttgtcacccacctttccaacatttttgttattggcaagagcaacaaaccatgaacttctcctccctgaggaaagggtatctgcctcaccattgctgaagagagagacgagagactggcagccaaacagagaagtgggtgaaatggtctctagagacatgttagaaagctttttgtacttaattaaagataatatagcatgaagaaaagatcattcatcatgaccaagttggatttatcccaggaatgcaaggattgttgaacatacacaagtctatgaatatgatacatcataccaacagaatgaaagcctaaaaccatatgatcatttcaacagatgccaaaaa

SEQ ID NO: 209947 - DNA, 406 bp, Homo sapiens
catggatgtcatcagcattgacaagactggagagaatgtccgtctgatctatgacaccaagggtcactctgctgttcatcatattacatctgaggaggctaagtacaagttgtgcaaagtgagaaaaatctttgtgggtacaaaaggaattcctcatctggtgattcatgatgttcacactatccactaccctgatcccctcatcaaggtgagtaacagattcagattggtttggagactggcaagattactgattttatcaagttcaacattggtaacctgtgtatggtgacaaatctgttgcactggcatctttcacatgaaccacatgaaaagatccaggatgtctctccctggttattcttcccaggttagcacccctcagtcaccatacacatgtaccaat

SEQ ID NO: 209948 - DNA, 248 bp, Homo sapiens
agttattgttatccttaggcaaggtttttgtgagtgaagaaaataatctttagtggctggtatgtttgaattaggcctttatcatttaacttatttgcattttaccaacattttaaaaatatttaaaacctaaatacagaggctcctcccaccttaatctcaatactgctatgtagtactggtgaacaactttggagaacctagatttattttaatattctaatagataattaaattttaaaatgata

SEQ ID NO: 209949 - DNA, 813 bp, Homo sapiens
gccaaggcaggcagatcacgaggtcaggagtttgagaccagcctggccaaaacggtgaaaccccgtctctactaaaaatacaaaaaaaaattagccaggcgcggtgccgggtacctgtaatcccagctactgaggctgaggcaggagaatcacttgaacccaggagacggaggttccagtgagccgagatcgcgccattgcactccagcctgggcgacagagccagaatccatctcaaaaaaaagaatgcagacactttattcaggcctgttactcctcatatttggggttagagaatgaaaggctcttttctccctctagtggctttttctgtatttctaccttctcagcttgctgtgtctgtggccagcaatctagacaaatttaatagttcacaagatagtcattcttacctttctatcctcctattctatttccttacctaagtttggttgattttagcaactcagatttaccctgttaggaaattgcttattccagtgatcggggttccctgttcaaaagtatccatgtcctggctgggcatggtggctcacacctgtaattccaacactttgggtggctgaggcagcaggatcacttgaacccaggaattcaagactagcctgggcagcatagcaagacccccaccccttacaaaaaaataaaaaattagccaggcacagtggtgtgcacctgtagtcccagctactcaggaggctgaggcggggggaatctcttggggccaggagtttgagaatgtagcaagcaccactacactccagcctgggcaatagagtgagaccctgtctc

SEQ ID NO: 209950 - DNA, 171 bp, Homo sapiens
gggatgaggctgacacaagtaaaatgaaagtttgtggtaagtactaacatgatctttattttacattccattatctctgatcaacctcatccttaagttcatatatacatgattattataggaaaataagtattggtaaggatgtggagaaatcagagccctcatacattg

SEQ ID NO: 209951 - DNA, 428 bp, Homo sapiens
tgaaccaataagtataatgcagatattccaaatctgaaatctaaaaaacttctggtcccaagcattttggataagggatattcaatctgtactgtatgtcaagaacagtgcctggtagatagtaaatatacaataaaatgtggttcttggccaggcgtggtggctcacacctgtaatcccagcactttggaaagccgaggtgggcagatcacgaggtcaggagttcgaggccagcctgaccaacatggtgaaaccccatctctactaaaagtacaaaaattagcctggcgtggtggtgcgcacctgtagtccaagctacttgggaggctgaggcagaagaattgcttgaacccaggaggcggaggttgcagtgagccgagattgtgccactgcactccagtctgggcgacagagcgagactccattta

SEQ ID NO: 209952 - DNA, 274 bp, Homo sapiens
ccatgccctcatacctatggttctatctaaaacatgacctctattcaatctcaagatcccactcaaatgtcacctgtgataagccttccctaatcctagaatagtagttctcaacatgggcaattgtgacaatttctggagacgatcttgcttgtcacaactgtgtgtagtgagggttctactaccatctagtgggtagacgtcagggatgctgctaaataccccaatgtaaaggacagccctccctgcccccagcaaagtattagcccaaaat

SEQ ID NO: 209953 - DNA, 180 bp, Homo sapiens
ccaacgctgctcacagtaagcattccaataacagaagctactattaaatccctctcaacttgtcattaatgttcattctaaaaacaaaatacttcccattagaacaccacactggagtatgtgggattaaatgtctcctatcactggtggattttattattgtgattgtgagagcgttgg

SEQ ID NO: 209954 - DNA, 330 bp, Homo sapiens
cacctcccatcaggcccacttcaacattggtgattatatcaaaacatgagattggagaggatgtctaaaagatatcagctaagataagaaatgtattttgtttttaaaggtaatttttaaagaatgagtagaatatttaaaagaagctaaataaacacattttaccttttaaaaaaatatttcagatattttttcaagaaaaatagagtcttttaggcttcttctaaaagattgttatcttgtttattgttctaatagcattcttgattgatagtataagctttctagttgaatataaagcagaagcctcactgatgggagaagactgcg

SEQ ID NO: 209955 - DNA, 552 bp, Homo sapiens
gtaggatgtatgaacggaaaacaccacaagtccaggggcaatgcagcatctctgccttcttctgggtattcctcttaaatggcttgacaataaccaccaaccagcactgccatacatgtgtcctgtacctatcagaggcactagggcagttttggaacagagagcccatagaaaggctactgcttagagatagccattttcttcttggagctggaccagtgaattagacgcatggaggagagctggaaaatccctttttggaagagctacacaaaaccaaaatttggaattcgtagctaataaccataaaaattaagaaatgactgttggaagagcactggaaatcacctgattaagttaagaaaaaataactagctcatgagaaaattattttcaggccagctgtagcctgtacccttttgaaaatcccctgactagtgagttcatttttgttggaatatagaatttttcttttctaagcagatgtaaacttgtctttctgtggttggctttggagcccacaagataattaaatggcagtgctaactgaaa

SEQ ID NO: 209956 - DNA, 650 bp, Homo sapiens
aggagtggtgcagaaaaatggcctgtgctacttcgcagttggaaaaaaccaacgtcatgctctctggcattatacaggatcacaagaaaagtaatggtcgtctaacttctacgtaaaaataacatcagtaactgggcaatgcagcatctctgccttcttctgggtattcctcttaaatggcttgacaataaccaccaaccagcactgccatacatgtgtcctgtacctatcagaggcactagggcagttttggaacagagagcccatagaaaggctactgcttagagatagccattttcttcttggagctggaccagtgaattagacgcatggaggagagctggaaaatccctttttggaagagctacacaaaaccaaaatttggaattcgtagctaataaccataaaaattaagaaatgactgttggaagagcactggaaatcacctgattaagttaagaaaaaataactagctcatgagaaaattattttcaggccagctgtagcctgtacccttttgaaaatcccctgactagtgagttcatttttgttggaatatagaatttttcttttctaagcagatgtaaacttgtctttctgtggttggctttggagcccacaagataattaaatggcagtgctaactgaaa

SEQ ID NO: 209957 - DNA, 901 bp, Homo sapiens
  misc_feature (901)..(901): n is a, c, g, or t
gtaggatgtatgaacggaaaacaccacaagtccaggggcaatgcagcatctctgccttcttctgggtattcctcttaaatggcttgacaataaccaccaaccagcactgccatacatgtgtcctgtacctatcagaggcactagggcagttttggaacagagagcccatagaaaggctactgcttagagatagccattttcttcttggagctggaccagtgaattagacgcatggaggagagctggaaaatccctttttggaagagctacacaaaaccaaaatttggaattcgtagctaataaccataaaaattaagaaatgactgttggaagagcactggaaatcacctgattaagttaagaaaaaataactagctcatgagaaaattattttcaggccagctgtagcctgtacccttttgaaaatcccctgactagtgagttcatttttgttggaatatagaatttttcttttctaagcagatgtaaacttgtctttctgtggttggctttggagcccacaagataattaaatggcagtgctaactgaaaaaaaaagaaatgcgctgttggccaaaggggggctccgggacgttcccttagtgagggaaattatagccttctcctgactcccggctggggattaggtgcagaagcggatccgctcatcggggcgactccgtgttccacgaataggggaaacaagaaagatattggacagcggcaggtagggccgcaacctaaggccggtgttggagggtcgtcggccgagcctggagtgggatatacggggctagggcagggggaagcggagatataagaccagacgttcatgagactacattgggtttggttgtccttgttagtgacgggtcttttccttgagacgggagttgtgtan

SEQ ID NO: 209958 - DNA, 475 bp, Homo sapiens
tgaaatgttctctccaatatatttagcttttgaaacttcatgagagtgaatggaaattcattcaaatctggctttgtaatgagtggttcatggtttttggtttgttatttttaacctgacgtatctggaaacgttcccctccccagacttgtttattggctctcctgctctctctcctcaagatccaaagctaaaaaacatgctgttgaaaacaaaacaactctagccaagggaaatctatgcaatggaaaagggattctccagaataaagtgtaacctcaaaactgtgcatattatctctcaaacaggatgagtaccttctcactgccaaagtagttggagggacatcaaacaccagtgatgggaacactgaacctcacataaggtaaagcgattcaggaaagttttggtaagctctcaggtcctgaatatagatatataaacttaggaaatggttttctctgctgagcggttt

SEQ ID NO: 209959 - DNA, 573 bp, Homo sapiens
tccttccacccaaacaccatcctttatgacggaaccaaccccgggagcccctttgagggcaatgcagcatctctgccttcttctgggtattcctcttaaatggcttgacaataaccaccaaccagcactgccatacatgtgtcctgtacctatcagaggcactagggcagttttggaacagagagcccatagaaaggctactgcttagagatagccattttcttcttggagctggaccagtgaattagacgcatggaggagagctggaaaatccctttttggaagagctacacaaaaccaaaatttggaattcgtagctaataaccataaaaattaagaaatgactgttggaagagcactggaaatcacctgattaagttaagaaaaaataactagctcatgagaaaattattttcaggccagctgtagcctgtacccttttgaaaatcccctgactagtgagttcatttttgttggaatatagaatttttcttttctaagcagatgtaaacttgtctttctgtggttggctttggagcccacaagataattaaatggcagtgctaactgaaa

SEQ ID NO: 209960 - DNA, 477 bp, Homo sapiens
gtaggatgtatgaacggaaaacaccacaagtccaggggcaatgcagcatctctgccttcttctgggtattcctcttaaatggcttgacaataaccaccaaccagcactgccatacatgtgtcctgtacctatcagaggcactagggcagttttggaacagagagcccatagaaaggctactgcttagagatagccattttcttcttggagctggaccagtgaattagacgcatggaggagagctggaaaatccctttttggaagagctacacaaaaccaaaatttggaattcgtagctaataaccataaaaattaagaaatgactgttggaagagcactggaaatcacctgattaagttaagaaaaaataactagctcatgagaaaattattttcaggccagctgtagcctgtacccttttgaaaatcccctgactagtgagttcatttttgttggaatatagaatttttcttttct

SEQ ID NO: 209961 - DNA, 424 bp, Homo sapiens
tctagaagttggagcagataacttccaaaataaggtaatttaatctagttgcatcctcttttcaaaatacagaaatgttagattcaaaaagcatattaaaaataactaatgcttaaccaagtttgaaagaaagaagttttttgatgtcagaaatgaaaaggacctgaaaggcacagcttttaggcccgtgggatacccagtatcaatataagccccaagaactcaggttttggaatacatataggaatagaagacatagctttggatcttatgggtgggagttctaattaagacctctttatgaagtgaccgtctcaaggaactccgctccatgaaatgacaagacataacttcccgccaaattagggaagctacagaggagattgtcattggcctggttattcttgatgaaggaagaaaaatc

SEQ ID NO: 209962 - DNA, 566 bp, Homo sapiens
acgttggccagtctggtctcaaaactcttgatctcaagtgatctgcttacctcagcctcccaaggtgctgggattataggcgtgagccatcatgccaggcctacagaaatacgtctattggtaggggaaatagaaagaatcaatggaacacctgtatgtacctactgttcatccttatcccacttaaaaaatatatgtgcaatggcagagtaatggaatattttaagacttagaaagactctaggcaacttaggcaaatgctctcatttcacaaaagataattaaatggctcggaaggtcccatagctaattagaggcaataatgagattagaacacctatctcctaattgccacctagcctaatgctaagatcactctaccacagtatcagtccccttagttactcgatgtctaaggtggtccattattgaacaatacaatttttttttttttccgagacagagtcttgctttgtcacccaggctggagtgcagtggcacgatcttggctcactgcaacctccaccacccgggttcaagcagttctcctccctcagcctcccaag

SEQ ID NO: 209963 - DNA, 243 bp, Homo sapiens
tatgctgcccttttaattcctgattagttggttaaccactatttctaggtctttaaaaaatagttaatatttttttctttattgagatgttattcacataacgtaaaactcagctctctacagtatacagttcagtggtttatagtatattcactgtgtagtattctaatatattcactaactgcagaacacttccatcacctcagaaagaaaccccttccctgttagctgtcactccccatt

SEQ ID NO: 209964 - DNA, 577 bp, Homo sapiens
catatctgtcaaaatcccagctgtcatttttatagctgtacacactgatacttaaaggaatgtgaaataacagtgacactttgggaagtattttggcagtttttttaaaaataaaatgtaagaaacagaaaaccaaatactgcacgttctcacttataagtgggaactaaatgatgagaactcacgaatacaaagatgggaacaacgcatatggggcctatcagaggctggaacgtgggagaagggagagaatcaggcaacaagttgacaaatggacatgaatttcacctctgagagtttcataagctggtattgtcctgacattgcaaagtgtttaccacaaagatcctgtacatccatcatccagggccagcgtttgcctgattctaattccactgacattgaaatctacagctctctgtgagtcatttatcacacttattaaaatgttccattgtgaattggaatagcaattcactattatttcagagtgctgcccaaggggcattctatgcagcaaatcttaatgctttattgaaatagtagtttggttttaataaatgattctttgcaaaag

SEQ ID NO: 209965 - DNA, 447 bp, Homo sapiens
cagccccgaccattagacgctaacccaagttttttttgttttgtttttcattttttctgctacatgttataataatccaagtttcttttcgatgcttgcctattgtcttacaaaactcctctgcttcctgaaagccaaccttaaacagccatccatgccctacctgttttgtccttaattatttttctggccacttttctttaacttctgtgctacaatcctacaatcctgatcttaaaagcctgggtttttaaatatctattttttgcttttctctccaattcctccaatttgttactaaaatattgacaattaagccctcagaacaaacttttttttttttttttttttttttttaaaggggtccccttgggggggggaacccctaaaatccacccgggggttttccaacttgggcaggggcggttttttaaacccttttggcgg

SEQ ID NO: 209966 - DNA, 1185 bp, Homo sapiens
tctaagaattttgcttagtttcagcacagtatggtaatgtattttcatgaggttaagaaaaaaaagtcctaagatattttataaaatcaattaacaaatgcttctaaagttcagtcttcaggcatctgaaaaatggttaagtataccatctaaataatccccactactaaataatctccaaggcaggatctaggtactgcaaagaccaagttcacagatcaccgaaaggaacccttaactcacaaacagtccctaaacctgtggtgtaaaacagtggttccaaaattcagctgcatttcagtattgtctgagaagcttctaaaaaatagattctcgtggccgggcatggtagctcacacctgtaatcccagcactttgggaggccgaggcgggtagatcacgaggtcaggagttcaagaccaccctggccaagatgtgaaactccatctctactaaaaatacaaaaaacagccgggcatggtggcgggtgcctgtaatccccgccactagggaggctgaggcagagaactgcttgaacccaggaggcagaggttgcagtgagccgagatggcaccaccacactccagcctgggcgacagagctagactcatctcaaaaaaaattaataagattctcaatcccaccatttccagaggtggagtccaacatccatggtcttaaaaaatttctaattattctaatgcaggcttattctaatgtaggccagtctcacatctatctaagtgcaggatttctcaacctcagcagtgttgctatttgggactggatacttttgctggcgggcagggaggaggctatgctggacactgtaggatgtttagcagtatccttggcctctaccctccagaagcacactgcccactcccagaggtgtaacaagcaaaaatatgtccagacactgccaaatgtttcctggggggtgaggggggaaccacccccaactgagaactcttgaactagagtaaatcaaaagacaatcatttgaagttaagaaaggaaagaaatatgaaagctgtttaaagccaagaggccagatctttttttcagtacattagaaaaagtagcagccaatactggggtgcagaccataacttctaaggaccaagtcaatgctgagttttagttgagcagatagaagagctttattttcactatcatttactc

SEQ ID NO: 209967 - DNA, 465 bp, Homo sapiens
tctaagaattttgcttagtttcagcacagtatggtaatgtattttcatgaggttaagaaaaaaaagtcctaagatattttataaaatcaattaacaaatgcttctaaagttcagtcttcaggcatctgaaaaatggttaagtataccatctaaataatccccactactaaataatctccaaggcaggatctaggtactgcaaagaccaagttcacagatcaccgaaaggaacccttaactcacaaacagtccctaaacctgtggtgtaaaacagtggttccaaaattcagctgcatttcagtattgtctgagaagcttctaaaaaatagattctcgtggccgggcatggtagctcacacctgtaatcccagcactttgggaggccgaggatctggaccagactgtcgggggcttggtaactccatccagaacatcctcagggaggagatgtcagcggaaaagagg

SEQ ID NO: 209968 - DNA, 513 bp, Homo sapiens
gagttttggaagctggcagtgcacccagtcccggctctcctccattctggtgggtctcaccagagattggccaagaagagatcaaactgttcctggaccaaactgagggtggggctgctatctctcgtggcccaataacgagatgcagatgaactggggagaaagagactttttatttctgtaaccagttacaaggagaagacctggaaattatctccagaccaactcaaaattacaaagttttccagagcttatataccttctaagctatatgtctatgtgtaagtgtgcattcatctcaagacgtaagtaattgacttatgttaatctataactaaggtctgagtcctgaagaccttcctctggatcctcagtaaatttacttaatctaaaacccttatcttgtctcctaaatcatgggggtttgggaagttccttcagacccccagtaaacttatttgtggagtcctggggaatttcttcagatccccaataaaacttatttaatcctaa

SEQ ID NO: 209969 - DNA, 657 bp, Homo sapiens
gttttgtattgttgcccaggctgatcttgaactcctggggtcaaggattctgcccgccttggcctcctaaagggctggaattacaggcataagccactgtgcccggccagtttatataatttaaacactgccttttggttccttgattcccatatgctaggacaagtaattattattttattttattttactttaagttctgggttacatgtgcagaacctgcaggtttgttacataggtatacatgttccaaggtggtttgctgcacctattgacccatcatctaggttttaagtcccacatgcattaggtatttgtcctaatgctcttcctccccttgccccccaccccccgacaggccttggtctgtgatgttcacctccctgtgtccatgtgttctcattgttcaactcccacttattagtaagaacatgtggtgtttggttttctgttcctgtgttagtttgctgagaatgatggtttccagcttcatccatgtcgctgcaaaggacatgaactcattctttttatggctgcatagtattccatggtgtatatgtgccatattttctttatccagtctatcactgatgggcatttgggttggttccaagtctttgctatggtaaatagtgctgcaataaacatacgtgtgca

SEQ ID NO: 209970 - DNA, 223 bp, Homo sapiens
ctgtatcccgggaagaggtagggctggggtccgaataatcaccacttggtgggggtttaagcccaagccaatgaaatgaacataaaaattagctcagtgcggtggtgcatgcctatagtcccagcaacttggaaggctgaggtgaaaggtttggttgtgccctaattaccacctgatattctatatatttattttttaatttatcgactgactccccaatctc

SEQ ID NO: 209971 - DNA, 538 bp, Homo sapiens
agatgagatagattttcttattatcccgattttacaaatgagcaaacagaggcacaagcaggttaagaaacctccccaaggttaaacagtgagaaacagcaaagatttgaacagtgagaaacagcaaagatttgaaacagcaaagatttgaacctattgttcgggagtccatgctgttactcatttctttatgctgccataatctaatataaaattgaataacaataaatgcaccttatatttgtatagctatacacactaatttacatgatcttcataagaactatgaaatggctgtgattatccccatttttaaaatgatactataaaggcataaaatgctgtatttatggtatgcaaccctttggtgaacaaccctataaatatttaattacttatattgatgttcttcctacgtctaagaaaaatgttatttccattcccaagatgttagtagagacgaagatttttcaatttgtctccttgattttgttggattatagcattaaagttatttttacaaagccatctacggtaa

SEQ ID NO: 209972 - DNA, 2421 bp, Homo sapiens
gcggccgcaagcacgggggcgaatccccgctgggtcgagggcctgaacgggagccaatcgagcagccgaggctactgccaatcacgcggctccctccaatcccacccgtgccatttccaaaatctcggtcccactgtgcagctcaaatgtggtgttcactctgccaatcgctggaggatagagtgggaacaggaataagcagagttaagaggccaggacaaaagaagttaaagagcgcccaatacatacatgtttttgaaggcgggcagagggaataaagtccccccagtgagggtctatgggcctgattgtgtagttctgatggagccccctttgagcaagaggaacccgccagcgctgagattagcggatttggcaacggctcaggtccagccgcttcagaatatgacaggcttcccggcgctggccggcccgcccgcccactcccaactccgggccgccgtcgcgcacctccgcctgcgggacctgggcgctgaccccggcgtggccaccactccgctcggacccgagcacatggcccaggcgagcacgctgggcctcagccctccctcccaggcgttcccggcacacccggaggctccggcagccgccgcccgtgctgcagccttggtcgcgcaccccggcgcgggcagctacccctgcggcgggggcagcagtggcgcgcagccctccgcgcccccgcccccagcccctcctcttcctcccaccccttcaccccctccccctcccccgcctcctcctcctcctgccctctcgggctacaccaccaccaacagtggcggcggcggcagcagcggcaaaggccacagcagggacttcgtcctccggagggacctttccgccacggcccccgcggcggccatgcacggggccccgctcggaggggagcagcggtccggcaccggctccccccagcacccggccccgcctccccactcggccggcatgttcatctccgccagcggcacctacgcgggcccggacggcagcggcggcccggcgctcttccccgcgctgcacgacacgccgggggccccaggcggccacccgcacccgctcaacggccagatgcgcctggggctggcggcggcagcggcagccgcggcggctgagctgtacggccgcgccgaaccgcccttcgcgccgcgctctggggacgcgcactacggggcggttgcggccgcagcggcggccgccctgcacggctacggagccgtgaacttaaacctgaacctggcggctgcggcggccgcagcagcggccgggcccgggccccacctgcagcaccacgcgccgcccccggcgccgccgccgccgccggcgcccgcgcagcacccgcaccagcaccacccccacctcccaggggcggctggggccttcctgcgctacatgcggcagccaatcaagcaggagctcatctgcaagtggatcgaccccgacgagctggccgggctgccgccgccgccgccgccgccgccgccgccgccgccaccgcccccggccggcggcgccaagccctgctccaaaactttcggcaccatgcacgagctggtgaatcacgtcacggtggagcacgtgggaggccccgagcagagcagccacgtctgcttctgggaggactgtccgcgcgagggcaagcccttcaaggccaaatacaagctcatcaaccacatccgcgtgcacaccggcgagaagccctttccctgccctttccccggctgcggcaaggtcttcgcgcgctccgagaacctcaagatccacaagcgtactcatacaggggaaaagcctttcaaatgtgaatttgatggctgtgacaggaagtttgccaatagcagtgatcggaagaaacattcccatgtccacaccagtgacaagccctactactgcaagattcgaggctgtgacaaatcctacactcacccaagctccctgaggaagcacatgaagattcactgcaagtccccgccaccttctccaggaccccttggttactcatcagtggggactccagtgggcgcccccttgtcccctgtgctggacccagccaggagtcactccagcactctgtcccctcaggtgaccaacctcaatgagtggtacgtttgccaggccagtggggcccccagccacctccacaccccttccagcaacggaaccacctctgagactgaagatgaggaaatttacgggaaccctgaagttgtgcggacgatacattagaatttattattaataataataagtgaaataataagtgggagtccttggaccacatcctaacctgagacaatgccgagcctgagacaaacccgtgactcagacttgccaccgggtctaattagccctatttattcagtatgaaaccctatggtgtttgtacatttaattaatttaattaag

SEQ ID NO: 209973 - DNA, 768 bp, Homo sapiens
agagatggggtttctccatgttggtcaggctggtctcaaactcctgacctcaggtgaactgcccgcctcagcctcccaaagttgattgctattaatataatcctatagttaccagaacacgtatactagaattacagtacactgaaatggtcaaaaggcaaataaaatagaaataagaaaatttgatgaaaatctggagaattaagtctttctgtaattgagagttgattttttgattgtggaatccttgaaatggtttgaaagaatgatgtgacttgaatgggctttataaacacagcctggtaaggatagctgtgacagcttgggacagtggatttggggtaccaccagttaacatttctggccctgttttcctgtctttaaagtggagataccaactcagaatagtaatgtgaggattaattgaggtaacttatgctaggcactgaacagtgcctgatacagtattgataatgctgtttctttttccatgtgtaataacacaggtgaactgcctaggagtgccatacatagatgagcagtagctactatgtcagtgttccttttgttcccttttatgagtgcattttgttttgcattttcttgtgtctgttgtggcttaagggataagatttgtgtgtctgaaatgctgtgctaaacaggacgttgttccttgtggaatacttgggtaatatggtttcctagatttcatattcactatttctactttgagagtctactgttaggaggcttctgtgttcaaagaaa

SEQ ID NO: 209974 - DNA, 825 bp, Homo sapiens
agagatggggtttctccatgttggtcaggctggtctcaaactcctgacctcaggtgaactgcccgcctcagcctcccaaagttgattgctattaatataatcctatagttaccagaacacgtatactagaattacagtacactgaaatggtcaaaaggcaaataaaatagaaataagaaaatttgatgaaaatctggagaattaagtctttctgtaattgagagttgattttttgattgtggaatccttgaaatggtttgaaagaatgatgtgacttgaatgggctttataaacacagcctggtaaggatagctgtgacagcttgggacagtggatttggggtaccaccagttaacatttctggccctgttttcctgtctttaaagtggagataccaactcagaatagtaatgtgaggattaattgaggtaacttatgctaggcactgaacagtgcctgatacagtattgataatgctgtttctttttccatgtgtaaaatgggcataccactagtctcttgggtcagtaatgcatttcagccaaatgaaataaataacacaggtgaactgcctaggagtgccatacatagatgagcagtagctactatgtcagtgttccttttgttcccttttatgagtgcattttgttttgcattttcttgtgtctgttgtggcttaagggataagatttgtgtgtctgaaatgctgtgctaaacaggacgttgttccttgtggaatacttgggtaatatggtttcctagatttcatattcactatttctactttgagagtctactgttaggaggcttctgtgttcaaagaaa

SEQ ID NO: 209975 - DNA, 407 bp, Homo sapiens
cagttagaacacccactgtacgactctcaattgtttgcaaatttgcttccaaaactcaggaatgcactactcaactgaggccgcatttgagagcacacactcaatacttcctccaataaaagaaattttcatctcagctgtacactcagagaccaggatttttttcgcctatatgttgataaaacccaatgacgcatagctgagcaagtctttcacctaacagcacaccaagcttctaatggaaaattcacagaccaggtgatgcagtcaccatacagcatacagacacaatatttgcactcttcctatcccctcccctggaatccagactcagcctgctcactctgaaagctttctcagttcatcctgccatttgccccttctcccaagccacctctacacccggg

SEQ ID NO: 209976 - DNA, 511 bp, Homo sapiens
gatcgcaactcctttccttgacctataaggccctgcaaggtctggccccactgatttcaaggatcagcctccctctggccagtgggcttccaccctgtgcacctccttgcacactggaaatacaccagccttttcttttcccacctcacaccttcccacatgctgtgccttctgccccaaatgttctcttcattttgcgtggcagctttttccttttccttcagtgtaaatgtcacctcctctgagaagccttccctttccattttgtctaagtaagaacctagttttgaggaaaagccctatatattcactttaatttttttttttttttttgagacagagtcttactctgacactcaggctggatggtagtggtacgatctcagcttgctgcaatctccgtctcccgggttcgagcgattctcctgcctcagcctcccgaatagttgggattacaggtgtccgccaccacgccagggtaatttttgtatacttagtagagatggggttt

SEQ ID NO: 209977 - DNA, 363 bp, Homo sapiens
ccacgataactctgtgagccagcatgtattatttttctgaagggacaaataaggagctgacaccttcaaggcaagtggttaaagccaacactggaattcaagagtcctatctcataaccagagtttttttaatgttctgccacatgatttccaagcccaatccctgttttgagtctacatgatccagggctgaaggtaactttgaaagatcgtatgtgataaggagaaaatgcaactgaaataaccaaaaacacaattcagtaattatcgagtgcctggcatcttgtcagtacaattgtgaggaacgaatgagacagtatatgcgaaggaacccaccacagtgcccggaacacttccgtattt

SEQ ID NO: 209978 - DNA, 308 bp, Homo sapiens
caagccaagagccatccagcgtcagtcctctctgggtagcccaagtaaagcaggagcataccccagagagaaagttcgcagggctgttcacctgcagtgctgtggacttcaaccttcttgttccttcttcagtaagtgaaaataacagtcattgaccatgactattatcgaccgcttttgaaaatgtaaacatagtgactttattgctgtaaaaatcatacgtgtttatcatcttaaaattcaggaaacatggacaggtacaaagatgtgcaaaatatcatccaaaatcccatttgctggccaggcac

SEQ ID NO: 209979 - DNA, 720 bp, Homo sapiens
caagcaattctcctgcctctgcctcccaagtagctgggattacagacgcccaccaccatacccagctaatttttgtgtttttgttagagacggggtttcaccgtgttggccaggctggtctggaactcctgacctcaggtgatgtgccggcctcagcctcccaaagttctgggattacaggtgtgagccaccgtgcctggcctctcttccattcttaatcatctaatggaaccttaatagttttcagcagtgatgtctatatcaaggcctgctagactgacagcaagccttcattccccacagggatcttaccaagtgtggaaaaatggaatatgggaagcattcatgttaacagtggttctcaaagtgtggttcctggaccagcagcattagtaatacctggaacttgttagaaatgggaattctggcccagcaagtgactcacacctataatcccagcactttaggaggcagaggtgggaggctctcttgagcacaggggttcaagaccagtatgggcaacatagcaaaaccccatctctagaaataataatttaaaaaattagcctggcgtggtggcacatgcctgtagtcccagttattctggaggctgaggtgaggacattgtcggaatccaggcagttgaggctgcagtgagccatgattgcaccacctcactccagcctgggcgacaagagtgagagcctgtctcaaaaagag

SEQ ID NO: 209980 - DNA, 212 bp, Homo sapiens
atggggtctcaaagatgtcccagtttagatgataaattatgtgatcatctctacacttagcagtcttttccacatgcagctttagccattttgaagactctgttgtagggcatttaggtttctaccagattatccacatattgacccatattttgtcttgtgtgtttgttgcctaaatgaaatcaagaatgtgcaccttctctcaatcctcc

SEQ ID NO: 209981 - DNA, 1726 bp, Homo sapiens
  misc_feature (3)..(3): n is a, c, g, or t
  misc_feature (5)..(5): n is a, c, g, or t
ggnangagggaggggcgggggctggaggcagcagcgcccccgcactccccgcgtctcgcacacttgcaccggtcgctcgcgcgcagcccggcgtcgccccacgccgcgctcgctcctccctccctcctcccgctccgtggctcccgtgctcctggcgaggctcaggcgcggagcgcgcggacgggcgcaccgacagacggccccggggacgcctcggctcgcgcctcccgggcgggctatgttgattgccccgccggggccggcccgcgggatcagcacagcccggcccgcggccccggcggccaatcgggactatgaaccggaaagcgcggcgctgcctgggccacctctttctcagcctgggcatggtctacctccggatcggtggcttctcctcagtggtagctctgggcgcaagcatcatctgtaacaagatcccaggcctggctcccagacagcgggcgatctgccagagccggcccgacgccatcatcgtcataggagaaggctcacaaatgggcctggacgagtgtcagtttcagttccgcaatggccgctggaactgctctgcactgggagagcgcaccgtcttcgggaaggagctcaaagtggggagccgggaggctgcgttcacctacgccatcattgccgccggcgtggcccacgccatcacagctgcctgtacccagggcaacctgagcgactgtggctgcgacaaagagaagcaaggccagtaccaccgggacgagggctggaagtggggtggctgctctgccgacatccgctacggcatcggcttcgccaaggtctttgtggatgcccgggagatcaagcagaatgcccggactctcatgaacttgcacaacaacgaggcaggccgaaagatcctggaggagaacatgaagctggaatgtaagtgccacggcgtgtcaggctcgtgcaccaccaagacgtgctggaccacactgccacagtttcgggagctgggctacgtgctcaaggacaagtacaacgaggccgttcacgtggagcctgtgcgtgccagccgcaacaagcggcccaccttcctgaagatcaagaagccactgtcgtaccgcaagcccatggacacggacctggtgtacatcgagaagtcgcccaactactgcgaggaggacccggtgaccggcagtgtgggcacccagggccgcgcctgcaacaagacggctccccaggccagcggctgtgacctcatgtgctgtgggcgtggctacaacacccaccagtacgcccgcgtgtggcagtgcaactgtaagttccactggtgctgctatgtcaagtgcaacacgtgcagcgagcgcacggagatgtacacgtgcaagtgagccccgtgtgcacaccaccctcccgctgcaagtcagattgctgggaggactggaccgtttccaagctgcgggctccctggcaggatgctgagcttgtcttttctgctgaggagggtacttttcctgggtttcctgcaggcatccgtgggggaaaaaaaatctctcagagccctcaactattctgttccacacccaatgctgctccaccctcccccagacacagcccaggtccctccgcggctggagcgaagccttctgcagcaggaactctggacccctgggcctcatcacagcaatatttaacaatttattctgataaaaataatattaatttatttaattaaaaagaattcttccacctc

SEQ ID NO: 209982 - DNA, 1941 bp, Homo sapiens
  misc_feature (3)..(3): n is a, c, g, or t
  misc_feature (5)..(5): n is a, c, g, or t
ggnangagggaggggcgggggctggaggcagcagcgcccccgcactccccgcgtctcgcacacttgcaccggtcgctcgcgcgcagcccggcgtcgccccacgccgcgctcgctcctccctccctcctcccgctccgtggctcccgtgctcctggcgaggctcaggcgcggagcgcgcggacgggcgcaccgacagacggccccggggacgcctcggctcgcgcctcccgggcgggctatgttgattgccccgccggggccggcccgcgggatcagcacagcccggcccgcggccccggcggccaatcgggactatgaaccggaaagcgcggcgctgcctgggccacctctttctcagcctgggcatggtctacctccggatcggtggcttctcctcagtggtagctctgggcgcaagcatcatctgtaacaagatcccaggcctggctcccagacagcgggcgatctgccagagccggcccgacgccatcatcgtcataggagaaggctcacaaatgggcctggacgagtgtcagtttcagttccgcaatggccgctggaactgctctgcactgggagagcgcaccgtcttcgggaaggagctcaaagtggggagccgggaggctgcgttcacctacgccatcattgccgccggcgtggcccacgccatcacagctgcctgtacccagggcaacctgagcgactgtggctgcgacaaagagaagcaaggccagtaccaccgggacgagggctggaagtggggtggctgctctgccgacatccgctacggcatcggcttcgccaaggtctttgtggatgcccgggagatcaagcagaatgcccggactctcatgaacttgcacaacaacgaggcaggccgaaagatcctggaggagaacatgaagctggaatgtaagtgccacggcgtgtcaggctcgtgcaccaccaagacgtgctggaccacactgccacagtttcgggagctgggctacgtgctcaaggacaagtacaacgaggccgttcacgtggagcctgtgcgtgccagccgcaacaagcggcccaccttcctgaagatcaagaagccactgtcgtaccgcaagcccatggacacggacctggtgtacatcgagaagtcgcccaactactgcgaggaggacccggtgaccggcagtgtgggcacccagggccgcgcctgcaacaagacggctccccaggccagcggctgtgacctcatgtgctgtgggcgtggctacaacacccaccagtacgcccgcgtgtggcagtgcaactgtaagttccactggtgctgctatgtcaagtgcaacacgtgcagcgagcgcacggagatgtacacgtgcaagtgagccccgtgtgcacaccaccctcccgctgcaagtcagattgctgggaggactggaccgtttccaagctgcgggctccctggcaggatgctgagcttgtcttttctgctgaggagggtacttttcctgggtttcctgcaggcatccgtgggggaaaaaaaatctctcagagccctcaactattctgttccacacccaatgctgctccaccctcccccagacacagcccaggtccctccgcggctggagcgaagccttctgcagcaggaactctggacccctgggcctcatcacagcaatatttaacaatttattctgataaaaataatattaatttatttaattaaaaagaattcttccacctcgtcgggatccgttttctgcaatcaaagtggactgcttgctttcctagcaggatgattttgttgctaggacaaggagccgtgtagaagtgtacataactattctttatgcagatatttctactagctgattttgcaggtacccaccttgcagcactagatgtttaagtacaagaggagacatcttttatgcatatatagatatacacacacacatt

SEQ ID NO: 209983 - DNA, 1656 bp, Homo sapiens
acagggctgtgtggaaaggtcacatgagctgctgtttgtggcagcacccaccatactgccttggcacatagtagggacactgcccaagtttactgatgcatttgatgcatatttggggggcacctgccatgtaataggtactcacccggagccacatctttgaagtgccacaatccatttattcagcagtcatttagtgaaccagcagacagcctccctgccctcagggagctcatcctctcaggaggaagacaagtgatcaattccttgagggcagggcattgcctgtcaggtgcacagctgtctcctagcatgtggcttctcctcagtggtagctctgggcgcaagcatcatctgtaacaagatcccaggcctggctcccagacagcgggcgatctgccagagccggcccgacgccatcatcgtcataggagaaggctcacaaatgggcctggacgagtgtcagtttcagttccgcaatggccgctggaactgctctgcactgggagagcgcaccgtcttcgggaaggagctcaaagtggggagccgggaggctgcgttcacctacgccatcattgccgccggcgtggcccacgccatcacagctgcctgtacccagggcaacctgagcgactgtggctgcgacaaagagaagcaaggccagtaccaccgggacgagggctggaagtggggtggctgctctgccgacatccgctacggcatcggcttcgccaaggtctttgtggatgcccgggagatcaagcagaatgcccggactctcatgaacttgcacaacaacgaggcaggccgaaagatcctggaggagaacatgaagctggaatgtaagtgccacggcgtgtcaggctcgtgcaccaccaagacgtgctggaccacactgccacagtttcgggagctgggctacgtgctcaaggacaagtacaacgaggccgttcacgtggagcctgtgcgtgccagccgcaacaagcggcccaccttcctgaagatcaagaagccactgtcgtaccgcaagcccatggacacggacctggtgtacatcgagaagtcgcccaactactgcgaggaggacccggtgaccggcagtgtgggcacccagggccgcgcctgcaacaagacggctccccaggccagcggctgtgacctcatgtgctgtgggcgtggctacaacacccaccagtacgcccgcgtgtggcagtgcaactgtaagttccactggtgctgctatgtcaagtgcaacacgtgcagcgagcgcacggagatgtacacgtgcaagtgagccccgtgtgcacaccaccctcccgctgcaagtcagattgctgggaggactggaccgtttccaagctgcgggctccctggcaggatgctgagcttgtcttttctgctgaggagggtacttttcctgggtttcctgcaggcatccgtgggggaaaaaaaatctctcagagccctcaactattctgttccacacccaatgctgctccaccctcccccagacacagcccaggtccctccgcggctggagcgaagccttctgcagcaggaactctggacccctgggcctcatcacagcaatatttaacaatttattctgataaaaataatattaatttatttaattaaaaagaattcttccacctc

SEQ ID NO: 209984 - DNA, 783 bp, Homo sapiens
acagggctgtgtggaaaggtcacatgagctgctgtttgtggcagcacccaccatactgccttggcacatagtagggacactgcccaagtttactgatgcatttgatgcatatttggggggcacctgccatgtaataggtactcacccggagccacatctttgaagtgccacaatccatttattcagcagtcatttagtgaaccagcagacagcctccctgccctcagggagctcatcctctcaggaggaagacaagtgatcaattccttgagggcagggcattgcctgtcaggtgcacagctgtctcctagcatgtggcttctcctcagtggtagctctgggcgcaagcatcatctgtaacaagatcccaggcctggctcccagacagcgggcgatctgccagagccggcccgacgccatcatcgtcataggagaaggctcacaaatgggcctggacgagtgtcagtttcagttccgcaatggccgctggaactgctctgcactgggagagcgcaccgtcttcgggaaggagctcaaagtgggtgactgcctgggctgagggtcccatgtctggggatccccacactctgcaaaaaggactccatcattttacccatctagggctgtgagagtgcaacacatgtctggtgagctggtgaatgcttagaaggatggatttgaagacctttccagtgagagagacagaagcaaggggcgggccagctccattttctctctgccatttcttaacaatacgccatcttgcccaagcaaaagacctat

SEQ ID NO: 209985 - DNA, 337 bp, Homo sapiens
ttccagcctaccaccaatatcctaaatcaggccatcatctcttactgcatcaactttctaagtcttcttcctgcccagacatgctctcactgagacagccaagtataaaggggtccctggagaacttctgactggaccgcacactgagagaggagtgtgcactggggtggggcctcaggaagttcgtccatttgcagtggggaggagtctggcccctcctcttcctggatagtacctgagattcaacctgaggtgggaaaccagctaggaggactctcgctttgctgagagtccctgtttcctttttttttttccttttcacccaataaattcaatt

SEQ ID NO: 209986 - DNA, 525 bp, Homo sapiens
gtctgttctatcatacaccaagctctcatggttctgtttctgtggatattttttacctattgatctagttgttcattcctgctctacgtcatgtttttatttaaaaattatggtaaactctactttacatagaatttatcattttaatcctttttgagtgtacaattcagtggcattaagtacactgacgttgttgtgcaaccatcactactattcatctccagaaagttttcatgatcccaaaatgaaatgctgcacatattaaacagtaacatcccattactccctggtaattaccattctccctaatttgtctataaatttaactcacttaagtatctcatatattatgcaatatttgcacttttgtgactggcttatttcacttactataacgtcttcaaggttcttccatgttgtagcatgtgccagaatttccttcctttttaaggttgaataatattctattttacatgtataacacgttttattcatccactcattggtcaatcataccatctggtt

SEQ ID NO: 209987 - DNA, 883 bp, Homo sapiens
ggagagctggtgttcctttggcctggggcccacccagaatggacacacttgggggcagactggagcccaccttgcatctggagctaagctgtcagacctgcagcttgaagcagggcagcctggctgaggcccacccagatcagccaacttgcaaacacagaagaaaccagtgcttcttgtgacagggtctctctttgttgcctaggctggagtgcagtggaacgaacttggcttattgaagcattgaccacctggacccaagtgattctcctaccttagcctcttgaatagctgtgacaacaggtgtgcactaccacacccagataaattttgtaatttttatagagagggcatttgaccatgttgcccaggctggtctcaaactcctgagctcaagtgatactcctgcctcggcctcccaaagtgctgggattacagatgaagaaaatgaggcactgagagattacataacttcccttgagtcatatttgcttgtaagtggtaaggctggatgttgaacccaggacaaagggtctcactctgtcgcccagtctggagtgcaatggtgtgatcacggtcactgcaacctctgcctcccgggttcaagcgattctcctgcctcagcctcccaagtagctgggattacagcggcttgcagtaaacttcttggaggagaattggcattgcaagggtgttactggagacctcggcaagaaagtgaatgcaaagacagatgacccaggaacccgtgatggataaggctcttgacagccaggacgtggaattacagggggtctctttgagagacaaaataaaaaaaatagcccagtaatcttccttccacccttttctcccagatctaattacagatgtcttgacattc

SEQ ID NO: 209988 - DNA, 463 bp, Homo sapiens
gacaaaaatttcagaggcaagaagaatggaagagaggaagagaagaagagaacatgagacaaaagagccagcctggggtgctaaggagctgccaaaagactcaaagtagcagaatgggtgggcaggccctcactgcctgagccaagccagcacctgttcacacccacagactcagactctatggccaagagcactgaatccatgtttttggccttccactaatcagactggtttttatcacaggcccatatggagatggagcaacttgcatcatcctggtcatataaaagaaatcaagggctgattgtccttgccaaccgtctccctgtactcagcccgtcggaggaatgacattacataaatcctcaaacataaagaggcataaggacggcacacatcttgccttggcatcccacatatctaatctaaacattctctgttctcaccaggacatcccaacaca

SEQ ID NO: 209989 - DNA, 589 bp, Homo sapiens
acatgtggcttttattggacatttgcagtggtagctttggagggagaaacaaggctttcccaggatgggtgtcttgattgactgggttatggtcctgccatcggctggagagcctaccttgggagaacttggtagttaagaaccaggcatggagtcacactggtcagtttgagtcctggttctgacatatgctagcagaggaactcttgagcaagttactgaatgtttttgtgcctcaatttccttacctataaaatcgggggatatagagttgtttttacatttaaatgaactagaatgtaaaatgtttctcaggttgcctggcctagtaacaactctattagcatttgtgagtattattacgatcattattgttgctgctgctgttactgctatcagaattgaggtgggaaatgaagagacatagtactcagaacctggagggctgtggcatttaaatatctactggcgccaggcgtggtggctcaggcctataatcctaacactttgagagaccaaggcagaaggatcacttgaggtccggagttcaagaccaacctaggcaacatagcaagaccctgtctctaca

SEQ ID NO: 209990 - DNA, 345 bp, Homo sapiens
gggaaagatacatagttgatatattgagattctcccgaaaaacaaagtagataagaaatccatatctatactgatatctatatctatatctacctatgtctatgtctacatctatatctacatcgagttctatttctactccaatacggagaaagagagaaagagaggcaggaggagagagaggaagggagagatggatcaagaggaactagctcctgtgattatggaagccgagaagtcccgggatccgcctctgcaagctggaggcctagggaagctggcggtgagattcagttagaatccaagggcccgagatcaaggggagctggtggtgcagctcccggt

SEQ ID NO: 209991 - DNA, 313 bp, Homo sapiens
atcacggccctgtaatagtgtatatatactccttccagatgatgtatttttcaacatctttactgggatagaaatctataaattcacttaaggtatacaattcaacaattttagtattctcacagagttgtgtaaccatcaccacaatctaagttgtgaaaatatgcaccaccccgcaagaaacctcctacacatcagcagttactccccatacccccactgggacactactctactttctgtctctgtagatttgcctattctaggcatttaatataaatggaataataaaacatatggcttttttaaactc

SEQ ID NO: 209992 - DNA, 753 bp, Homo sapiens
gcctttataccatcggttagactaactattcccctttgcacctcattcaccctcaaaggtatttcagagcttcagagtaccattcagtaaaattccacacatagataaaccttacttgataaacacactatagctgcacatcaaaattattttatattgttctcagggaacatataaacaagtgttaccgtgactattctaaagagggtatcatttaagtatgtatcatcaaaattatgacttaatctgtggcttttatgaaatagcattaaaatgtttaagaattataataagagctattgcaaaagtcaataacaaataacaacttgtaattatatcaaagtattgccaataattgctttgcctactatataaattcctttatgaaacgtattatggcaagcagtgattacattttaaaaatataatttgacaagcaatatatccatacaataatgactcatgatataatagggacctattgcacaaataaactgtaaaaacagacacaagcataagatagaacactaagtatactcagacttcaacaattcaatagcaaattgttgtagttgtttatacttggagtggcttagaacacgaatgaaaaatatgatactaaaataattcaggattctgaatattgctaactcctctttctccttatatagtaagataattatctcttgaataaagcccttcctccctctttccttttctttcaattttatttcttctttcttttcctccata

SEQ ID NO: 209993 - DNA, 191 bp, Homo sapiens
taaactgtaaaacttatgtttttattgcatataagcacatctttataaatgaattcaaaagcataattctgtgaggcatttgaaaacagccaccaatcctctgacatatgctggaatgtggtttgtcacctgtagaaaactaattctgattagcactaagattagtcattctagtctccactgggttgcag

SEQ ID NO: 209994 - DNA, 238 bp, Homo sapiens
tagtgctgcaataaacatacgataaagcacattattcttagcccttatgtaatcaaaaatcaggttcagtcacatgccacttacagagtccagttaacaagagcaagatctggtataaagaaagtgacttttggctgggcacggtggctcatgcctgtaatcccagcactttggaggccgaggtgggcggatcatgaggtcaggagatcgagaccatcctggctaacacggtgaaacc

SEQ ID NO: 209995 - DNA, 748 bp, Homo sapiens
agctacctcatctctctgcacttaagtctccttatctataaaatgaggaattaaaaactgtactcagtctcaaagtgttatattaaatgagttaatatatgtaaatcaaaacagtacccaactcataggaagtctatatgtattagctgctatcttagtccacttgggctactgtaacaaaatagcatagactgggtgacttataaacaagagaaatttatttcttatagttctggaagctaggatttggtgtccgatgagggcctgctttctgattcataggtaatgccttcttgtgtcctcacaggatggaaggggcaaaagagctctctggagcctcttttataagggtaataacctcattcacggggcctctgccctcatgacctaatcacttcccaaaggcctcaccacctaataccatcaccttggggttagtatttcaaaatacgaattcagggggcacaaacatttagaccacagccgtggcaattattgttgctattgctgcatatcaagtattatggtccttttcctagtctgtagttatcagtctagcacttctgtagagaagattagaaaagtccaccaaagagcatccacaagacatctttcatttgaataaatatgtattcagccaatgttgattcaacactcaatactacaggttgagcaagttacgtaaactttctgtgttttctcttaaaacatattaataactgctttatagtgtggttataaagagtaa

SEQ ID NO: 209996 - DNA, 504 bp, Homo sapiens
ttctttccttccttctttcttcctttcttcctttctttgagacagagtttcactcttgttgcccaggctggagtgcaatggtgtgatctcagctcactgcaacctctgcctcctgggttcaagcgattctcctgcctcagcctctcaagtagctggaattacaggcacccaccaccatgcccagctaattttttgtatttttagtagagacaaggtttcaccatgttggccaggctggtcgaactcctgacctcaggtcatccacccacctcagcctcccaaggtgctgggattatgggcatgagccaccgcatccagcccatcccatgcttgattacctctgatgatagtgaactcactacatcccaaatatttcagaaggtatcgttgtaaacctggggccaaaacctttctccctgtagctttcacagaggatgagactcttctatgtggcagcccttcagatatctgcagccagccctcatgtccctgtgggtctcctct

SEQ ID NO: 209997 - DNA, 328 bp, Homo sapiens
tccataaacataatgacacaaaggacaaaactaaaacatctgaaagaggattttttcagacaatgtttttccaaagttgaatgcagacacatttactactagtagtttgactgtacaaaaataacactagaagttcctgaaaattttatttaacaaaaattgctgtttaaaacaatacattacttttgagagggaatttacttgggtgtagtagaatcaaataatattggtaaatatggtcactgagagttcggatcctttgccagagattccttcccccaaaagtgaaaggttccgctttcgtatcgtatggaaacgctcacaagac

SEQ ID NO: 209998 - DNA, 1267 bp, Homo sapiens
tgctccccttgctaccgctgacacttggcaccgccgcctcctagcagcggccagacgcggggctgggggccttccacgcaaaccgaaggagatacggacatcgtcattctccccaccgcgcgagccgggcccgccacccacgcaggggagaccgtgcccgtgcccctctcccgcgcctgccgcagatgcagggaaaaccgcctgacatcatgagagcgggacaaacgctcactttgaaggattcctgggcaggacttcaagtgaaatcatatgcctgagaagaacttgataccggtctagagaaaataaccagttctgactttgccaaaccatggaatgtgcaaaatgctctacttttttgcaagaggccaaatgtcccttaaaaagctccattatgaatatgaaccttaagaccgaagggtcaagaagcttgtgccgttgttgagtgtgggaaaaaatttacacacatcgtgcaagtttctgctccttaacattattttattaataatacgttccactttggggaggggaacctgtaactgtgcgtgaattatcatctggacatgtgcttctgtgaacaaaaggggaaatgtgcatatgggtaaaaaaattactgctttcttataactaaaggctatcaatctgaccaacttataaataaaagtaatcaatagcacagtaaaggaaacattaaattttctacaatttacccaagacaatttaatacaatactttcccctagcaaatgcattctgaaggaaaaagatcccaagtgaaccaacacattaattggaaagccttagcttcttatttccgaaaacaagaggtaattcattctatgtgttctttaaataagggtaggtagcaaaaataaaatgaaataacataaaatcaaaagaagatataatggtggaggaaaagaaacaggtggcttcatttctattctaaaaaagaatttcacgatttatgtcttgtgtatacaggggtagggattagaatctgcaagctggaaactgcattccagtagttaatatttttcattgtgcagtcgcctcattcaaaataaaattaccacctttttcattcatttatttctctgaaaatctggggggaaacattaccttcagattagtatttaatattactataaatatggcatttgcttttctccaaagtgtttccccttatgaaaaaagtagaaaaagcaaaacacattaaaaaaagaaagaaataaaagaaaggcaaatggagagctacctttctttga

SEQ ID NO: 209999 - DNA, 349 bp, Homo sapiens
atttgaggggagtcccccactcccttgtccttagggtacgtcataaagcagatgggaccaggtattttgaagaatcagccaaataacagaaggacatgacagaggctgtcctagttccttgattaaaatgtgtaaggttgattagagaaaagaacttaatgctgtttatagatagaaaactgttgctttctcatttcttattaccaaagtgagactgaaacaaatgttgattctgttggcacatttgtattgagcacttaggttccctgtatcatcttggtcatgattaccgctgtgtttcccctcgagaggccattgcaggttttagtctgggctatttgtattcagc

SEQ ID NO: 210000 - DNA, 348 bp, Homo sapiens
gagtgctgggattacaggtgtgagccacccaatgcttggccatactctactgttaatgcagcagttcagcacagtcaattcacgtttctccctgctcacagccctcacagaataaaagccaaagtcttataaagccctctaaaaagtgtcctccccttacctctctggccttctctcttactctcctcttcactaactcaattgcgtagacactggcttcctcactgtttctaccacaagctaggcatggtcccaccttggggcatttttgctgtctgttccctcttccagatggcctcatagcttgttcccttacctcctttagccttttcaccctttccagcccac

SEQ ID NO: 210001 - DNA, 344 bp, Homo sapiens
aaggtgactggtgggttattggaaggatgatttaggcagatgctgaagccactgggagtgacaagagtcatagtggtgcaggggaaggcagcatgaccgtcaagatcattaattgcagccttgtttggaggaacaaaagcttaaagacaatcaaaatgtcctttaatagaggactgtctaaatcaattagggcatattcattcagtagagtaagatacaagatacacagcctattaaaaagaaagaatgagggagctttcagtactggtataaagtaatcaagatattttgttaaatgaaaaaagtgaagttaagcaaaaagtactgtacctagtatgctgcta

SEQ ID NO: 210002 - DNA, 505 bp, Homo sapiens
aggtaaggctgctacttaggattacatgaagtggaaacaacccagaatagtttgccagcaaataaaacttctttctcacaattttcaagatattcatccaaaatcattttgattgtaacttttggatagctgaatagcactgttcttatactaagcatatgattataaaagacccagaaatgaaagttgttgtgcttactcacttccttccctccttaatttaataaatgtttgttaattgtctactgtaagttggaaactctcccagacacttgtgaaatatcaatgaacaaaataaatatatttcactctcatggtgcctacattctagaagggagaaataaaataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagaga

SEQ ID NO: 210003 - DNA, 402 bp, Homo sapiens
cagggttttctctggggggtgggtgttccccctcttagcccaagctctgccacacgagaagcagatgtcttgttctaatcttcaagtgggatgattcgtggacactgccattagctagttttcttaacatgaagagacagctgcttagtggctatttctatgtgggctgagctcattcagtagagcagctttcccctctggagaacaagagaatgataagcgagcataaatcatgctaaaaggaacgactcctcatcatgagtcattaggacacatgccacattggcgagcagatgaaaaacctttgatgaagaccagttgtaaaagcacaagctaatgctggagaaatgcatcatggtgacttgaaagtgtaatatatgcatgctcacgctttcggtctta

SEQ ID NO: 210004 - DNA, 503 bp, Homo sapiens
tgagtgtggtggggggtagaaaagtggaggcgtacatgaatatatttttagaattttatctttttatgtattactgctatgtgtttagagtataaatttacagtgccatcctgactggatgaattggatttaactattcataccaggaaactgggcatccctgccaatactaatctcttgggaacaggtatcaaaccatctctaacaagattcatagaactctagccaacacaatgagggcaggagactgagataccctggggtcaactgaagaaaggcccaattgaaactgctctcccattcccactgccaccttcattccagtccacagagggatagggcagggcgtgcagacatgcaaacgggatctttcagatgtggcctgggcaggccttcactgacccaggtaacacgggccttcagtctcttccacaccatttgcccatttcagtctttcacctgactagtgaaaactgcacactggccatacaaacacccctgat

SEQ ID NO: 210005 - DNA, 492 bp, Homo sapiens
gcccctgttttttcttaggtattctgttttattacctttaatgtggactttaagtattttaatactataaataatgatagggttttgtacgaccaactctcctggggaatacctgaatgatgttttatcaaagaaaacctggagaaataggcagagctgccctgctaagatggtgaaaattcactgtgcttcaggatatgttagtaatttctgctttccagatgaactgaaaactgaaaactccctcagtcaggagacaggaacttggtgaatgagcataaaattcagtcatggttttgagaagaaaaagaagaactagcactaataccacatgggatgaatccaagtaaaagatctatgttccacatgacgactgaaagttgagaagcagcttcaaagaacagttgaaaaatcacaactttactgaagggtagaactcggcagaaatagctgtagcaattgttagatgaatatgtttcagacaaacagagc

SEQ ID NO: 210006 - DNA, 328 bp, Homo sapiens
gccatgataggtgaacttttccagtaaacaaaactgtccccacacagaggagaggctcctggaggccttcacctggcagggcctgaccgtggagtaagagcctaggaagacactgaggggcctgttcctgcagctgcagcctcagcagggcccttcatgcctgcacccccctcccctggggtgcccagtgagggctgactgctaggggaaatgtcggggtgctacagcacagccccctcccctgtgaatccagcacgtgagggccctgccctcgttcctactggggacgcagccagtaaacaaggagaccagggtgtgcccaagatga

SEQ ID NO: 210007 - DNA, 434 bp, Homo sapiens
ggtacctgtcccttggacattggttatttattgctaaaacccgcatgggtacggagccaatgtaggtgataaatactgccttagaggaattgagctttcactcggcacgtgctgggggtcacagcccgtgtttctcaaactggcccttgggccacagtccgaatgcagctcctggaactgcccttagctggggtctgactgcataattccaatctttgatgatgagaatctgcaacttttacaagctctcagatgattctgatggcctgtagtttgaggacccctgatgtattaggaagcctaatgtgaagggatcacagctaaatatagttgcattaagagcctttaaaaaatccagaactggattccatgaaaatttacttcggggttaattgatgtttttgcctgctatctctgggcaaggaagactactg

SEQ ID NO: 210008 - DNA, 475 bp, Homo sapiens
ctgttgccttgtgaagaaggctcctgcttccccttcaccttctgcgcgattgtcctgagctgaaaagaatatgagaaatcggattttacgacatggttataggcggaagggatttgccttgtctcagatgagactttggactgtggacttttgagtcttattgcccagaggaaaccatatttacagtatgtccataggaactttcttcatatatcttctttttctgtcatgtagatactaattttaaaaacaacaaataccagattatatttgtttgacaaaaatacttctgaaaattatgcaattatgtgagtgaattacttaaactctttaagccttagtgtcctcgactataaggtgaggatgttaattcctatttcaaaaaatatgatgaggaatagatgagttaaaagcaaagtgcttagtaaagtgactgaaatatggaaaaggttcaataaatgctgcatgttagtta

SEQ ID NO: 210009 - DNA, 613 bp, Homo sapiens
actgacgtgggtataatgtgtgtgcctaattctgtgttgttttatcacatgcaaatttgtgtaactactacctcttcaagtaaaatgcagaactgctcccccaccaaacagatctctctggtgagacctctgtgtagccatacccactctctccccatcaacaactaatgtgtctccatcgctatcattttgaggaggctgagttttaaatcaacttccgaccctctcagcagtgtgaccttggataagtcatttgtccttttctggatgttgatcttctcagctaaagtaagacaaggttggctcacatcaacattcctcttgaatttccacaggctgatatgatctgaaaatgctacggagattatgagaaagaaaatggggttttatggtgaaataaactagggaaatgatgctttccataaatacataatgcttctttaccgtgaattctcagccctttaatacactaaggtgaactgtgaatcttctagtgtgggaggtatacgcagcattttccaaatttatctgaacacagaatgctccccccacccttaaaaaaatcctctagaaaaaaaatcacttggaatagctgccgggaatatgcttagag

SEQ ID NO: 210010 - DNA, 390 bp, Homo sapiens
cagccttcagaaattttttcttttctaacctgcctcagcttcagagcttctccctgtgtctcgcaggagttttgtgggtcacaggcagtgccggttgtaaagaacacagcccatggggtgaggagatgacacagcctttgggaggaagacagggctcgtgaaagagagagacgtgaaacagcagagttttcttggcctgaggcctgagacgctgcagtgagtttatagaatgctagccagttatgattgtttgttaagggacatttacatatcattcaatgttggccaggatcttttacaatcttttaatcaaatttgcaaagaacattacaaacttttaaaaaaatttactattagttattaaactggcaggagtgtacctgcatcaaa

SEQ ID NO: 210011 - DNA, 624 bp, Homo sapiens
taccccctaatggaatcagatagtcatttttctgaatgattcatgcatatgcttatttacaactatttcattttttcctgaatgcacgtaaaagatcactgcagcttaacagtatgcaaatctattcctactgtgaaatcataacagcagcaccagcctgctgagaactaagaggaaatgccacatatgaccaaagactaaattacctaccaaatcaagcctctgaaaagcacagacacatttactatggaacaagaatatgcaagaataagaaaaagttctagcagagggattagttagaataatacatgccgaaaagtgctttaagaagcagagacatcttttggacagacagaagttcattcaataacttaaacaatatttattaagcacctattatatgccaggtaccatgctaggatctaggaggttaaaaataaaaaagaagacttagtccttcccaaccctctcccagaacctcagtgtctaccatggggaaaaataagcaacaaattcaataagatgtgataaatgctgtgatagataatgtacaagatgctatgaaagcaatagcattataggatagcatggagggatcaaggaaagtttgctgaaggagaggag

SEQ ID NO: 210012 - DNA, 4317 bp, Homo sapiens
tgaaggctgagttctagagatcgggtcggctttctacgcggctctcgtggaacctagcaaagaaagacagtgaagactgcaggaccttccttcgcgcttttgttacaatccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgctcagcatcagagagttcacactggagaaagaccttatgactgcagtgaatgtggaaaagcctacagcagaagctcccaccttgttcagcaccagagaattcacacaggagaaaggccttataagtgcaacgaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagctcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggacatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaaa

SEQ ID NO: 210013 - DNA, 403 bp, Homo sapiens
gggctcaagtgatcctctcgtttcagcctccccaagtgctggaattataggtgtcagccactgtgccaggcaggtttggtttttaaaaatttctctttgggttactaaaagtgtttggcattacatgatttttgtagttatttgtgcacagttgtagactcaagtgaattttaaaatgaaattgcctttaaatattagtatggcaaaaatgaaaacagcattgcatagtattgtttatttatatgggtgacgtagataggtattttatttcatgggaacaatctaagatttatgatatggatcaaggattctagaaactattctcgtaaccagttttaaacaaggtcatttataacacctctgccctcccttcattgtactttatcattaaaaatcaacttcc

SEQ ID NO: 210014 - DNA, 950 bp, Homo sapiens
catgggcgaagcccggttctactaagaatacagaaactagctgagcatgatggagggcgctgtggtcccagctgcttgggaggctgaggcgggagtaatcgcttgagcccgagaggcagaggttgccgtgaaccgagatcgtgcaggcaaaggttgcagtgagtcgagatggtccctccagcctgggcgacaacagcaagacttcgtttaaaaaaaaaaaaggaaaaaaatactgtaacagctcatctaaccagaaaccagcaacctggaacattaaactaactatatacttcctaatctggtcaagaattcaggagtcaaaagagaaaaatccctgtgtaggtgctgggggttggcagtaattcttctcagtatctaaggcttaataatgccctccagtgagcagtgacatacacaacaacgaccgcctcactcgaagagtcttgaactccacattaaaaaaattatggtgcattaaacaagggcgaaaacaaaaattttctggtaataattagatagcatgactaaacagaccacaacatcccctgaaaattcaggctattcatgatttcactgttccatgaaacgcaggttctgaagtttaaatccaagtttcccttgagagttttaattcatgacttgaactaaaaaataaaactataaatttcaatgatctgggggtttatccttctagctactagacaggcaaaataatcttaatatgtggtaagttttactcattaactaaaatatggaaaagctaagatataaagatctgactaaaaccacaagattttatgacaaaagggcaactagtgtactcaaaattctttcacactttacatgaaatggcttattataaaaaataaaatcttgtgtaaactgattaatcagtttacacaatgatcgctctctttttttttttttttttttttttgggcaaaaaaagg

SEQ ID NO: 210015 - DNA, 214 bp, Homo sapiens
gaatgacagagccttgggagaagccttgggagaattaaaaactaaaaactttaaaaaaaaaaaaggaaaaaaatactgtaacagctcatctaaccagaaaccagcaacctggaacattaaactaactatatacttcctaatctggtcaagaattcaggagtcaaaagagaaaaatccctgtgtaggtgctgggggttggcagtaattcttctca

SEQ ID NO: 210016 - DNA, 175 bp, Homo sapiens
catatacaagtaacccattttaatcctcagactactgcaaaagttgagtattatccaacaggtatcactataaccattagacataactagtagaagtattggaaattcctaattagaccatcaagaacaaaccctaaggaaataatgtcaataaatacatcaataggccgggcgc

SEQ ID NO: 210017 - DNA, 353 bp, Homo sapiens
caagacggctcactcatatggatgctagctctttgtatgaggcctgttctttcccacttgcacttctccataggcctgcttactgtatggtagctggcttttcccggagtgagtgatccaagagacagggacagaccaagcaggaagatgcagtaactttttatgatgtgtattctattggctggccacacataccaagcagatagggaagggattacacaaaggcatgaataccatcaggctgggataattgggggccagcttggaatctggctaccatatccaaccaaataagaaattaatagttttaattaaaggaaaaggattatattaaatagacattcgttagtttt

SEQ ID NO: 210018 - DNA, 522 bp, Homo sapiens
ccagcctggaaacccctgtggcctcacccctctccagatggatcagtggtggagaccaggtacaggtgaatcaatccacagcggacccagagcttgagctggcccaaccagctgcttctgagacttggatgctcagaaactcaaaagcagcccaagggcaggtcctgcaaagggctgctgcgcattgactggcagccactcctgggccaggtatgtgctggtggtgagcagcagaggccgcgtgacagagccagctgcacaggtgagaggaaagtctaatttttgatgaccaattcatttctcaaagtttgagaagattcactgtgctctctttctggatcattccaataatcctgccctgttttcttcttgagcaagtctgagggtgtcttagattcctttttagtctttgagaaccttcagagacccaggttccatctttaccaaggagaaaactgaggcccaaggaaattgatttatgtaacatgctattgtgccaataattgaaatctgtctatgctt

SEQ ID NO: 210019 - DNA, 446 bp, Homo sapiens
ctgagacattgtcacaacccacaggaacctcagaagacatgacaactcggtgtaacgtgggatcctggaacaacaataacaaaaaaggagcttagggaaaaactactgaaatctgaataaaataggaagtttagttaatattgtattggtttcagtgtattagttgtgacatatataatgttaagatattaacaataagaataaacatggggccaggcacagtggttcaggcctgtaatcccagcacttgggaggctgactcaggcagatcacttgggtccaggagttggagaccagcttgggcaatggagtgcaatcctgactctacaaaaaaatacaaaaattatttgggagtggtggtgtagaccacaaccgtagttccagctatttgggaggctgagataggaggatcaattgagcccaggaggttgaagttgcagtgagcc

SEQ ID NO: 210020 - DNA, 354 bp, Homo sapiens
gaaacacaggaaggctggggaaaagtacatcagggaaacctaatctagcttcagggaggtggggctgtggggaagaagagtgttaggaaagagaagcacatttttaaaagatcgtcaattacagaagaaaacaaatgaatttcactggcctatcctaagaccattctagccaatcagatttttgcagcttggtttctgcccattggcttgtaatcagtatttccaagtgtaaaacaccagccattctttccttgaatcattttaagtctaaggggacagcatcagtaattagcagctcaggctggagttaatccctaaggaactctcatttcctgcctctatgtcagttttcgt

SEQ ID NO: 210021 - DNA, 348 bp, Homo sapiens
catgttgtgctcagtattacatgcgttaaaatgttcttagttgtgaaatttgacatgaccgctagttaaagttacaatggaagttttaaatcccgctttccgaaaactttgcagctatagcatgaagttaaatttttgtcttattttctggataagtttactatactggaacatagtaaagctctttttataaagagctttgaataaaatacctaatgatgtggttgaaacgaacacctattttcaaaactaatcttaagtggtatttcagtgcatatgttatgtaaaagcaatttataaactaaattttaagagccttcaaaatacaaggtactcgtatttaatgac

SEQ ID NO: 210022 - DNA, 386 bp, Homo sapiens
ggttacctggggctgggagtaagggggacagttgggagatgttggtcgaaggacataaaatttcggtgaggcataagaaataagttcaagtcatctactgtgcatcactatgagtacaattaataataatatattgtatacttgaaaattgctaagacagatttaagcgttcacaccacaaagaatgacatatatgtgaggtattacctatgttaattagcttgatttagtcagtctacaatgtataaaaatatcaaaacatcattataagcaccataaatatacacaattttctgtcaatttaaaaaactaaatttaaaaattagtaaaataacactagcctaaccagtttacagaggtggaatccgcgtattttctaattttag

SEQ ID NO: 210023 - DNA, 731 bp, Homo sapiens
ctaaatgttagttttcctgttactgtagagcaggagaactgatcctcttcacaaaagagggctccttgtgaggatgttaacagtctagctcaaagaaccaaagtgcctcagaatcacccaggtgcatgttaaaatccagattcatgggccccacctcaggcccacttagctgcaatctcaggaatctgcattataacaggctcctcaggtggttcttccatagcacttatttgcatgctactctcttaaggtgaggggaagcataagatccacaggtccctctaatgccataatttttttttctctccgtttgttattcactcctgttctctccactaatgttcacaaattttgtggaacttttaaagtcatgagaacctttcaagatagtaagatgaatcttgattcaaaattgtaaacaagaaaaaaagacatgccacaaatattctgcctgttgaaattagaaaaccagttaagcaatatggaaacctaattatctcaaatttctgtacaattcttcatctttacttaattgagggatagccattatcttttcttggatggaatcggttcattgggtcctgatacctctgcaaaacctgtaaaatgggcttcagatccagggacctctaccattggtgataagtgactcccaaacattttcatcctcagagaaggcacaggtgtgagccaaacccgcaaatagacggccggcatactggggggttctc

SEQ ID NO: 210024 - DNA, 346 bp, Homo sapiens
ggtgatagattaggcaaaccttctctgctaagtgcatgtgtgcatttcagctcaggaacaaaaataagaccctgttctacggaggctcttaaaaaactgacctgtgctggccccacacgctaaggtttatttgaggcgcccgaaggtgattagatccaggaggaggcgtttttctgcaatttagcttaggaactcagagccagccaaatgcttactgcagctgcttgttggctggttcaaaggtatagagctgctttaattaaaatcggcaggcgcgttttgattttggtcaaaatagattttgttatttttaaacttcctgtggaattaaaaaaaaagtattttt

SEQ ID NO: 210025 - DNA, 478 bp, Homo sapiens
catcacagagcgaataagcactgtgaagaaaatgggacgggggctatggtagtgatgggaatttagatcagatggggaggggcctaaggagacctttctgaggagtgacaaattggatcaaaggtaagcgacaagaaagggccacctgtgtgaatgggggaagggacacagaagagatgttagtgcaaggaggctgacacgcttgaagggagagtggcgtaagccgactattgatggagcctcctctgcactaggcactgcctttaatgctgagatgaggggtacccggctggggcctgtcagttgaggccagagaaattgcagggttagatcacatagggcctaggagtttattctgttctccaagcccctggaggttggcaactggaggctgacgtgacctgatgaatgtgtgcaaagattaccctggctgctgggcagggaatagactctgaggagcatgagtgaaaatggagac

SEQ ID NO: 210026 - DNA, 745 bp, Homo sapiens
ttgtgaaatgggcctgggtagataaggaaaagaacctccaagaggttaagtgatttgcggatttgcctaaattatacagaagagtcagaaccagtgcccaggccttctgattcttagtgcagtaaacactaagcaccatcattccatttcaccacactcctgtcttgctgttgtcctcagctaagaaagcctacccctgagttaccctcttccatcttagagccttcctgctcgctgtctgcccccctgcgatggggacttctttggcccttctcacccagcccagcctctgcccgtttccttctcctttccactgcgctgagctcttttctcctccgagaagccttcccttcatctctcctggccccattgtctcccgacctctttgggccattattagtgttcccgtgtggtttttgccaaccacgtaggaattccctgccttaagaaagtccactctcgggccgtgcgtggtggctcacgcctgtaatcccagcactttaggaggccaaggtgggtggatcacctgaggtcaggagttcaagaccagcctgaccaacaaggtaaaccctgtctctactaaaaatacaaaaattagccgggtgtggtggcttgtgcctgtaatcccaactacttgggaggctgggacaggagaatcacttgaatcggggaggcagaggatgcggtgagctgagatcaccccactgcactccagcctgggcaacagagtgagactctgtctcaa

SEQ ID NO: 210027 - DNA, 806 bp, Homo sapiens
aagagcaaagagttgcgttacaaagaacttgggggcccagacctgagccaggggagcctcatggctgcagcccccctgcacctggcaggagaggcccaggaggcacagccagctgctgcttgaggttgtgaccctgaaacctgtcccaacagtggacgtcaatgggcctgagagtcccccgaggcatcccattcctccaggtctttgctgaaacatcgccttctcagtgagtccttcgctgaccactggagataaaattacaggcaccttgggcccttgtgatccagggtagggtcctgagagcccagccaagtggggttagggttacctgggcaggagttccagagttctgggtattctgagcttggtccagaggggcaggaattgtgagctccaggtgggcacctccacgtagaaccctggaactctttatcccaagaggagggccagggcaggagcagggacttttaaaacacagggcccggggcagtgccctcttgtccaggtctaacggtgataatgaatggtggactgagggctggagtccagccttcagcctcagcatcctcccacccatgcctggttttgaggctcactgaccctccctcctgggatagccaaagctcccagaagggaagaaggtaaattgtctttgtatcccagtatctgacaccaagaaagtggccaccaaagaagcccactttgtgagaaccaatgggaaggagcctgagctgctggaacctattccctatgaattcatggcataataggtgttaaaaaaaaaaataaaggacctctgggctcca

SEQ ID NO: 210028 - DNA, 368 bp, Homo sapiens
ttcttaggaagtagaaaatgaaaccagatagaaatattgatctgctcacacaaaaaagaagagtacttgaaatggtaactacatatatattaaataaatgcattttaatttttttcttattgtttaaatctctttaaaagataagtgacaatgtgggctttatatgcatacatagtatgacaacaattgtacgaagtcctagaggggagaaatgaaagtatattattgcagggtttttatgctatgtatgaaatggtataattgcacttaatgtaggctactatatgttaatgatgtagactataagccctgggaaactactaaaataacaaaataaagagttatagctaataagccaacaaagaagt

SEQ ID NO: 210029 - DNA, 162 bp, Homo sapiens
tccatcaccctgggctatactgagatgaatggttgccgagcattatcacttcctagtatcttgcgtgctccttagggaacagaggggctgcttgtattcatctttcatttgggaagttcacacttctccagaacaaagtgagtttctagtagcagggaggga

SEQ ID NO: 210030 - DNA, 248 bp, Homo sapiens
tcgtctacaggatctcttatttctgttaatagttactctgctgagtatacaaatagtgtctactatctcaacccaccatgttggccaggctgttctcaaactcctgacctcaggtaatccacccgcctcagcctcccaaagtgctgggattacaggtgtgagccaccgagcccagcctttgtgatcatttttcttttcattttcaagtaaatcaacttaatataaaagtgcagaaaagtaggaaaaaa

SEQ ID NO: 210031 - DNA, 337 bp, Homo sapiens
ttccagttttggtatatgtgctgccgaagagagcactggactctcaggtccattctattggtctgcatgtctggcataaggatgtcattaccacactgtgctgactactgtagctttgtagaaggttttgaaattgagagtacaagtcagtcctccaactttgttctttttcatgattgttttggctcctcagagccccttgcaatttcatatgaatttgaggattggctttccatttctgcaaaaaaacttgttggacatttggcaagagctgcactgaatctgtagattgctttgggaagtattgacatcttaacaatatcaaatctccgtatcc

SEQ ID NO: 210032 - DNA, 1305 bp, Homo sapiens
gtctcctagcaacaagttgtaccatatgaggacggccgctgagccataatggagatatcaatgcctccacctcagatatatgtagaaaaaactctggccattatcaaaccagatattgttgacaaagaggaggagatacaagatattattcttagatccggattcaccattgttcagagaagaaaactacgcctcagccctgagcaatgtagtaacttttatgtggaaaagtatggaaaaatgtttttccccaacttaacagcttacatgagttctggaccacttgtcgccatgatattagctagacataaagccatctcttattggttagaacttttgggaccaaataatagcttagtagcgaaggagacacatccagacagtctgagggcaatttatggcacagatgacctaaggaatgcacttcatgggagtaatgactttgctgctgcggaaagagaaatacgttttatgtttcctgaagtgattgttgagcccattccaattggacaagctgctaaggactatttaaatttacatataatgccaactctgcttgaaggactcacagagctttgtaagcaaaaaccagcagatcctttgatttggctagctgattggctgctgaaaaataatcctaacaaacccaaactttgtcaccatccaattgtagaagaaccttattaaaaaaaaaatcctcgaaagaacaaatcatgaactatcttattataaaaggctgtacttctactgtttgaaaaaattatttctagggtttaagtaactacaagtaaaataaatttatttcttaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctttttggcgccccttggccccatttttttttaaatttaaaaaattttttttgtggggcccaaattagacctttttgggaaaattccccttaaaggggggtttaaaaaaaaaaaggggcggggtttaaaaaacgggggaggggaaaaaacctgggggtccccaaaaaaaaacccttggaaaaaaaaccccttttggcaagtggggaaaaaaaaaaaaaggccccaccatatcctcttttcaaaaatttcgcccccttaaaaggaaaaagaaaattgcaccccttaattttttgaaaaaaaccccggaaaaattttgtgaaacaaacccttttttttaaccaaaagggcccaaaatggaaaaatcctttt

SEQ ID NO: 210033 - DNA, 1182 bp, Homo sapiens
ggatctattcttgacaatcttgcataatgtaaatccaaatgtttccatttttaatggtcattttcttaaagtgattttgaaaactgtttaagtttccaattgatatagtatatattgaaaggaaatatgtaactgtttcttaacttaggttgtttttttttttcccatagatttggctagctgattggctgctgaaaaataatcctaacaaacccaaactttgtcaccatccaattgtagaagaaccttattaaaaaaaaaatcctcgaaagaacaaatcatgaactatcttattataaaaggctgtacttctactgtttgaaaaaattatttctagggtttaagtaactacaagtaaaataaatttatttcttaaaaataagtgttaaaggaataactattctatgaagcagataacattaaggtaaaatataggcttagagtatgattttaacaatgatgtaacactaggtaatggaaaactcatgtaagatgttgctagatgtttttgtttttcttaagtttgagaagtaagacataaagtttagttatacattttcccaagcacatatcctatatctaaatacataattaatgcacagttgagacagtctagtttaaaaggcttaggtccttttgtagtccataagcatggtgatttggtttcatgctcatgtgtcagatatgcttccctcaaaccttgttacagcatcatcacattacctgtttgatgtaaaaaataaaaaatagaaaggtgtaagtatataagtaattttttggtacaatgaaaatggccagaaccaggggatgatcttaaactaatcacttggataactattaggctggtgcaaaagcaattatggtttttgtcattaaaaaacaatggcaaaaaccacaatcacggccggtcttggtggctcacgcctctaatcccagcactttgggaggccgaggcgggtggatcacgaggtcaggagatcgagaccatcctggctaacacggtgaaaccccgtctctactaaatatacaaacaattagccgggcgtagtggcggcgcctgtattcccagctactcgggaggctgaggcaggagaatggcgtgaacccagggggcggagcttgcagtgagccgagatcgcaccactgccctccagcctgggtgacagagcgagactctgtctc

SEQ ID NO: 210034 - DNA, 743 bp, Homo sapiens
gtctcctagcaacaagttgtaccatatgaggacggccgctgagccataatggagatatcaatgcctccacctcagatatatgtagaaaaaactctggccattatcaaaccagatattgttgacaaagaggaggagatacaagatattattcttagatccggattcaccattgttcagagaagaaaactacgcctcagccctgagcaatgtagtaacttttatgtggaaaagtatggaaaaatgtttttccccaacttaacagcttacatgagttctggaccacttgtcgccatgatattagctagacataaagccatctcttattggttagaacttttgggaccaaataatagcttagtagcgaaggagacacatccagacagtctgagggcaatttatggcacagatgacctaaggaatgcacttcatgggagtaatgactttgctgctgcggaaagagaaatacgttttatgtttcctgaagagaagttgtaaacctttgagaagtggacatacgaggaagaacactgaagtttttggtttgtttttaatatttttagagcagaaataaaatttggtgatttttgttataaggaaaaaaatgcaaagcattgagcaaaattttggatttttttagtatgttatttttcctgttatgacttatttttccctaagtcatttagatctgttcctcagtattttccactggatattcattcaaataaaacagaaaactgtcttgg

SEQ ID NO: 210035 - DNA, 1615 bp, Homo sapiens
gtctcctagcaacaagttgtaccatatgaggacggccgctgagccataatggagatatcaatgcctccacctcagatatatgtagaaaaaactctggccattatcaaaccagatattgttgacaaagaggaggagatacaagatattattcttagatccggattcaccattgttcagagaagaaaactacgcctcagccctgagcaatgtagtaacttttatgtggaaaagtatggaaaaatgtttttccccaacttaacagcttacatgagttctggaccacttgtcgccatgatattagctagacataaagccatctcttattggttagaacttttgggaccaaataatagcttagtagcgaaggagacacatccagacagtctgagggcaatttatggcacagatgacctaaggaatgcacttcatgggagtaatgactttgctgctgcggaaagagaaatacgttttatgtttcctgaagtgattgttgagcccattccaattggacaagctgctaaggactatttaaatttacatataatgccaactctgcttgaaggactcacagagctttgtaagcaaaaaccagcagatcctttgatttggctagctgattggctgctgaaaaataatcctaacaaacccaaactttgtcaccatccaattgtagaagaaccttattaaaaaaaaaatcctcgaaagaacaaatcatgaactatcttattataaaaggctgtacttctactgtttgaaaaaattatttctagggtttaagtaactacaagtaaaataaatttatttcttaaaaataagtgttaaaggaataactattctatgaagcagataacattaaggtaaaatataggcttagagtatgattttaacaatgatgtaacactaggtaatggaaaactcatgtaagatgttgctagatgtttttgtttttcttaagtttgagaagtaagacataaagtttagttatacattttcccaagcacatatcctatatctaaatacataattaatgcacagttgagacagtctagtttaaaaggcttaggtccttttgtagtccataagcatggtgatttggtttcatgctcatgtgtcagatatgcttccctcaaaccttgttacagcatcatcacattacctgtttgatgtaaaaaataaaaaatagaaaggtgtaagtatataagtaattttttggtacaatgaaaatggccagaaccaggggatgatcttaaactaatcacttggataactattaggctggtgcaaaagcaattatggtttttgtcattaaaaaacaatggcaaaaaccacaatcacggccggtcttggtggctcacgcctctaatcccagcactttgggaggccgaggcgggtggatcacgaggtcaggagatcgagaccatcctggctaacacggtgaaaccccgtctctactaaatatacaaacaattagccgggcgtagtggcggcgcctgtattcccagctactcgggaggctgaggcaggagaatggcgtgaacccagggggcggagcttgcagtgagccgagatcgcaccactgccctccagcctgggtgacagagcgagactctgtctc

SEQ ID NO: 210036 - DNA, 1561 bp, Homo sapiens
gtctcctagcaacaagttgtaccatatgaggacggccgctgagccataatggagatatcaatgcctccacctcagatatatgtagaaaaaactctggccattatcaaaccagatattgttgacaaagaggaggagatacaagatattattcttagatccggattcaccattgttcagagaagaaaactacgcctcagccctgagcaatgtagtaacttttatgtggaaaagtatggaatgatattagctagacataaagccatctcttattggttagaacttttgggaccaaataatagcttagtagcgaaggagacacatccagacagtctgagggcaatttatggcacagatgacctaaggaatgcacttcatgggagtaatgactttgctgctgcggaaagagaaatacgttttatgtttcctgaagtgattgttgagcccattccaattggacaagctgctaaggactatttaaatttacatataatgccaactctgcttgaaggactcacagagctttgtaagcaaaaaccagcagatcctttgatttggctagctgattggctgctgaaaaataatcctaacaaacccaaactttgtcaccatccaattgtagaagaaccttattaaaaaaaaaatcctcgaaagaacaaatcatgaactatcttattataaaaggctgtacttctactgtttgaaaaaattatttctagggtttaagtaactacaagtaaaataaatttatttcttaaaaataagtgttaaaggaataactattctatgaagcagataacattaaggtaaaatataggcttagagtatgattttaacaatgatgtaacactaggtaatggaaaactcatgtaagatgttgctagatgtttttgtttttcttaagtttgagaagtaagacataaagtttagttatacattttcccaagcacatatcctatatctaaatacataattaatgcacagttgagacagtctagtttaaaaggcttaggtccttttgtagtccataagcatggtgatttggtttcatgctcatgtgtcagatatgcttccctcaaaccttgttacagcatcatcacattacctgtttgatgtaaaaaataaaaaatagaaaggtgtaagtatataagtaattttttggtacaatgaaaatggccagaaccaggggatgatcttaaactaatcacttggataactattaggctggtgcaaaagcaattatggtttttgtcattaaaaaacaatggcaaaaaccacaatcacggccggtcttggtggctcacgcctctaatcccagcactttgggaggccgaggcgggtggatcacgaggtcaggagatcgagaccatcctggctaacacggtgaaaccccgtctctactaaatatacaaacaattagccgggcgtagtggcggcgcctgtattcccagctactcgggaggctgaggcaggagaatggcgtgaacccagggggcggagcttgcagtgagccgagatcgcaccactgccctccagcctgggtgacagagcgagactctgtctc

SEQ ID NO: 210037 - DNA, 557 bp, Homo sapiens
gacctactttctggatccagtggtctaagagacaaataaataagcttcctagccatggagttaaaggcttttgcttagtctggctctgcaagtggggtttctacaaaatagaaattgacaaaagtggcttaggtatatgttttagttctagcacctagcacacagcaggggctcaataacgttcattgagtgaatggagctgcctgcattgctcatggctgattcactcactgcagcagcctgtgctttcatggatggataaatgatgaatggagggagaaaacaggatgctatgttgatgatatatgaaggcaaagaaagatcctattttttttctagatgactgtttcacatgctaaacaaattctggttaggactagtcaaaaatctttaacaaataattgatcaaattatattgagcatctaccttgtgctacccctttagaaacaaaattgctcgagatgatccacagaaagcacttattattgaatatgaattaaaatatttacggttattttcaacactgggaagcctagcacttgtccactgcactgag

SEQ ID NO: 210038 - DNA, 538 bp, Homo sapiens
gccatccagcaagcctcttgcacagccagacaatctgccactctgccagtttcctcgccagcctcttggttagcctcccatgcagccagcttctaggccagcctcctaacaagccagacttgcattccgactcttagccagattcagcctgccaggatctcagcaggccttttagcaagcgtttatggcagcctctcagacagaaagcctctcccacaggctctaggccagcctcccagtgagccagcctctcagcaagcctctatgctacttttcaagagagtccttcagtacaccagcctcccatgcagcccgcgccttggccagccttccagccagcctctagcataaaaaccacttaagaaggccctgttgcttcccttcaccctaaaacactgcagagagtgccctgaaatatttgaaatgttgaaaagctgaacctacaaatgtcaaaacacaaatgtatatttgttattgggaatgtttttctcaacaaaaattgaaacattaaaaataataaaatctaattacttataaa

SEQ ID NO: 210039 - DNA, 535 bp, Homo sapiens
ggtccccaactgtaacacagcgttgctgaggggatgatgtgggcacacgtctggctggggctgcagagcacacggtgcctccctgatgctccacggtgactgtgggcagagtcccctcctcggagccgggagcactgcttcctgcctggtaactgcagggcaccgcggacctggagttcggccccgtgtggccctgctcacctctgcctggggatctgagagctgccctaggcctcctgctcccatccccgctaaagccaacttcttcctgggcctcacctgccccagccatccaggcccagtctggagctgaccagtgggcagcccaagaaggtccccatgggtccctgggccctctgtcgtggcagcaggggagcagccctggctgccccaagccctccgtggggatgcaaggggagcgcccacccctcctgtttttctgtgctcagataccccccccaaccaactgtcattaaaataacaagtttctgttacaatctaaacattcccacatcgcataaagggttatattaca

SEQ ID NO: 210040 - DNA, 356 bp, Homo sapiens
ttattgatactgctgccacttcccgtaagtgactgcaaactccaatacgaaaccttggaaacttgtggctgcggagatgctgatgcaggtacccccaacgcattctaacatgaagtgttccttggggaaacagttgggcatttctgagcatgtcagcagggctctctgctttggccatctcatagcattttgtttcccctgactatcccgaagttacggatccggcttgctgattgctcttagctatatagtgcgcagatatgctagaggctgtctagctgggtgaactgttgcggttatcgttgtcgtacgtggcgacgagtgtgaccctgtctcccggaatttcaagggccagc

SEQ ID NO: 210041 - DNA, 786 bp, Homo sapiens
tgttcttctccttcaatattctgttgtatattctgggtcttttgcctttatataaactttagaatcagttttgatattaacaaaataatttgatggataattggataatttgattccacttgttcattgctgttacacaggaagacatctaactttttatacttattaattctatattctgcaatcttgctataattgctttttctaggagggtgtttttttgttttgtttgtcaattcttttggattttctatatggaaacaataatattatctgcagccaaagacagttttatttcttctttcccaacacgtgtagcttttctttctttttcttgtcttatttcattagctaggacttcaggtataactatggtgaataggagcgaaaggggatatccttgtcatgttctcaaacttaggggataagcatctagtttcttactattaagtatgatgttagctgtaggttatttggtagatgttctttaccagttaaggaagttcccctcttttcctagttagctgaaagtttttatcatgaatcgtagttggattttgtcacatgctttttctgcatctatcaatatgtatgatcataccattttttcttccttagcctgttgatgtgatgaattacattaactgctctttgaatgttgaaccaaccttgcctacccgggataaattacatgttgccatgttgtgtaattattcttatacattgttggatttgatttgctaatattttgtagtgtctttggtttttgtgttagggtgatgctgg

SEQ ID NO: 210042 - DNA, 443 bp, Homo sapiens
tggttcagctactactttagatgtagatcttgaacaagtttcaaaaatgaatgaaagtagctttttatgaatctgggcccgatctcccgattgcccctccagagcagctccctgcccttccctgcccctgaaggctgacctgtgagcccctttgggctgctgatggacctgtgctcccctatcctatacccatataaaccctgaaccccaggctccagctcagaccagcagaggaggagacgagacaagcagacaatgcagaacagtgcagcagagagaactcgagaggaattcagccagggtggtcagagaggagtttggctgctggacagcccactccaagggaagatcatcttcctactccatctcccctccttccagctccctatccatcctgccgagagccacctccaccgtgcattaaaacctcgcattcatccttc

SEQ ID NO: 210043 - DNA, 243 bp, Homo sapiens
ttggtcacacagaagaccaggacacagacaggacacctcttgagctttgctgccaaaagttcattctgctggatacacccgaaacatcaccctcaagttcaaagtttcacagatctccaggttaggggcatcatgcagtgacattctttgctaaagcaaaacaaatgtaaccttggctcctgttcccagtaaactcgtcattttcatctgagaccttctaagcctggcctttactgtccatcc

SEQ ID NO: 210044 - DNA, 563 bp, Homo sapiens
aatgtgtattgttagtatatctattctaatcattttatcttaaatgctgctcttgggagtgaatattcaagtgtgcatcaattttttgaatacttaccctggaagatataaactgggcaagtattttgtgctctgtgtatttttttactgcattagacattgaatagtaatttgcgttaagatacgcttaaaggctctttgtgaccatgtttccctttgtagcaataaaatgttttttacgaaaactttctccctggattagcagtttaaatgaaacagagttcatcaatgaaatgagtatttaaaataaaaatttgccttaatgtatcagttcagctcacaagtattttaagatgattgagaagacttgaattaaagaaaaaaaaaattctcaatcatatttttaaaatataagactaaaattgtttttaaaacacatttcaaatagaagtgagtttgaactgaccttatttatactctttttaagtttgttccttttccctgtgcctgtgtcaaatcttcaagtcttgctgaaaatacatttgatacaaagtttaaaaaaa

SEQ ID NO: 210045 - DNA, 852 bp, Homo sapiens
tattcagccttaaaaagtaaattctgacacaactacaacatggatgaaccttgaatacattgtgataagtgaaataagccagtcacgaaaggacaaagattgtgattacacttacatgaagttcctagaagaggtgaaatcatagaaaatagaatggtggctgccaagggctgagggatgggaaaaggggagctactgtttaatgggtacagagtctcaggaaggatgaaaaagctctggagatggatggtggtgatggttgcataacaatgtgaatgtacttaatgccattgaactgtacagcttaaaaggttaaagtggtaaattttatgttatgtatatttttacctcaattttattccaaaagtatatctgtgtttatgcccttcgttacccagagaggcatttagaggctggttcccaggactcccaggggctgtgttcactgtttggcaaacctttccctagaatcctcttcgaccagcagccccttggaggccccaacaatagctgaccccttgcatggccctcatcctgactcttcatctttctatgcagcatagcagtgggaccccattaaggacacttcctttatctagcgtctactatgtggccaagaaagagcaacccgggatgcatgacttttctttgtaagtttggcataaaattaaatatagattcactattgccctttttcttaaccgagcttctctgtcaaaaaagctaaacaaggcaagtaacaaaacagtcttaagcacagtgccatttttgttcttatatatgcacagagaaatttatggatatgtacaaagtgttaataacacctacctctgacggggaaaatgagcattt

SEQ ID NO: 210046 - DNA, 267 bp, Homo sapiens
gctgccttttgtggtcgactgggtttctgggcatgcatgggtgtcaagtttctggaaaagcaagcttctctaaattcattcccatttttctggcctggttaaaaaaaatcgtcttcataaactacagtgtatggggaaccagctggagatagaaagtggaggcacaacataatatgaactggaaaacagagaagctgctgaccgtcctgcacagggtgtggggagtttttcctgatctatttggttacttttacaggtggacaatta

SEQ ID NO: 210047 - DNA, 152 bp, Homo sapiens
atcgtacccagccaagaagtgctttctgtgggtgatgatatcttggctagatgtaaagggtgtgttggagttggccaggtgaaaacaaggggagaaaagtgttccgggcagaggaaggagcccttggagggaatggggaacccagagcttag

SEQ ID NO: 210048 - DNA, 577 bp, Homo sapiens
taagaactgagaaataggataaaggtaaaagtgttcattaggttttagaaagagtacttatagaatattttggaaaaaaatgacataggaaagcattacttttttcccttcaatttgattccaaaattttgggtgtctgttgagatctccatgtttttttttttttcattttatatgacaaaactagaaatattgtagttctgccttatcctcaggtgatgcctgaaatctaagatagtaccaaagtttatatacactatattccttcaatccgataacctagagggctactaagtggtcagtgtgtgggtaatgtagacagaatgaataagttgattcacatccagggcagaacagagtaggatggtgcaagatttcatcatgctacttagaatggcctgcaaatttatgaattgtgtatttccagatcacagaaaacaaaattgtggatgcgggggtactaaggtaacaaaactgtcatcttggttgttcctaaggtttcctgcattttagaaaattagagttaattataacaaaacaaagcactgagtgataacataaaggtcttatacattgc

SEQ ID NO: 210049 - DNA, 411 bp, Homo sapiens
tgtaaatgctacaccattttatatatgggacttgagcatccatggattttgtatatggaaggggtggtcctggaaccaatcccgcaagataccaagggatgactatatttttattatattacagcaaggaaaccagagtctttgaatctgctaactgtgcagaaaagatcctgagacatggctgggcacggtggctcatgcctgtaatcccagcactttgggaggccaagacgggcagatcactggaggtcaggagttcgagaccagcctggccaacatggtgaaaccccgtctctactaaaaaaatacaaaaattagccaggtgtggtggtgggcacctgtagtcccagctactcaggatgctgaggcagaggttgcagtgagctgagattgtgccaccgcactccagcc

SEQ ID NO: 210050 - DNA, 374 bp, Homo sapiens
atctcataaattcaatttctccatctagtggccttcccctcacccaggccctccccacctccctcctggaccacaacagcagctctaaaaggcttcccagctctggctatttcacagtccagaggcacccacatgctgatccccgcaaggcctcttcaggatggggactctagccactcaaattcttccattgctccccagtaacttaagtttaaatcatttagtcacatgccattcaaggccctctgggttctggcctccaaggacctttgctacctgatcttctccttagtggtttacacacatcattgcccagcaactacaaatcgattcctgcccactctgcaccccggcatttcccatccctacctatg

SEQ ID NO: 210051 - DNA, 304 bp, Homo sapiens
gagcagaaatgggcatgattgtgttgcagttcagtaaaaattaacaagttaaacggcttactggcctgtgtttacctcctgtgctgacttagctaatttggtgacattgcctcaatttttataactctgtgttgaaaaacatcaagtgcgatgctagaaatatactctgcctcttttctcttgtgtgtgtctacacacgtgtgcaggaagaaaataatgcagggagaatggtcagagtggcaggaactgccttagagcatgtgagtgcatttccaataaagataaaagtgagtgtctaacccaa

SEQ ID NO: 210052 - DNA, 488 bp, Homo sapiens
  misc_feature (448)..(448): n is a, c, g, or t
  misc_feature (467)..(467): n is a, c, g, or t
tcttcagtaggatgcaaattgaccaatcttttactcaacacccattaggtaagaatttcagcaatgtactgatccacttatctgctcatatttctccagtttatctacaaggatatcataggattttacattctttgcagaagtcacttgcatataacccagcttaagcggaggcttcactttgacctattcctctaggtccttgcaaatttttggtgttggtttttgcttgtggtattgcttgcatcatttatgcattttaaaaatcctgagcttgttacaattcttcctgtgtaactgctgatttcttggttttgtttttattgttgttttattatttttaggtacctctgcctttttattctgtatgtatgttatacttcaattaaaatatttttaaaaatatccctgatgccatggaaccaaaggacgagggatcctttaaagncgacttgagcttcaagctngactggccgcgttacaacgtc

SEQ ID NO: 210053 - DNA, 450 bp, Homo sapiens
gaaagagtattcctgacttacagactggggtagggggtggggaaaggagcaaacaaagcaagtggcttcatcaacatcccagagggaaaggcaggctttggaaaagaaccaagtgtttggaagttgacgaggagggtccacagccagggaccgcgcagtagagacgacagaggaacgcgacctttttttctaagtgcatctgaacttgcctttacttcggggctcccagtccccatcctctgggtcaacctagcagatcttcttgaaggctgacacccttcacatacctgtaggtagttctcctccccaccctgacccctgacccctagttccagtgggactgtcctccactgtagtcatacaaggagtctgcctcatctgcccctgtgcctcagccacagcccactgtgaatcactcggctccaaattaaaactccttccctctccgga

SEQ ID NO: 210054 - DNA, 175 bp, Homo sapiens
tggacaggcaaataattaattataaaagagggtattcaaaaagcctataaataagtgttcagcctcattagttatcaggaaaatacaaatttaaaataagatagtgctacacatctaccagaaaggctaaaatttaaacgactgacaataataagtgttgatgaggaggctgagc

SEQ ID NO: 210055 - DNA, 513 bp, Homo sapiens
atgatgtttttaactttcagattgggtcttaaagttgctagtaaattcaggtagcaattaagatgccaatatgagaatgtctttagcataccagtacgaaaatgattagaaagaggaatacttgggaggtggaaatgtatgtcaaatgtacataacagaaaggtggcatctgcatgaagtacaacagctactgacttctttaacagaggactatcaaaagatagacattgccaggcgccatggctcacgcctgtaatcccaatactttgggaaactgaagcaggaggatcgtttgtggccaagagtttgagaccagcctgggcaacacagcaagaccttatctctacaggatacttaaaaattagctgggcatggcggcttgtgcctgtagtcccagctactccagctgaggctgaggtaggaggatcagttgagcccaggagttcaaggctgcagtgagctatgatcatgccactgtcctccatcctggatgacagggcaataaccagtctc

SEQ ID NO: 210056 - DNA, 737 bp, Homo sapiens
attgttgcaattcttactatttttatttttcactcagttctcttaataactagcatgcctctatttcttttgtatgactttttgcagaaaaataattacatgtaaattctcgtttaggaaaggcctttatatttggggatcaagatctagttattaatgtatggtatttttatggaaatagctttattgaaatatagaacatataccaatagttattatatttatatttaatatatataatgttctaatatttaatatatataatgcactgatttttggtatatatacagttatgtaaccaccaccaaagtcaattttggatcctgtcatcaccccggccacattaattaaattaattaattaatgtatttatttattttcgagacagagtctcgctctgtcaccccggctagagtgcaatggtgcaatctcggctcactgcaacctctgcctcttgggttctagcgattctcctgcctcagcctccggagtagctggctttacaggtacgcgccaccacacccggctaattttgtatttttattagagacagggtttcaccatgttagccaggctggtctcaaactcctgaactcacgtgatccaaccacgggggcttccaaagtgctgggattacggtgtgaagcactgcacccagcacatttattttttattgattaatggtgggaacaatcttgaatgggcggcctgggttgagcttggggggtttgttttgg

SEQ ID NO: 210057 - DNA, 259 bp, Homo sapiens
caagtgcactttgctctccctcccccattcccctggtgtaagcataccacacagtctttgagttcacattattatttgtgtcatatagatactgttcacatgagccaggaagagtacaacttttttcttaaattatcacctctcaaaaaataactttgttgtctacatacgtgtcttccaatgagccagaagactccctatgtcagcaaatccactggtgccatgacttcccactgagccccctgacttcctgttctgc

SEQ ID NO: 210058 - DNA, 292 bp, Homo sapiens
gtgaaattttaggtatcaaccaaaaagttgaggcttttcttttgtgtaagaaatttccagctactaatcaaatgactatatataagtagcaaactatccccactattattaataaattacatatttttctttatcctatacaatttcataaatgtactcacattttataataactataatttgaatagtcatagtatattcatgtctccaaagtgctgggtcatgagttagatgagttaggcagatcatgggttccaagtctacctccctgggtttacacctgcaccattga

SEQ ID NO: 210059 - DNA, 466 bp, Homo sapiens
cagaactgggatggtgccactgtgtggtggacttgaccaatgcattcttctcaatcagcattgctccagagagccaggaacagtttgccttcatgggagggcgacaatggactttcatagtgttgctgcagggctatatgtatagccccattatatatcattttcttattaatgatgttatgttaacctctagttcttttgctggtttggaggccacaacacccctcttgcctgggattgggatgatgaggctgaaacagcccttctgatgacataagccctctgggtggttaaccagggtgcccatttaaactagatgtgcatgtaaccaccaatagagttggctagggcctatggcagtatatggagtgcttggaagcgccagtcagcttttagtcccagctatggaagggagctgagccccagtgttcattaataaagaagcagttagtaaccatatatgctg

SEQ ID NO: 210060 - DNA, 399 bp, Homo sapiens
tgctcacaaaaggaacttccagagaaagaacaggataccaagtctaaataaatttggaagacaaggagaatatcatagtttagttcaatcttttagacaaattgccacaatttatacgttgggataagagaaccatgagaaaaggtatattctaagtcctgaacatctttctataccctgaagatgtttttatagctcttctgctgactccctggcaaaaaaactatttacggtttggggtagggggcgtgtcatgccatacagctaaatacacttttttcctaatctaggaggcatgtctacttacaaataaattgcttaaactagttaggcttgtgtaaatgtaactgacatttccttgagatcagaaaaagttttgctgattaactatatttgtgt

SEQ ID NO: 210061 - DNA, 556 bp, Homo sapiens
ctctccggaataattgtcttcccccatccccacctggacatatcctattttttcccctcactgagcattctgtctacataaaccaaccactgtgcagtactttacataccttaacccagttaattattgaaataattgtatgagacatctgttactatgatactccttaaagatgaagacagtaaataatttgcccacagttacagtcagtgggtgatggaatcagagttcagatttaaatccagattttttaatgctaatgattatgtttttaacctataccctacatagccatcaatttaaaaaaactgacttgtaatcaaaatttattaagtagaggctggcacagtggtgcatgcctgtaatcccagcactttgggaggctgaggcgggtggatcgcttgagctcagaagtcttgaaactagccggggcaacatagtgaggcctcgtctctacaaaaaacacaaaaattagctgagtgtgacagaaaaaataaagattataaaatgtattaagtagaagtataatgctggatgagaaattaagtgagaattg

SEQ ID NO: 210062 - DNA, 335 bp, Homo sapiens
cgccaacggggaaagggaagcccccgtctctctaactgcatgttatcaggggtgagcctgcctttcctatcttgggacctgtgggctcatgttcacacctatctttctcaccttttttttgagatggagtctcgctctgttgcccaggctggagtgcagtggcacgatctcagctcactgcaacctccgcctcctgggttcaaacgattctcctgcatcagcctcccgagtagctgggactataggtgtgcgccaccacacccagctaatttttgtattttcagtagagatggggtttcaccatgttgcccaggctgctcttgaaatcctggcct

SEQ ID NO: 210063 - DNA, 827 bp, Homo sapiens
cccaagttcttaatcaaataaatgacttgaaaatatactcagtctttttattctctcactagagtcttttacagaatagacatttttcattttaattaagtctatttatcaatttattattttatggatcatttggtattgcatttggaaaaatctttgcctaaccgaaggtcaaaattcttctcttacattttcttctagaatttttaaagttttaagatttgaatttaggtttctaatccattttgaattggcgtttttgtactacattttttttccttcacctctatatgtagaatcaattaaggtaataatagtttctatctgaaatgtcctgctaacacacttacctatttcaatactcattctaccttcccgtctccctgcattttgttttttttttttacatcctttcacccaggctttagctcccatctccttctaagtcctcacgcccttgctgtgtctatgatactaatgtgattcagaccatttctctcccagtttctttccttcatatatatgcaattttaagtctttcttatttaaaataataataataataataataatgctttttgaagctgcatagctttctaactacataacattaacttgctttgttcttttcctataaaactattctcttgaaagaattatatattctctcatttctctctcttccaaccaacactgccaggtttctggcccagtcatcgcactgacactattcttaccatcaacacttgtgatttccctttgccacttatacagatcccatttcagcattcatcacacaggtctccctgggaggcatttacactgtg

SEQ ID NO: 210064 - DNA, 367 bp, Homo sapiens
ggatttgtctcattgatcatgtaggttgtacacgctgagtcttaataaaattcagttctgtgcagacatgtctgctcccctaaaactatataagcaagcacattatttggcacatgtctaatagaacaaaatgtcaggcaaagttcaagcatgtccacttagcctgtgctcttaatacagtctgccttattcagttggttacacaataaacatgtaatatattcaactatgataatattgtgctatgatcattttaatgattactaggaattaaccagtgtttcttgtctgtttttttagtaaactgaatgaatgagttcaacgtatacattttgggtcaaaatttaccatacctaaaactgcagaa

SEQ ID NO: 210065 - DNA, 863 bp, Homo sapiens
gagagagcctgttgtttttgtgctcatggctgtgatgtagtctgcctgaaaccatggttacggtttcacagggaagctccaacaagccacatgcgtagaactctagatttgtggtttgcactttggaaagcaggcaaacctttatggaatcccagagaactccatgccattctattctacttcacagatgtccctcatctctgcttccttcagcccccacaacagagctcccactcattccccatttcttttccatgcatggcctttgggccctttcctcatgaatgcagtgcatatgagagggggagtggaagggataactaatttcagaggtagaccttgactctgaaaacctgtgattttggagttgttgtttttggacaggaagggggtggaaaaaacttgacgctggtagctaggagatgggagccttttgcagtgtatgcagatgaggggcttggacagtggggcagagagcagggatgaggagcagcaggtctgcatttatccatagaacagatgttggttggagggagagtgtctttgtatctctggtgatgcttcactggggcacaccccaaactctgggagcttcaggacactgtccccaccttcatccctcctagtgaagcatgcagtgggaacttgtttggttatcatcctctaaggttctcaaattcatgttggatttggccctaggccagatcatctagtgcacaggcaagttttacagatgaggacattgagttccagagaagctagttggggaccgagggtcacatgacaagcaaaggtgggttggaagtagggccctcaccgcctgttgcccatggcttgtctgatggggagccgagcctgcccat

SEQ ID NO: 210066 - DNA, 490 bp, Homo sapiens
tgggctaaaaaataagtctttacacttggataagaaaagattttgtgagatatttgctgtggaggtgatgatcagtgcaagagtggaaagtttaagaggtgaatgaccactggtgtatttggctgatggtatgtcgaaccttagtatagcccgcccttaattaaaccttccactttaagattaaacttaatgtggttttaagactttgacatgtgtatcagttagtgttcattgtttctgaaacatagcagagaaaaactctgaataatacgaccaaggaaaagaagaatttatttgaaggatatgagatagctcactgaatcaaacaaaaactgtgtactacattgacatgtgacattcatccctgaaaggcctgagccaaattttttttaaaaaaagaccaaaaggatatattaatatgtgacacgtttatttttaaattttagcctttattaaaaaattaacgtaataaaaaagaaacctatgtata

SEQ ID NO: 210067 - DNA, 548 bp, Homo sapiens
aagacaggagaggagcaccacctgatgagcacacactccagccagttgttgctgggcgtgagcacatgtccagggttgccaaagcgcagtgctgaggaaagccacacacctgacagctacccacaaattgtttgaaatgctgggaggatcacacaagacacgtcttgtaagcctgtctgggtcagggactgcccgtttatcctgggcagtgcattgaaggtccagaatgtgccatccacagccaggctctattttcacctcctcccaccagtctgtcctctagtacaaactgcgtgctgttctccagcatgccatagtttcacaccctcatgcccttccacaactctattcagccttcagaaccaacctccaatgtcacctaaagggggctttcctgccatccctgctctcggacaagtaaccacatcgccacactgccgtgttgctctagacccatatctggaggcctccctgggttcctcccttggcctcagtgctggacaccttctccacccaggtgtcctgacagcttcattctctacatgtat

SEQ ID NO: 210068 - DNA, 592 bp, Homo sapiens
tactaaatatcattttaatctgctttctcttctaattctgatgccacctaaacctaacctacccatcacctcttaaaccaagtagagtctcatttttcaaataataaagcacaggtacatcttaaaaatcacttttatttgaattttagttggtgtggcatcacagggttagtatgagcagctgcactgtggatggaaacagattgagaaagtgttttccaggtgaaccctaaataaacaaaactaaatgcttgtctagcaaaacaagaaacaagatgtaaaaacacgcaaagctgttttcccaagttcaagggaacagacagcccctctagctgctactagatttcctcagtcagtattttttttgacttttgtggcttaaaaatacagtttttcatctgtattatcctatcacaaaatagttcgaaaataatgccaggtatatttaactgatggatataggtaactataatataaagtgtggggatggtgtccataaagtctagaaacagggaaatgtacatcatgatgtcaatggcatcttcaaggtgtaaaaaatttgtttattatttatgtgtttttgattttatga

SEQ ID NO: 210069 - DNA, 533 bp, Homo sapiens
aggcaaaggcgcagagggtaggggcaagcaacaggaagttgggctggcaggcaaacagcaggcctcacgtggcagattccatacctctcctgccatggctggccccagcttttcctccagaaagatccctgccaagaattagccaaggagaaaaaagaaaaacacacaaacaacacacacacacacacacaaagaaaaaagattacacattctgtacacagctaacaacaacaaaaaagggtcaaaacctcacatgctaaaattacaatggaagtgtgagcttcactctttcttaacaggtgaacagtggggcttgttttaactaaccttgtacggacttacggactggtagtcctatccagaaagcaaacatcaagtattcattagcataaccatcacaaactctcactacatccctattacataatactgcctaaagtttttccctcagaaaactgctccttcaattcttctctggtgtgtgttctcttgcctggcaaatcaataaactctgtgctcactttgatgatcac

SEQ ID NO: 210070 - DNA, 321 bp, Homo sapiens
acccaacaaggtaaaattcccaatatttagcatccaatcaaaaattaccaggcacataaagaagcagggaaatatgactcatggtaaggagatcctgacccagagctgtcacaaagattagaattagcaggcaaggatattaaaaacagttataattatattccgtatgttcgaaaagttaagtagagatacggagatatttttaaagacccaaataacacttctagagctgaaaactacaaagtctgaaattaaaaatatatccttggatgagattaatactgtagacattgccaaagaagagattactaaatgtgggcc

SEQ ID NO: 210071 - DNA, 545 bp, Homo sapiens
tagcgggaatggtggcgcgtccttgtagttcctaatcgggaggctgaagcgggatcccttgagcccagtaggtcaagggtgtagtgagcagtgatcaccacactgtacttcagcctgggtgacagagcgagaacctgtctcaaaaaaagaaaagaaaaaatatggctgggagagaaggggatgtgtccagtaaagaaagaagtgttgcctgtttcagtggggtgggtacctgtccaagaccttagaaattggacaaggcggccaggcgcggtggctcacgcctgtaatcccagcactttgggaggctaggcgggcggatcacccgagatcaggagtttgtgaccagcctggccaacatggcgaaaccccatctctactaaaaatacaaaaattagcggggcatggtggcgggtgcctgtaatcccagctactcgggtagctgaggcaggagaatcgtttgaacccaggaggcacaggtttcaatgagccaagattgcaccactgcactccagcctgggcgacaaaacaagcctatatctccaggg

SEQ ID NO: 210072 - DNA, 724 bp, Homo sapiens
gcagatatcttagtttgaagtaaaataaaaattgtagtctgatgtcactaattaaaactgtttacttttctttttttttgagacagaatctagctctgtcacccaggctggagtgccatgctgtgatcttggctcactgcagtctctgcctcccaggctcaagggattctcctgcttcagcctcctgagtaactggggttacaggtgtgtgccaccacgcctggctatttttgtatttttagtagacacggggtttcaccatgttggtgtggtggtctcaaacttctgacctcaagtgatctgccctcctcggcttcccaaagtgctgggattacaggcgtgagccaccttgcccagccaaaaccattttcattaggcacagagtattgcaaagattgtaattatcttgtattttcttttttttttttttttgagacgagtctcgccctgtcacccaggctgaagtgcaatggtgcgatttcggctcactgcaacctccgcctgccaggttcaagcaattctcctgcctcagcctctggagtagcacgcaccattattcctggctaagtttttatatctttagtagggacggggtttcaccatgttggccaggctggtcttgaagtcctgaccttgtgatctgcctgcctcagattcccaaagtgttgggattacaggcttgagccaccacgcccagctagcttgtatttaaaaaaaaaaaaaa

SEQ ID NO: 210073 - DNA, 332 bp, Homo sapiens
aagagagagggttgtagattacatgatgttctaatagaaggtaacagcataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtgttgtagattacctgatgtccaaataggaggcaacagcataaggtcctcaaagacaaacttgttgtagattacctgatg

SEQ ID NO: 210074 - DNA, 329 bp, Homo sapiens
tacagacatgagtctaccatgcccagcctggtcactactttctgagaatattttttagtctctgtaaggagaggtaggaaacatgtcagtcctcttagcagtgagcttgcaagttgttgttagaatatgttattgctctacgtgcttcattttcttggttaactatggagccactttgtctgatgactgtatagtcagttttccagagaaacagaaccaataggatatatagagatatagaagaggagatttattatgagaattggtttaggcaattatggaggccagaagtcccatgatctgccatctgcaagatggtagaaccgact

SEQ ID NO: 210075 - DNA, 131 bp, Homo sapiens
gagttagtattctcatgttccagcagagcaagtaatttatagtcatgttgatgatcctgtgtcaccaaacaaagattaatcatattctggattctctgaagaaggcattaccttttagaaaaaaaaattaa

SEQ ID NO: 210076 - DNA, 577 bp, Homo sapiens
gatagatagctagcaaaaaacattcgactgagcttcagaaacaagttctctggaaactgaaggacaaaacactggctggacattcctggcagtgagctacggatggcataacatagcacctacatctccttagccatttgttctagtttgctctacattaacaattcacaacaagaagagtggaaagtgttaaggagctaccatttagtgcctctgacacctcagctactatgcaagttgtttcctgtagcctacttcatttgatcctcagactgacttgctatcttctttgtaaaaatgaggaaacgagagctcagagattcaataatttgcccagcttcatatatttattgagtggcatgtgctctcatctatgcttaaatgtaattatgtgtacttaaaggcaaatatcgttctccattttccacatatccaagattttagggatgatagggtttctctgagttatggttggtaataaaaaagaaactttttcgtattagagtagtttgaggatagagcaattatcatgtaaggtatactgctcagagtctatgcccacctcattcaggccact

SEQ ID NO: 210077 - DNA, 282 bp, Homo sapiens
aacccaaaatgaagatccacttgtgtacaacttagtaagaaattaaccttttgccatatttacttcatctctttttgcagaagtttgttagcattgacatccactgtgtaccattcttcccattttcaatcccttttccttcctcctctctccagagataggcactcccttggtttttaatgcagtctgtagacatgcatattgctttgcatgtttttaaacattaacaaatggcatcatagtgtacaaatcattctgcaacttgctttttcactaaacatt

SEQ ID NO: 210078 - DNA, 241 bp, Homo sapiens
ttcatattataagacgttttaggaatattggatctggtagcctattgcctcaggtagggtcaaataccccatttaatattatataatgtttattaattattagtgtgaagtatagaaagctctcactttcttctgttgacaagtgtgacatggaattttacttggaattcagagttgggagaattctgagaacttagggactgatttgagtaataataaaactccagtctcccgtttaaaa

SEQ ID NO: 210079 - DNA, 859 bp, Homo sapiens
gtcgggagttggagaccagcttgaccaacatggagaaacccatctctactaaaaatacaaaattagccgggagtggttgtgcatgcctgtaatcccagctactcgggaggctgaggcaggagaattgcttgaatctagtaggcggaggttgctgtgagccgagacaccagcctgggccacaagagccaaactctgtctcagaaaaaaaaaaaaaaaaaaagaatctgttagacatggagatgtgtacatgcgtgattgacaaagctacagagcaagagagaggataatagtggtaatgagaaggatgagctcttggatgacttctagttttctgggttccatgctaaggtggatagtgacttccatttataaattagggaatataggaagatgcacgtttgggaacaaaagatgagatgtttggtttttgaatggttgaatttgaggtacctgtggaaccatatggaaatgcctgctaggtagttggatataccagtccagagtcagagaagttgggactggagagagatttgggagtcagcagtatagtagtatatacgttgtagttgaagtgatggtttgggtcagctaagaggcatgttgagactgaagagctgcaggctgaggagaggacttagagaacactggtagttaaaggtgtgactggtggaagtggagccccagaagaaatctgaggaggcctaaagatagatggaaaactagtaaagcctgggcgcagtggctcacgcccgtaatcccaatactatgggcctaggcgagaggattacttgaggccaggaatttgagaccagcctgggcaatataatgagacctcatctctattaaaaaaaaaaaaaaa

SEQ ID NO: 210080 - DNA, 424 bp, Homo sapiens
ctcccttccaccagtcacacctttaactaccagtgttctctaagtcccttccccagcctcccttcccctcagagaagttgggactggagagagatttgggagtcagcagtatagtagtatatacgttgtagttgaagtgatggtttgggtcagctaagaggcatgttgagactgaagagctgcaggctgaggagaggacttagagaacactggtagttaaaggtgtgactggtggaagtggagccccagaagaaatctgaggaggcctaaagatagatggaaaactagtaaagcctgggcgcagtggctcacgcccgtaatcccaatactatgggcctaggcgagaggattacttgaggccaggaatttgagaccagcctgggcaatataatgagacctcatctctattaaaaaaaaaaaaaaa

SEQ ID NO: 210081 - DNA, 671 bp, Homo sapiens
agggagtgctcgtcttttggaacaaaagacgagaatctgttagacatggagatgtgtacatgcgtgattgacaaagctacagagcaagagagaggataatagtggtaatgagaaggatgagctcttggatgacttctagttttctgggttccatgctaaggtggatagtgacttccatttataaattagggaatataggaagatgcacgtttgggaacaaaagatgagatgtttggtttttgaatggttgaatttgaggtacctgtggaaccatatggaaatgcctgctaggtagttggatataccagtccagagtcagagaagttgggactggagagagatttgggagtcagcagtatagtagtatatacgttgtagttgaagtgatggtttgggtcagctaagaggcatgttgagactgaagagctgcaggctgaggagaggacttagagaacactggtagttaaaggtgtgactggtggaagtggagccccagaagaaatctgaggaggcctaaagatagatggaaaactagtaaagcctgggcgcagtggctcacgcccgtaatcccaatactatgggcctaggcgagaggattacttgaggccaggaatttgagaccagcctgggcaatataatgagacctcatctctattaaaaaaaaaaaaaaa

SEQ ID NO: 210082 - DNA, 381 bp, Homo sapiens
acaaatgctgcttctgtggaattttgtgtttcattgcgctaagcatatatgagagatagacaatggattcttgctggaataagcccaacccagagaatgtctgctggggttccctgggccatgtgctcaactagagcaggagagtttgtacccacaagcctctgcccttgtcagtgtgcaggttctttcatatggtttttcatccctgatgtattcatgtaggcaggtcctgtgtgactgtcacgatatcaggtcaaagtctcatcttacagggaatgaaatacactggagagagacttcgctgaattcgctgttgtgaaaaacacctgtgaacactgtggctgaggatgccaaagaagaaataaacttttaaaaactatt

SEQ ID NO: 210083 - DNA, 285 bp, Homo sapiens
ccatctctcccatcagcttttgatcacactatttactctatttcaatactctacagcaatcttatccatgaaatatttttgaatcaattatctgaatgaatatgcacattttactccagggaaaaaatagagctcatctccactaaaatcctaatcattttatctttctaaaacaactgcagaaacattaaaatatcaatagatatctagctaaaagaagtacattattcctaagtcatgcaatcaaactgttaattttattttccatcattttaatataattgc

SEQ ID NO: 210084 - DNA, 1557 bp, Homo sapiens
ttttgtttttttatatagttatttgagagaataaaaactgaggacgagaagccttggaaatgaaagtagaaagtccgctcctatactcaccgctccgatgagtgttgtaccttggatttccagccaatgcaccaaaatgatatggctccaatgactggagaaacaccagggtccttcgtctcctgccaattagacaaatgacatggacacacgtggagtagttttaaggagtggaaagtttaattaagaaagaagaagaaaagctccccctgtacagaggaaaggggtacccgaatggagaaaacgccatgtgcagtggaaaagcagttggatatattgggaggctgaaggaggtggtgtctgatttgcatagggtccagggaattggtgtgaccagatgtgtcattcatgtagcccatgaaaaacctggccctctcaccctagtcttttaatatgctaatgatgggcgccatgatgtcctgcacacgtggtgttatctggagatggccatgacacctggcacaagttgtgacaaggacaagagagcgggaacggccctgttgggtggacctggtttctaatcaccagtatttgcatatcaatgcttgctggtctggtttttcaagctgctttctgttagaaaagaaatgttttgggggttgctttttattaaaccaaaattccactgagaaccattaccctttctagctgcctaaaaattatttcttagtaactcctgtattaacaacactatttacagttgcaaagtcacgaaacaaacaaaggtgtttatcaatctttgactgaataatgtactaataggtaatttgtgcatatacctgcaatactacatagctttaaaaaacaatgaagacaggcaatttgcagcaacatggatggagctgaagtccattatcctaggtgaagtaactgaaaggtgaaataactgaaaatcaaataccacatatttccacttgcatgtaggaaataaacatttagtatacatggaaataaagatgaaaataatagacactggggactccaaaatggggaagggtgagagaggttgaggtttgagaaactacctattcctatttggttaatgggtacactacaagcccaatcccacacagtatgcaatatatccatgtaacaaacatgcatatgtaccctttgaatcttaaaaatcactaaattgaaaaatatttaaaaagtacatttataaatattttattcatttaacttctataaaccagaaagcaagacctcaccagatattgaatctgccgccactttgaccttaaacaccctggcctccagacttgggagaaataatgtatttctgtcattataagctacccagtttgtggtattttgttatagctgcccaaatagacagactgacacaatccattattttttattgtatttttcagatccaagatttcttttttttttttatactttaagttctaggatacatgagcacaacgtgcaggtttgttacacatgtatacatgtgccatgttggtgtgttgcacccattaactagtcatt

SEQ ID NO: 210085 - DNA, 904 bp, Homo sapiens
aagcattttggcaacatttacaagaaatcaacaaaaacagttaacacatttttgacccagttaattttactttggagaagtaatggaataggaattccgaagaagcatgagctcatcattatagcattgtttacatccaccaggagatgaatgtttaagtaaattatggctgggcatttaatggaatttttatccttcaacagtgcttttcatacagttaatggaaaagaacagagtatgaaatatatgacaactcttcttaaaaatatgtaaggatataggcgaggtgcagtggctcatgcctgtaatcccagcatgttgggaggccgaggtgggcggatcacctgaggccaggagttcgagaccagcctggccaacatagtgaaaacctgtctctactaaaaataaaaaattagccaagtgtggcggcacgtgcctgtagtcccaactactcaggaggctgaggcaggagaatcacttgaatccagcagccggaggttacagggagctgagattgcaccactgcattccagcctgggcgacagagcaagactgtgtctcagaaaaaaaaaagtaagcatataaacttttcaggtacagttccctgctttttaaaataacatttcaagtcagcatagtgtggtggttaagataagccaggggcttcggaatcgttgatccttggcttcatattctggttctgtcacttcctattaatagctgtgtgcccttggatgagtcacttcacctctccaagcctttgtctgtttatctctaaaacaggactagtaatttctatattgtagggttattttaatcagaatgagctatgtgcatactcaaactacagttgtgggcaaactgtaactttaaaatgattcaggatcataacttcagttatttt

SEQ ID NO: 210086 - DNA, 357 bp, Homo sapiens
gatcaacacaaatttagtaatttggttatgacctcacaacgacaagtgttgggcattattgtaaacaactttttttaagaacagttaaagcagcaccacaagtgcccttgctatggggatcacaacccctgcaggatctatgacaaactgtcctgctatttagcaaattggtacttgtgataactgtgccatacatgaattttaaaaagtgctatacctcaaacaatctggaagggaagcaatatagggaagtaagatcaggagtttggttttagctgtagtttgagatgccttttaagacatcaagtgggaaagttaggtagctgttatataaaagttggctgttaaagggagaga

SEQ ID NO: 210087 - DNA, 433 bp, Homo sapiens
cagcctctgctcttgtatctgttaagagcagaacagccgtcccacaggaggctcagggcaccaaatatgctatgcagatgtatgctactattgattcactataattgcaaacacaaaaatacatttttcaagaatttactaaataattttgaaatgcactggagcaaatgaagcacaaactgcttttaggtaaagtccttcaggtgaaatagtacataatatgctacaataacttcagtatcgaatcactttaatgctgagctgtgctttctgagaactttttcttccttgaagtataacactgacagacttttagaaagcataaggcacagaaactgtcagagacatataagaagtaattctgagtttatgtctaaagccttagtttttgttactggaagttaggagttttctcaaagaatactttctggca

SEQ ID NO: 210088 - DNA, 193 bp, Homo sapiens
ccacagtccccagatatgtggtcaaacatgtcttgggtatcaatgggaaagtgtttttcagttgagattagcatttaaatctgtagactttaaaatcctacataatgtcagcggggctcatccaatcagttgaaggcatttaagagaaaaaagacctacaaagaaaagggaattctgcctcaagactgtcctc

SEQ ID NO: 210089 - DNA, 605 bp, Homo sapiens
atgactctagcacgatccccctttccggacagcgagcatcaattattcctgacaacagtccctctacaagactaactcattgcttcactgttcgtgcccataagcgtagatccgctttatgcgatttggggagaaagaccacaaagctgaagtgccaaatttatgatgtcctacgagaggtacccggtatcaacatcacatcactgaggatggtactttcatcacctgtggcatactgttcaccaggtttgtccactccaaactcccttttccaaccttttccatgctctcatctttagaagtaggtcattaagtgcagccattccaggagtggagagttccgtcccacctctttcagtggagaaagagctacatcaagcatttggaaccctctgaatgggaattgtgtctcttctctcatttatttgtttgtttatttattcaatcatttatttctatcagtctggactcataggtatttattttatatttccagttataatccaacactatgttatttattttgctgctcatcaccgtcccagctttggctactaggagcaacttcaggcgaatccctttgacacccctgccccccaccccac

SEQ ID NO: 210090 - DNA, 410 bp, Homo sapiens
acagggagtaaaaatcctttcaaatggcaactccatgcttgacgaatctatctcacaaaaatataagctcacatgcacagtattttttgtaatagctaaatattgaaataacttctaatcatctgtagtagaatagttaaataaatcgttacacctgtaccgtagaattctctgcagccataaaatgaatgtcatatattaattcatgtcttgatgtagaaagactcctagatgcaatgttaagaaaaagaaggcgaggggcggtggctcactcctctaatcccaacagtttggaaggccaaggaaggcggatcgcttgagctcaggaattcaagaccagcctgggcaacgtcatgggatagaacagaatagaatactaccaaactattaactatggtacctttggagaa

SEQ ID NO: 210091 - DNA, 134 bp, Homo sapiens
tacagtctaagccagaatctcagaacaggaaatccaaaacaaatttcataatgaaatatctgatataatgggatcagcatggaaataaggggctgtggtagttttatatggccacaaattccttggccaggtgt

SEQ ID NO: 210092 - DNA, 178 bp, Homo sapiens
aggtagtaggaagtgcggtttgttttttgctggtggggaaatggcagaatagaaaggtgcaatgacttgcctgaggttatacagagtttagtgacactcttgcatgcccatactagatgatttctcatttccaaggtcaagtcttttggttagggactgtcattcagttcgtgtaaag

SEQ ID NO: 210093 - DNA, 281 bp, Homo sapiens
gggaaatggaaagtaacttatgaatacataaaggtttggccctatatagatttctagaaataattaattccagcctaaggctcttgcattagtttcttaaatgaatcagatccttttcatccacagcaaacataggtagcatggaaatagaagggttgcagtgtatacacattgcacttccgtctaaatgtacacatcgacatagcctgccatatcccaccatcactcagaggactggagagaaggtaaaatccaaatagtctccaggattaagaagccac

SEQ ID NO: 210094 - DNA, 683 bp, Homo sapiens
  misc_feature (47)..(47): n is a, c, g, or t
  misc_feature (72)..(72): n is a, c, g, or t
  misc_feature (84)..(84): n is a, c, g, or t
  misc_feature (147)..(147): n is a, c, g, or t
  misc_feature (204)..(204): n is a, c, g, or t
gcttacgccatgtagagtgtgtttactgaaatgatcatgtgattttngtttttaattctgtttatgtggttnatcacatttgtngacttgcatatgttaaaccatccctggtatgtaacccacttgatcatggtggattatcttttngatacgttgctggattcagttagctagtattctgtgaaggattttggcatgtatgtncattaaggatactggtctgtagttttcttcttccctcttattacaattaaagaaggtttatggtgactgacttctatatccacctatgatccattcaacaccctggtctctcatttccttggcctttatatagttacctctttttctccccactacagccgcataatcacctggtcatacagttgatcttgctatcaccactaacagcacttatttaatcagaattttgacagtgacatccttccttctaactcacttaacttgggtacttctcattataattctccaatctcatcacgatgtccccacatcttaacacttactcactagccatcaccactttcatgccccctctttcctcattattcaacatagattctatagtctagcactctacttgctaactaaaatccttatctatctccttttgcctgtctttccttctgttctagatatctattacaacctcaactcaggtt

SEQ ID NO: 210095 - DNA, 461 bp, Homo sapiens
ggatgattacaggcgtgagccactgcacccggccatgaagaagtctttcttcacatgaatctgtcagaaacaattcccactgcggaggcctagagaaatcaaatattccctcttccaccctctggcagccaaggtgttagtgcatgactcagccttgaccagtcagatgctctagccagagactagactattgagtgacacaaagatgacacaatttataattcagccatgccagaggcagcagtatccaatgacagtagcagcagtgctcggcaacagcagtgtctggtggtggcaatgtctaatgccagcattgccctaaccagacttttcctgtgctctccctggctatggttcctgatggctggcttctcttgatttctgtctgtttataagactagttctctttctgagagctatctgacctctttacaataaatatattttctgtttaacggaga

SEQ ID NO: 210096 - DNA, 1463 bp, Homo sapiens
gactttagcctttcctgagtccaagaaaccatgaagctcacaattcagcatgtcaattctctacatcaactgaaataactggtgatgttggtactaatttaattggtgcctgcaccagcccagcgacccttgaacactcagaatttccaaacagagaattccaacattatcaggcatttcttcttgctgccaccacgttgcttccccttccaccatgattgtaagtttcctgaggcctccccagtcctgcagaactagacgggggtctcacgatgttgcccaggctgatctcgaactcctggcctcaagcaatcctcccacctcagacttccaaagcactgggattatagtcatgagccatcgcaggaggatcagggtgtaagtcagccagagagacaaggaaaattttggatctataggagaaagaactttcaaacagcaaaagtcacccaaaaatggaataccaacttctagatataaagggcaatgaacaaattgaaaaatattcttggagagaagcttgtgatactggcagctcaagaatggacagaaagcatggaaaatacatattgaacgttgagcactctgaaaaccagccggtaaaagaatattgccgcaatgactggtctatgtggaaagtcttcctggcttgtctcttagcctgtgtgataatgacagcaattggagtacttataatatgcttggtgaataacaaaggatcggccaattcctccattgttatccagctatccacaaatgatggagagtgtgtgactgtcaaacctggaacaccctctcctgcttgtccacctacaatgaccaccacttcaactgtacctgcaagtacagccactgaatctacaacttcaacagctacagctgccaccacttccacagaacctataactgttgcacctaccgatcatttataatttgaacagccatagccatcacttcaactgaaacttcaacctctaccacttcaactcagtttgcaactataatagctactcctatcacttcaagtggaatcatggctgcagtcactttaacagactctataaccgttacaacttcaacaaaatcaagtcctacttcaacttaaacttacttgacaactcaaataatcaccacttcgaccatctctttgactgaatcaacaactacattcccttcaactgaatctgcaaccacttccacttaacctataactactgtaacttctacttagcctacagtaacaatgctcatcactcttttccaacaatgtataatctccacctattcatctgaggactaagctctgatttttcatcttgcccaaattcctttctaaggggtatggggagtcatgccctacaaaccataaattctcatcagatgggttttatttaaccctgtatattgtgacttactttctaatctgactctggcataacaagggaaaaaaatcaaaatgtttt

SEQ ID NO: 210097 - DNA, 769 bp, Homo sapiens
aattaagtgaggacaggtatgtgaagaggctcaaaggatttctgaagtgtggcaggttccttggccttcacaagaagcgttggaggagctgcccctgcccaccagttcagcctcatctccgacctcatctctgagatgagaatcttcttctcagagctacaaccacacaaaactgcttgccaccctccagcacacaactccaggcgttcacacctgccatcccctcttccaccttggcctgaaaggtgccttttcattctcaatgccctgctctacatgctgctcctccatgaagtcttccttgcaccccctcttcccccagctcagtgcttccttaatgaaggccccacagacattagtgctgccttctgatatagtactgatcacaccccagggctcccctgcaccccgtgttcaccatcccagaacttgccttcagacaatagttttagtgtctgcctttccaaccagaacagtttcctgaagagcagtgattgtctgactcctttgagtaaccccaggctcagcacatagtaggtgtacctatgtgtttaatagaaactggtggaggtggagatggtggggcttgtagattagctgtagtagcaacggtgacgcttgcatactgacggaggtagtgatgatagcgcataaatactttcactgcaaaggcagtgcttgctccaggatcctgtgggaggagtactgcccactgccaagaacacaggacaggctaggctaggactggtgggaagaagtaggtggtatg

SEQ ID NO: 210098 - DNA, 496 bp, Homo sapiens
gtcctcgtcctcgtcctcctcctcctcctcttcgtcctcctcgtcgtcatcttcgtcctcttcctcttcccaagccaagaagcccgatccgcccctgccgcccgccttcggggcgccccctcctcccctctttgacgctgctttccccactccgcagtggggcatcgtggacctctcggggcaccagcacttgtttgggaacctgaagcgaggagggcccgcgtccgggccgggggtgacgcctgggctgggcgctcccgcgggggccccagggccgcttcctgccccctcgcagaccccgccaggaccccccgcggcggcggcctgcgaccccaccaaggacgacaagggctacttccggagactgaagtacctgatggagcggcgcttcccctgcggcgtgtgccagaagtccttcaagcagtcctcgcacctggtccagcacatgctggtgcactcgggggagaggccctacgaatgcggcgtctgcggccgc

SEQ ID NO: 210099 - DNA, 246 bp, Homo sapiens
gtctcccagtgttaaacaccatattctagaatacatgttacttatcactctagatgagctgtctaagtccaaaacagttacccaactattcttaatttttagtcctttcgtctctcatcccacctccttgcattgcatttttcaggcatcaagggtatatgacctttttattgattgattgattgattgattgagacggagtcttgctctgtcaccccggctagagtgcagtggcatgatcgtggc

SEQ ID NO: 210100 - DNA, 715 bp, Homo sapiens
gaccactggatcactaactcattctgcaggctcccttcagcagccaggccagagcctgacatgctccaccctgggtgaagttgtactgaatcacagaacagccttcctccatctcccacgacaaacagacaaaaaccaaagagtggggaaagcaccttattgtcctcattgtattgggaagggctctcaggacatatgaaacctgtatcaagaagatctggtaagaatcaacaatcttgtagctgctgtgaatgcaacagctgtcatgccccaaccagggcatgctttgatgctaagactggatgtttcacaggcaaaggatttggctacttgttagctattaacccagcttggagtgcaacagtctaataaccttcattccccaaatcagaacaagaaactgcatcctctagggcccaccatgaacggctgtggccacttcccactgcggccttgaatggatgggcccagggatgggcaggagacagagcatcgggtcttaatacatttttaaaacctacctagcaatggcaaggtaaataaattaagtggacagaaattgttttcgtgggggaaaaatactcttcaatttcccaaagtcttgagtccttccaagagttgagagtagggagttgacatgcaagcctctgagctggaggtgggcttgcagagtgagcttaaaggaaagagatccagttccccctctccagtgagg

SEQ ID NO: 210101 - DNA, 521 bp, Homo sapiens
agaacaagagagggtgggaaaataagaaaggaaaatagaacattttagggaaagggaatagtgtgtgcaaagatgaagaagtataaaagaaaatgtagcttattccagaaactgctaaaaggatcaatatgctgtcgtgtcatgagagagccacaattcttcaaacatatttaactgctggagagaatggctcagaatcccaggtatcagcttcagcacacagataaaatataagaaagaatttgaggttgatgtcagaagcatttccaacagggctaaggaagtatttttttggaagatctcttcttggcccttgacagaagaagcagagtaacttttcttaggtggcataattcttcaaaatgtgttcattttgaagaacaggggtgatggatggtaatacacaggcagggatcaacagtcccagaactgaaggaagagttgacaaatgtatcaaagatgcctaatcaaaatgtgtccacattctgctaaataaattctggttgagcagaactaacaaa

SEQ ID NO: 210102 - DNA, 428 bp, Homo sapiens
ggagctgtgatgacgctcactttacaggggagcaaataaagcagagaggttgagtgatttgcgccagtatacacagggctggaggcaaagccaggctgtctgaaccactgtgggttactgaacgatagtgatactgaagcactgttgattcctggccaggtgggggccagttccccgacagctcacagccctcccaacccagacaatgacagagagaaaggaaagaaccctcaggggaggcgttggtcctagcagcatgttctggagaaagaactggagaaggaattggtgatttactgtcctgccagtatctgagctgctgggagggcaccctgggatgctctgagaagattttgccaggagatcctgctctgtatcaaaaaatttgaaattggaaatggtggaccaaatgctgggctgggtaatgc

SEQ ID NO: 210103 - DNA, 585 bp, Homo sapiens
aacatcctattaaaataattacattaagcacaagataaatttgttacattttgtccttataaaagaattaggaatgcccctttagaagaaatagctcttcttttttacatcaccttgaaatagtttcctcttgagttaatcctttattagatttatgctgttcatgtcttcttttgattgcagtaccagtgtattttgtgagagttgcagaattaattgttgaaaaattcatgtaagtgcttttttattagtcacatgagactgactatagcacattgttaccctaagtttttttctgaactcttaaatgtaagtaaaatttttaatatttgaaagtatttttaaaacaagaactcaatatttgatatgcattaatgtaaggtctacataaaatgtagcactttaatttacaataaaaaggaaaaaatggctgagtacaaataatattagcagtgtccagacaggcgcggtagctcacgcctgtaatcccagcactttgggaagccgaggcgggtcgatcacgaggtcaggagattgagaccatcctggctaacacagtgaaaccccgtctctactaaaaataca

SEQ ID NO: 210104 - DNA, 251 bp, Homo sapiens
gtgatgtgctcggggggcccgatttcctcaggcttaagattccttcttgagtgaggcaagcggcttgcagggcgagcctgcaggtgagccgcatgtgtcggccgacgaatgaggtgatgacgctgtacattaggccaagcaataagcgacgggccggggcgaaaccccacatgcgccgcagactcctttttccctcctctgtcagcctctctgagcccgggcctgggaggctttagtagggttaattgggg

SEQ ID NO: 210105 - DNA, 584 bp, Homo sapiens
acgttcagctacccacctgcgtttcctctctcaggaaaagcctcaccatccacccaggtgccaagccaggacactgggagccacttttgcctccctgtccctctcccctcatccaataagtcaccaagtcctgtcaattctcccttcaacagacctttcctttccttcctgggcacacccttgagtggtgctcaccagggaacagatgtggcaaatgttccaggctggcctcacccgggtctctagacacttggctcagaggcagaacatggctaaccctagataagccttgtgtgaattcctggcaagaaagtcccctgctgtcttagtctgtgcattctctgactagcacagtatgtggcgagagcaggtgttgaggaaatgtttgtctaattctaaggggcctgccaggccttgatacaaatggcgtcacatttacatgaataacccagagtttctctaattatcctcacctgcctgcccaggaccttcaacctcatctgctaagtcggcctcaggcgtttctagacatcttaagggaccgcatggcatccaaggccactggcatctactgtactcccctc

SEQ ID NO: 210106 - DNA, 393 bp, Homo sapiens
tgtactgtttaagaactcataggagactaataattaatttactataattttaaaggcaaagagttttatattaattttactgttgcacaagcagttattggaagtgggggaaaaaaagaaaactggtgagagaaattacatggaaattataggaaaaaggaacttgaattggtaatttggcaaagatttgggaacaaatagtttgaacatagatttctttcaccttatatgatagaaacacaaggcacacgtgagctgtatagtgtgctgagcacacccccagaaaacaaaaaatatcacattgatgaagtccgagactgtatctagatcttagcataactagtgaattcagggagcacatcctgctgctgaaattgagaagtcagtaagaag

SEQ ID NO: 210107 - DNA, 415 bp, Homo sapiens
cttgatgatatttccactggaggcagcctcttcatggtaaagaaagctgccagaaggctctggcctgaactggtctttagaaacagacagagtaccctgaagacacagctggcattgccaggaaagtagtccactgatgggaaagcagcccaccaatgctgctctgagagcatgcctgagggtgtaggtggaactaccagtggaagtcatttcctggagttgcttggaagctgctaggtggagaatgtgagcagatagtgggtaggacactgtctgaggattactggaatcccatgacaaaaataaaaaataataaaaggaggattgaaacttggaagagaggcatacttctgagggttttgcttggtactgtaactccagaactctctattcacaaagcctagaactatatcac

SEQ ID NO: 210108 - DNA, 322 bp, Homo sapiens
agaacatggatgaagggtatctcccttcctctctttcttcctatcacaatttataatggttctttttcattttttttattattttaaaatgtattttaagtataaattaatagttacaaatcatagtactgaatttttctctcagtacattcttcaagaaaatcaattgttgggactgcttaggagggagagcctgtggtgagtttacattgcaagttccattggttgtcatgcagtgaggccatggagagcattcgttttgctgctcttaacttcatcagtgcttttatgctgacagtttttgctggtgcaacacattgaa

SEQ ID NO: 210109 - DNA, 321 bp, Homo sapiens
aatcttaggcaagtgacttacactctgagcttcaatgtccttgtctttgaaatggggtgatcatatgctagttgttatttatatgtaaagcattgctgtagcctgcacaaattaagcatcgtgacttgtcctgcctgctgtgccttagagagcctgggtcccgggaggtcttggggtctttgcagttgagagcattgaattgtgcagtgtctcagtgactgaaaccaccatagaaggtaagccagtgtgtgacacctggaggaacagctggttagtttatgaattatctggaggcattggctttgctttcattcagccaca

SEQ ID NO: 210110 - DNA, 566 bp, Homo sapiens
  misc_feature (538)..(538): n is a, c, g, or t
  misc_feature (542)..(542): n is a, c, g, or t
cccctttgttttggcctagttcttcctttgggaacagtagtacccaatgcctgtaacgtcattatatcttggaagtaactaacttgtatttgattttacagacccataggcagaagggacttgccttgtctcagaaaagattttggacttggacttttgagttaatgctgaaatgagttaagacttttgggggactgttgagaaggaatgattatattttacaatctgagaaggacatgagatttgggaggagccaggggtggacttataaagcttggatctgtattaccacccaaatctaatgtaagactgtcatcctcaatatcagaggagggcctggtgggaggtaatgagatcatgggggaggatttcccctttgctgttcttgtgatagtagtactcaataagatctgtttgttcaaaattgtgtgacacctcgcccctctttcttttcctccaatttcagccatataagatatgcctgcttcccttcttcatttcttctttagtagctattaccttcttaataatttgactnttgncctcctttttacccctacccatgg

SEQ ID NO: 210111 - DNA, 379 bp, Homo sapiens
agtggcacttgcaagagagcatcagctatgggagtatggggggggaacatttggtaggtggggccccataactcccaagagtatatgcccattgtcttcagttaccagggtggtaggaaaggaccattagatggtggcagggctaggcatgcctgggcttggactctacttgggcaggtcttgctgcaactgctgtgggagatgggggtgaggttcccacgtcagtggaattatgttcctaggaggattatggctgcctctgttgtgtcatgcaggttgccaggaaactgggggaaagacaggagtcacaggcctcactcagctcccgtctaacccaaatggctggtctcactcccactgtgcccccccgccaagagca

SEQ ID NO: 210112 - DNA, 449 bp, Homo sapiens
cctcaactagccttgtttccagccttatatctaggacttgactcagtttatgtacctccagtggctgaggagacccattattttctccttctctgccctgctaagccccttcccaggtgtcaggagatgaggctttgctctcccacagctctctccatggcagttaattccagctccctccttttgatgctcagaccaaaaaccttggtgctttcttgactgctattcttctctcacacttatatccaatctgatagcaaatcctgttgacttaaatatcaaaatattaatatatacagaactcaactacttcttatcctccctgtaattatctccgagtccaagccaccatcatctctcttgttataacagcctcttaatgggcctcctgcttctagccgcactccctacagcctattctcagtacttttaaaaacagaataaacctt

SEQ ID NO: 210113 - DNA, 122 bp, Homo sapiens
tgagcctgggaggtggaggttgcagtgagccaagattgcaccattgtgctctagcttggacaacaagagcgagactccatctcaaataaataaataagtaaatattgtctgtagatcttttt

SEQ ID NO: 210114 - DNA, 327 bp, Homo sapiens
aaggtgagagtctaaagttaattttctttgcgtgtgaatatctagttgttccatcagtatttgctaaaaaaaattattctttctttattgaattgcctttgctcctctgtcaaaaacgaatggctatttttggtggctattgttgtgtgggcttatttctgggctctaaattctgttccactgatctatttgtctgtacttttgccagtactacactgtcttgattactgtatgtttatattatagccttgaagtagtagtagtgtcagtcctgtaaatttgttcttcttcaataccatactggctatttggttttgcctttccatg

SEQ ID NO: 210115 - DNA, 758 bp, Homo sapiens
caggaggaatgttattgttgctagctttatcctttttctcccctgcattacttgaggtatttcccatcttgaaaagggattggggtgaggctcaatttcccctactagaaatttcttcccagttacgagaggtttgtataaggctcaacctctcctactggagatttctcacctttcctttcctttccctttccctttcctttccctttcctttccgaggctcaacccccctgctggaggtttcttgcacttttctcctttcgcttcatccttctctggctgcttccctcacgggaacgttggtttcctcttagcaatggctgtttcagtagaaacccctgacccagactcctttacagaagggctaccttaagctgtataaggtgaccacagaactgcagatctggactgaacacttgctttgcactcaattgtgagtctcaacacacactttcaatctccaagatatcccaaccaccaagaaaatactttgtcgctcttgtgatgtttcttacgttggtctgtgcacatagttacctggtcaccatggtatgtgaggatccttttctcttaagttgttggtctgttcctttccagactgctgagagtccgggtttattcatcacactgggtgggtcctgatccctcaccatgaggccacctcaatgaggcagtgggatgcttctcctcactattggtgactggagacccttttctcagaggagaatgggaattccggacgagcccccagattgtta

SEQ ID NO: 210116 - DNA, 615 bp, Homo sapiens
ccctttcctttcctttcctttccctttcctttcctttccctttccctttccctttcctttccctttcctttccgaggctcaacccccctgctggaggtttcttgcacttttctcctttcgcttcatccttctctggctgcttccctcacgggaacgttggtttcctcttagcaatggctgtttcagtagaaacccctgacccagactcctttacagaagggctaccttaagctgtataaggtgaccacagaactgcagatctggactgaacacttgctttgcactcaattgtgagtctcaacacacactttcaatctccaagatatcccaaccaccaagaaaatactttgtcgctcttgtgatgtttcttacgttggtctgtgcacatagttacctggtcaccatggtatgtgaggatccttttctcttaagttgttggtctgttcctttccagactgctgagagtccgggtttattcatcacactgggtgggtcctgatccctcaccatgaggccacctcaatgaggcagtgggatgcttctcctcactattggtgactggagacccttttctcagaggagaatgggaattccggacgagcccccagattgtta

SEQ ID NO: 210117 - DNA, 508 bp, Homo sapiens
attgatttattttcatctttgaatgctggctgatccataacgtcttcaatttgaagttcctctacgaaattcaataatagtcaatataaaaatagttcaaacattgccacattaaccaagtcagtgcttcaaaggtactgtcctatccatttcattagtaaacttgactgaacaagaataagactaacattgattaccaaaatgtgaccccaaagagaagccagtttccaggaaaatataatccaatagaacacaagaagtaaaatacactgagagcattaatagttttctgttctgaaaaataaatgctattgcttatacaagacttgctatagccatctgaaagctccaattctcttcttttaccttgggttttctttctcattattgtgtatgggagagtttactctcaaagtctttatccttgcaacggagatgatgatactaccttagagggctttgtaagaactagagatgatatacgtaggtgtcttgcaaatggtggtta

SEQ ID NO: 210118 - DNA, 653 bp, Homo sapiens
atgactgtacgaagaattacaaaactagtaattacacatagatgatcaactatatcttaggggagagctttcacatttatttttaagcgccaaaatggtatctagaacattttatagaatctagaataatatttgagggaattttgacactaaatcaacctgaagatgaatttaagattacaactgatactataacaatatgaatttgaactgtgcaggtcaacctatacatagattttcttctgcctctgccaacctctgagacatgaaggccaaccactcctcctcttcttcccctcctcagccctctcaatatgaagacctctcaatatgaaaaaggtatttgcctcatatatgtccaacgtatactgataatacagggatgggataagtgcttgggatattcccactcaaagagtggataaacagctatacgccaggcattaccatagcaagcctgaaatccacatgctgccagttccttggctggagggccgagtcctgctctctggaatgattctctgcggctcttggatccaccctccagactcttgttgcaccttctgagttgtcccctttccataagaaatagcactttcagctgaataatcttctcagcttatgtctcacccataaaagtctgggggctctaa

SEQ ID NO: 210119 - DNA, 569 bp, Homo sapiens
ctttaccattcttccatggaagaagacaaaattcatctgagtgtagaaactaactatgctatggctcaggccctctgggtatttctcctcaggaactgctcacctgtggggagagtgacttgtggtctgcttaccccaaaataattcaatactcaaggctgggtggactctacagggcaatggtgtgactgaccagctctttcattgaagacatagaaagtacaagcagacccttctggcaggagctctaacatcagcttccaatctagatttcatcagtaataaacattttggtttctatctcagactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggagttctggccgggcgcagtggctcatgcctataatcccagcactttgggaggccgaggtgggt

SEQ ID NO: 210120 - DNA, 241 bp, Homo sapiens
attgcttgaagccgggaggtggaggttgcagtgagccgacagcacacccctgcactccagcctggtgagagcgagactctgtctcaaaaaaaaaaaagaaggttgggaggacagatccagtttgtcagaggaattacttgaactagctgagtccttcactatataaaaatgttttacttaatataactatttcaaaattaacaggcaaaaccccaccagaatggtctttcaacaaactgaa

SEQ ID NO: 210121 - DNA, 392 bp, Homo sapiens
tgattctgatactatttcaagcaggagttatcgccacccctacttaaccgctagtaacacggtccctattggcatcaggctggagagaaacgcaactccaaaatcttatcctgaggcatctgctttcaaaggttttccctaattccagctgtcttggcctgagttctccagagtacagagcctaaggcaaacacatttatgtcttgctactttagctgagagttcaagcccaagaaagcaggagtgaaggaatgaggggaaagaggcgggaaaatagggggagccaacacaaggtatattactgagactgctacaacctgctaccaagcataattcatggcttgatctggcaggattctaagagcctatgaactattgcatttcaggatagt

SEQ ID NO: 210122 - DNA, 509 bp, Homo sapiens
ccttgactctagttcacatgagggtaatagagggaggtaaatgaaccagatcactgaagtctgaatttcaagctaaagagtgtggtttcattttcctcatctataaaatgaagataatatctctgtctcttgcaagaattaaagtgaggccaggcacagtgcatagccctcttcacccatctctccagctcttcgtgttgggctcagcccttcttctggtagtcttctggttccagataatggctatgattccggcactttgggatgctaaggtgggagaatcacctgagccaggagtttgagacgagtctgggcaacatggcaagaccccaatctctacaaaaattctaaaacttagctgggagtggtggcgtgcacctgtggccctagctgcttaggaggctgaggtgggaggatcgcttgagcccaggagaacaaggctgtggtgagctgtgattacaccactgtgctccagcctgggcaacagaaggagaccatctcaaaaaaaa

SEQ ID NO: 210123 - DNA, 375 bp, Homo sapiens
aggaagcggaacagaaaagacgatgtgttacatcttagtgcctaagctataagtttggagttttactataaaacattcaccatgtgatgttcaaaataaaatagaatatttaataattattgggttaaaaaaatggttcaattctctccaatggcaaagaagctgtgattcactgtatgagcacagtgataaccattctcacctaaaacacagttcacaggggttcctccaggaatacaacatctctgttctggtctgtctgaaaatagtttaatgtatctcctgctgtttgacatttatgttgacttcatatattaaaatgtgaggaatgaaaaaatcctatcactgatgtttccatctaaactttccattcca

SEQ ID NO: 210124 - DNA, 208 bp, Homo sapiens
gtggggggaaaatgagttaatttattgaatattttaactagttgtaataggttctaattttacctacagtggaaacaattgaaagtttttatgttaacattattctggcaagttaatatgaactaaagaacattaaacaaatatttcagtgcagagcatgaaacaaatacagcaaaagatattagcacttccagttctgaactgattt

SEQ ID NO: 210125 - DNA, 523 bp, Homo sapiens
tggaaacgactttatcatgatgcaagaacttgatacttgttttcaggcttttcttcctgtaatatagatatggatagtacgtaaagacatttttatgtagggctgcaaaaagatcttcctcctttttgttacattatacacacacacgcgtgcatgcgtgcgcgcacacactcgcatgttctggggaaaatgtatgggagaaatacaagcacggtagttaaaaaacaggtttgaaagtattctagacccaataggaaagagacacattttagcttgagagaagctttcaaagaagcattaattcctttactctgatagcttaggctgctcattgacatttaccttaggtttttttgttttgttttgtttttttctctatttaaccatcaacagtctactttttgccacttgaaaggcatagggattcaaacaggttttaggtagggaaaaagggaagccatatttctgattctgtgaaatttttcccagtggcattttccagtcatttatgtttggagtatgc

SEQ ID NO: 210126 - DNA, 155 bp, Homo sapiens
gaattagagtggaaggagggaagggaatgagaggaaaaaagtaaataagtgaaaaatgaaagcaagtgtccatgataagaaccgcatgggtgctcctatctcatttatgggaaatcatgtgtgtggaggtgacataaacacatggtggtgagatg

SEQ ID NO: 210127 - DNA, 297 bp, Homo sapiens
tgtgtagattttgaaaatatttgattagacttatacttaagtcatttttggagggtgctaatgaaaatggtattatgttttaatttcaaattcagattgtttattactggtatataggaaagtgattgacttttatatattaaccttgtgtcctgtaaccttgctataattgcttattaattctggaagttttttcattgattctttcaggttttctacatgggaagtcttgtcatttgtgaacaaaaacagttttctttctaactttccagtctaagttttatttcctttttttgt

SEQ ID NO: 210128 - DNA, 434 bp, Homo sapiens
caaaggacagtccacaaaggacagtgcagggggtcacctggatatgtttgggctacagtgccacagacacatcccatgatatgaatcattaagataataacaataagctacagtttaatgagtactcactctgtacctgccagagtgctaaattcattatatggactgagtcctcacaacaaccctaaggattaggaactgttttatattctctctatttaacagatgacaaaactatgtggctcagagacggtaagcaacttgcccaaaattgcatagccaggaagtgacagaaccaggtctaaaagccaggtctgtcctgtcaaacttcagagccttaactactatcctacacttatccatctgaaaggcacagtccctacctgcttcccttaaaccccatggcaccctcacacctcactccctcacccaaa

SEQ ID NO: 210129 - DNA, 524 bp, Homo sapiens
gtgatgttgcaaatttcttttaaatgtgagaatttcaagcagtaaaattactcaaaaggctactggatttaacttacaagttcttcagtggtaatctgttcaaaagaattattttagttgttaggtatactgttgatgtggttgataattctggtatccaagaagaaatctcccaagatcctacctaactttttgtaactaaagcggcatacatacacaggtagtgggaaaatgtctagactggtgagtacacataccaacatttttccagaattttctgcctccttattataccacttgagtaaggggtttagaaattttaggctctacttgggaatttgtctatttcttttgcagttctatcaatttttgtatcatgtattttgaagcatttatgttattatatacataaatatttaggactgttatgttttcttgattaattgaaccatttgtcactatgaaatgaccttgtttattgctggtaatatttttgctatgaaatgtactttggtattaataca

SEQ ID NO: 210130 - DNA, 347 bp, Homo sapiens
tgcataaaggggaggcaatgggggcaaggacacaggagtaaagggtcaaacagcccgggaggactgatcctacccagctgtccacattgcaggtacttcccactagtgagctcatttggaatatcacgttgtttgcttttactttcttgttcaaatgtctgttttatgtttttagagttggggtctcgctgtgttgtccaggctgatctagaactcctggcctgtgatggttaatactgagtgtcagcttgactggattgaagaatgcaaagtattgatcctgggtgtgtctgtgaaggtgctgccaaaggagattaacatttgagtcagtgggctgggtcttggtg

SEQ ID NO: 210131 - DNA, 606 bp, Homo sapiens
ggctgttataagcaattaaattacgtactagttagttgtctctccaaacaaggttatgattaataatatttagctttccatttttatataggatataaaaaagatgaattgttctaggccatgcagtatgtattttatagcatactcttgatcttagatctgtcactaaaaaaacaaatgaatatatgtataaattaatatgagtgttaggtccttgaataagaatgagatatatattttctccccttttggcaatctctatcacagaaatgggccaagttgtcaccacatttagttcatgggaaatttgttttcttttgaaagtgctactctagttttgtcgtatgaaataacaacaatttgtatttaattagtctagtacttcagaataggccttcaactgtttcaactatttggaaaagtcactctaatttttgttatcccagaaaatctttgtattctattaagaactaaaatataatttgccagtccttttattattactattgtttttttaaaactgcaagatatggtcatgagtatctggaaatggctcagaaaattaaaaattatagctaataatattgcattatttctcacatggtt

SEQ ID NO: 210132 - DNA, 118 bp, Homo sapiens
agtgctgggattacaggcatgagccaccacaccaggcctgctaaagattcttacaaacaaaaaatactgtatgtaagagctcagttactatgttactatgtcaaccagcccccagccc

SEQ ID NO: 210133 - DNA, 292 bp, Homo sapiens
  misc_feature (17)..(17): n is a, c, g, or t
cgaattcgagctcggtnccccattggataagcggatgagggggttggaagagggagaaatagttacacctgttgactttacaagtgcccatctatctgccttccctgcctttcccctttctttcccctgacctctctcccttctcccacaaacatttgtacctctgatgtttcaggtactgattcccattctgggagtgagatagttcctataacgcagagcttgcctttagtgagggaagacagaaaacaaatatatcaacaagaaaatatcacataatgctgggtgctgt

SEQ ID NO: 210134 - DNA, 397 bp, Homo sapiens
agaactgtgcttctctgctgcgtagcgccctctgtggctccccagggtggagttctcactgctgccttgcccacggacgccccttcatccttcaggaaccaggcaggccccaccaccataccccttagcaaccagcttcccactctgaccggtgtctgtctgtgtgctgccttccgtaggagactttctgagcttaggttccctcgacgctctatgggcactgggcttcctgtcccaacacactggtggtagtgatgggacgcagcctctgtgcgggccctgtgcctggtgtggacccagcagagttgggcagcggatgtagagttggggaggggagcagtgacaaccattcagagtggctctgcctcctgcacccctgggccgtgtgcctggggac

SEQ ID NO: 210135 - DNA, 974 bp, Homo sapiens
atggggatgatactccagaaagatttagtgcatattgtgatgaacattaattatgggctgaattctcctatatagaataactttaatgttagtgctttaaaactattaaatggactttcataattatactccaataagttttgtatgtcaggaagtttttagtaccattaccaacctgaaatataggccatagaggctgatattgagcacactgatgttactctattttatctcctttctagtagaggaaaagctgacatatccatcatgctatcaaccagagagatttgctaatttcatttttttgcattttcacttacccataataattaatatgcctaatgacaaaaggcattttaatcacttaaagtgccttatgattcatcaaaaatgtaatattctgtttgggataaatgttattgtatagtattataaaactttaactcatcagtaatttgagcacagtttaattttgttctcccccaagataaaacccctcccctcccaaagccttgatggccttgaggggtaatcagcctggctgggagaaagagaagtgggttaaatcaaatggcagcacaccctagtttcctctgcaatctcatataggaagatgagcttggggttgcggggcatgaaaaggtgggactcagactgggcatgagaaggtgggactcagacttggatcaaagagtggggacacagcagagaagagcagaaaccttttgcagagagaaaggagcttacctggatagagctgaagatgatggatgaggggaatgtcaaaggtccccggatgctgtgatccagcatggaggatctggatccctggactttctgctgagcagcaatggagacaggattgagaaaaccagtgagctagagaatccaggttgtatttatgcagatagaaggtcagttccaggaaactaaggggaagtatgggtgtttgagatcagggaaatcctgctgaa

SEQ ID NO: 210136 - DNA, 105 bp, Homo sapiens
cagctgccacaggctcctccctataaattaagttcctgcagccacagctgtgggagaagcatacttgtagaagcaaggccagtccagcatcagaaggcagaggca

SEQ ID NO: 210137 - DNA, 401 bp, Homo sapiens
tctcatgagctttagtaagttgtttattctccactggactgtaaaccctgggagggcagggactgtacctgctctgttttagctccaacacccaacacagtgggctagtacttagtaggcactcaaataccagctgaataaataaatgcttaaaaattattacatctggcctaggatctattatatctatctgggatctggtgctcatgatgcatgtcaatttagatgagtaatcactcttcaaaatactgtcagaatggtcttttcccgggaaaatgctgcatgattttgaaacatgtggtacacgatgaattgaatatggcaagttgctaaactgacacgcagaagcacacacctgaaatgatttaatggcactttcaaattaaatggtactcagactc

SEQ ID NO: 210138 - DNA, 315 bp, Homo sapiens
atgtgggtcactgtcagcgtctgaagccagccaggcatgagacacccacacagccaggctgcctgatggtcaagaagcttttgtattgtaataaaaaatgttttagcaatatggtccatgcactgaaaccttcctgaggcttggtttcaaacataacactgaattccacatgcatctcagttcaaacgtgggcaagaagggatattacaggagtcatctcatttaataatcctacagtcccccaacaaccactgagggacaaccccactaaggaagagggcgggccccactgaggctgcgcacaagctggcaggc

SEQ ID NO: 210139 - DNA, 490 bp, Homo sapiens
gcgccactgcttgacccaccctgatccacgttgtctgcttcccacttcttacttcttgttgtgtgggaatctctcttccttggcccctgctgccctcaagctgagaaaggctattgagaggagtggcacgtagcccatgggcatgttctgtttgaggattctgacctgactgaacccacgaagaggatagcctctcaccaaccatctttcaaccttccgcttcccttgctgtcttgctcttcccttcccttctctggtcttcttttcctccttgcttcttgcctcctttagaaggctaaaatttaatagactgacaataccaagtgtgaatcagctgaaacttttgtggagtgtaaaatgattgagcaactttggaaaacagtttggcaatttcttatgaagttaaacatgcacttatcaaatgatgcagcaattccactcctgggtatttgctcaaaagaaataaaagcagatctatacagagacttgt

SEQ ID NO: 210140 - DNA, 347 bp, Homo sapiens
aacagaatcctagtacattaattcagaaagtcctattaaatacaagtatttttaaaaataaaaaagtcaataataaactatgagccagcttagtttttatacttttcagtattttctcgtgacttttttgtgtatgccttacctattaaatatgaaatatataaattttcttatcagtgctattgatttgtaagtatttattttcaataaaaaccagcctattactgtttctcataggtaaagctaggaagaataactgaccctgtcatctccaaaatacaagaaaaacagacatctcaagtcctcaacaaggacgcatcctctcagcaggatgctagcacggttcc

SEQ ID NO: 210141 - DNA, 562 bp, Homo sapiens
gggctaaggttgcagtgagctgagattgcgccactgcactccagactgggtaacagtgagactctgtctcaaaaaaagaaaaggaagttaatagtaattatagttaccctttactgagctacctggcaggcctagaacagagacacgcaggtgctgaaggcacaggttctgtcctcaggcagacttgggcttgaacatcagcttcatcattaactaaagcgctaagtgaccttgggcaaatgccttaagcattctagtctcttctaggaggcagggagtgttcccagccacacatctaagggagattagggggattaaagatacacacaaatatagtcaagaagattatcctaataaatcacctaacacatacgtgttatatattattacacagaacaaatcacctaacagcccaggcgatgtcctagcaccaagccccacaaggctcttgcttaagacacacacacacacacacccacacacacacacccacacccacacacacacacacacacacacgagccccatacttaccagagaatagaaagtaggtctttttttt

SEQ ID NO: 210142 - DNA, 936 bp, Homo sapiens
gtagagggagtgggggaagtagaggaagtagaggaattagaggaagagacagcaaaggaagaacctgctgacttccctgttgagcaacctgaagaaaattaaatataaggtattagatttaaaaggagctttacatttcggttctaatgtaaaaaagggtaagaaatttaatagcttaaaatatgaattaacacccatgttgcatgcattccacatattaaaatttgttttatataatttctaaatgtttaacatttgtttaataaaatgaaggcaaaactattttagtttagtttttatagctaccagacttagatccgataaattgtttgtataatttttaagcttaatttttattactttattggtgttaaggataacaaatgtgtattgttagtatatctattctaatcattttatcttaaatgctgctcttgggagtgaatattcaagtgtgcatcaattttttgaatacttaccctggaagatataaactgggcaagtattttgtgctctgtgtatttttttactgcattagacattgaatagtaatttgcgttaagatacgcttaaaggctctttgtgaccatgtttccctttgtagcaataaaatgttttttacgaaaactttctccctggattagcagtttaaatgaaacagagttcatcaatgaaatgagtatttaaaataaaaatttgccttaatgtatcagttcagctcacaagtattttaagatgattgagaagacttgaattaaagaaaaaaaaattctcaatcatatttttaaaatataagactaaaattgtttttaaaacacatttcaaatagaagtgagtttgaactgaccttatttatactctttttaagtttgttccttttccctgtgcctgtgtcaaatcttcaagtcttgctgaaaatacatttgatacaaagtt

SEQ ID NO: 210143 - DNA, 961 bp, Homo sapiens
  misc_feature (219)..(219): n is a, c, g, or t
  misc_feature (221)..(221): n is a, c, g, or t
  misc_feature (225)..(228): n is a, c, g, or t
  misc_feature (230)..(230): n is a, c, g, or t
  misc_feature (236)..(237): n is a, c, g, or t
  misc_feature (240)..(241): n is a, c, g, or t
  misc_feature (244)..(246): n is a, c, g, or t
  misc_feature (544)..(544): n is a, c, g, or t
acctggagccgacagacgtctaggggcttcgctgcggctgagactcggtcgccgccacgccttagcgtgaaggattccgggaagcctgcgggactgcgagtggagaggttttgcccaacgggacggtctccttccttctgtccaaattctacctgtccttcgaggcgtggtgcgggccccactgcttaggggagacttccttttcgcctgaccgcggangngctnnnngncctggnnccnncannngggtctgggtctgccgcccaggatggagtacaatggtgtgatcttggctctttgcaacctctgcctcctgggctcaagccttcctcccacctgaacctcccaagtagcgggactgcagggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggntgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccagga

SEQ ID NO: 210144 - DNA, 1023 bp, Homo sapiens
aggttgcagtgagccaagatcacaccattgcattccagcccgggtgacagtgcgagactccgtctagaaaaaaaaaaaattgtggctccagccattatgaactgtgtggggacaaatcagcatcttaggagcttgatgacttgaaacgtgacatgcagtgaaggcaaacttcttcctcctcctgagagatgtcagggctagggagctgtgaaacgaatggaacagagccagtgcccagccagccccagttccctctctccttctggggacttgttgacagtatctcgttactattgcaggcaatgtccccttctgctgaatgatccaaggacaccaaactttgcctgatcgacaggggaggctgctaagctgcacctgctccctgtaagagtggagtcaggccaaggcatagaggcacacaaatactagctttcagacttgctaggactacgtccagtctcatcacagctgtccacgtggaagtctctttgaggtcaagcaaacaaattcaacacagtcaaactttaaaccattctgtgggtgaaaggtttctgaagaatagacagatcttattctgcagtttaatgtttctggctaatctatgtaattgtgttatatagcgcattcacctcaactatgccacacttcagcaggctactcactccctctctcatatcacatttagaaatgggtccagagaggcctggacaacaccctgagaatgcaaagttttccactcaagttccaaccactgggatgggcgatagccctctgctagggctggtctaggtgctccctccctgggtatcagctgaattctacctggtgttggcagtgcggtgttccaaagcaaagtcccacagatactgtactttcccaagcacacagattctctctgaaccacagggcagctgccaggggataggggaagagcggtgtagacaattcaaagctgtctttcctacttttttaccaatataaacttaaaaccaggtattgtgaatactcacctgattttcggtt

SEQ ID NO: 210145 - DNA, 963 bp, Homo sapiens
  misc_feature (919)..(919): n is a, c, g, or t
gagtccactgcaggcttggagagggtggggtggagagccatgacatgcacagttactgaaggtcctcagtggccagagttgagggagtgccgcggcgtagggtgcgggctgcaggagggagtctggggcccattctgacttggttgacttaggccaggctccgagcctttctgggcttcaaatacccctctttggggtaagggggaagagactctgagctcttagaggtcctgtttctcgtttgctcgtggggatccagggaaagggagcgactctctccaggccccccggtctctgcctttccgtactggcctcatcccttccctgaggctcctgctccgtgtttctggtgggtccggattgggaccacacagttctgggaaaggcacctgtccccgctcctgagagccgggtggggaaggggaggtggggtctagatgggatgggcagagctgggcgagctcttctttctggaagggaacccaggcactcctcagagttgggaccgttgaacttcaagccaagccaggcaggtgagcctggcccatggacagatcctgggggccaaggtcctcatctcctagatgggtgcccaggcaggcccgtgtctgctggagggttactgagaggcgatccttggctcctcagcggaacagggggttctcctttgttccactggtgcctgggtaggaatgcaaggttttgtcacctgctccccaccctggagcatgtggattgggtgctgtcttcacaatattggatgtagctagaggtttgcagtaagtactttatttgttgccttttttgttgagcctgggcaagatagaaggtggtgggtagagctgctggtgaggacgccaccctgggtgcagccgaatgtctctgggaatgaacgggggagggagtgtgattctgctgntcctccaatcccacggaattttctaacatgcttattcaccgagc

SEQ ID NO: 210146 - DNA, 394 bp, Homo sapiens
tatagggtgttatgctctgaatgtgtccccctaaaattaatcaccaatgtcataagattaggaagtagggctttaaggtagtgattcagtcatgaagggagagtgttcacgaatgagtttaggatccttacacaaggactggatggagtgggcttcccctgttttgcccttccaccttctgccatgtgaggacacagtgcatctcctcctgaagacacagtgcacaagataccatcttggatgcagagaccagaccctcaccagacaccaatcctgctggcaccttgatcttggacttctagcctatggaactgtgagaaatacatttctgttcttcagaaattacccagcctagtgtattttctatatagtagtacaaactcattaaggcaca

SEQ ID NO: 210147 - DNA, 559 bp, Homo sapiens
aacaggtctccatttggagcctgtcagtggggtcagagactaagattcaggctcagggtctaaattccatatcctttcttccataccctggtgtttcctatgaacagatagatactttagggctgcaaggtttggattgcatggcactgctcagaagataagttacaggtctgggctaggctgtagctgcccctccaggtggctagacctttcctttctgtgtcaccagttaacactggccaacagttccttccattaactgttcactgctttctcctgtgtctaactgatgcagtttatgacccataactaagagcagtaccaggtatggctctgtttcctgttcatgtcccctgtcctctgggctgcatgcattccgttcttacagaaagaatacctttaacctagtacatcctgccacacatctgcttctactgtgaaattgatgagggggtattaccgattcttccctcacccatcatttactgagatgctggtgattgcattataatcctctaaagcttacattgtctttctgattcttggtcttatctgagca

SEQ ID NO: 210148 - DNA, 569 bp, Homo sapiens
gaaaaagctgtaatgatcagacagccttgagggggtcttcagagaaacagaagctgcagcttgtcaatcaggcatcaggcatgcgtttatgtgaaaacgacccagaggccgtctgcaaagggaaagcctcatctctactacaaaagatggagaacatatacacctttacatacttttagcaaaaacgaaatgtctattccatgttttaattttctcctttaatggactcctttgggttcaccactcagtcactggttctaataaccaaagactgaccttattctgttcagctgccacatcacattccataaaatggtcgtgccccaccctgggtcgatggatgtgaaggccctttctcgcttttcactcttaaacacagcccaggaacaagctgtcttacctgggactctcagtagatgctgagaggcagacttgctgggtgtggcattccaaattttaaaagcagcaggagttggttgattttgaagttgaagactcctaggcggggagctctgtgaaaatgggagccaagtcttttaccagtgtgagagagaattaaaatgggggcc

SEQ ID NO: 210149 - DNA, 649 bp, Homo sapiens
atcacaggtttaggcaatagataagtcagaaactacagttaacttgtctaggacccaagacaattaataaaacttacttggagaagcagcatagcctctagtcacctgaagacaagttttaaagatctctaacacactggtaacacttgggcacaccaaaatggctgtaatctgaaaaacagccacatgccacttctaatggtgtcattatactaaaagtgaccttcccccctgaaagtttttaaagtaagctaaatcttgaacaatgactcctactcttctctaaaataggagctatgacagctaccttaatgggatgcccgataaactcagggcaaggggctcactgtgctgacattctcacctcacctaggacttccgctgattcatcctgatggactgacaagtcactgacttgccaaagaatcttgtttatttcacatataaaaacactgtctactccagtgtggcgattcctcagggatctagaactagaaataccatttgacccagccatcccattactgggtatatacccaaaggattataaatcatgctgctataaagacacatggacatgtatgtttattgtggcaccattcacaatagcaaagacttggaaccaacccaaatgtccaacaatcataga

SEQ ID NO: 210150 - DNA, 346 bp, Homo sapiens
gcaattaaagaggaaaaaaagctatctaacttggagggcatgtgttcctggtttgtgaccccacctaccctactcctgctcattaaccctgttgtagccaggtgccaatgctctgcctgaggaatttatcactgaagttaacatttcagctttaagacataacagcttaaagaaggggcctggtatatcctcacttccagagatgtatatgtttaattatttagatcattcattcaaggggtttcaatgtatttctttgtaagccaactatttttttttcactaatccatctgtttttattattacatttgattacaaataaacttaatttgtcatactgctataa

SEQ ID NO: 210151 - DNA, 221 bp, Homo sapiens
ccggagtatacctgcagctgtcctgatgttcctcatcttcactaatagaatccatctcaagaaaccactttcttcacctgcattcatggatttaaaaaaattaagataaaacaacaacaactaaaaaaaaacactttctttgctcatccacaagaagccactcctcatccattcaagttttatcaagagactgcagcaattcaatcatatcttcaggctcc

SEQ ID NO: 210152 - DNA, 300 bp, Homo sapiens
gtttaatttatttttaagacatcatgttcacacatataagtgggagccaaacattgagtacacatggacacaaaggaacagcagacactggggcgtgcttgaggatagagggagggaagaggatgaggatccaaaaattacctatcagtttctatgcttattatgtgggtggcaaaataatctgtacaccaaacttctgtgacatgcaatttatttatataacaaacctacatatgttcaccgaacctaaaagttaaaaaaataaaaatttctaccaacatctaatgtgaaaaacaaaac

SEQ ID NO: 210153 - DNA, 227 bp, Homo sapiens
ctgctacctgtgagcttcctctcaattgttttattataatttttgttattacaggattaatttgttttaatggggacgtttgtcttctcgctgtttgtgtacgtcataaatctgaaggggaaaatacagaaacagaagggcgtgtgtctttacaagtgtgtttggaggcaaaccaaatggtacatttcttttcagatgctttctgctttgctttctgatttttggtc

SEQ ID NO: 210154 - DNA, 409 bp, Homo sapiens
ctttcccattatttttcccttctgctcttggaaaactaatgaaagacatgtcactttctcattttatgtaatatgtgtatgtgtgtgtttataaatatatatcttaccctctttctttttgcccatttccttctctgtgatacattctggataatttcttcactcatatatctaggtcattgtgtatctctttctttagttgtatccaatctgctgttaactacacccaactttttcattataattattactgcatttttcacttgtagaggcttcattgcttaggtctttttcaaatgtgttaagtttcttgttcccagcagatatttttccatcaataaatacagttgttttataatctctgtctgatatttccaatatccaaagtttttaagggtctatttctgtc

SEQ ID NO: 210155 - DNA, 611 bp, Homo sapiens
tgcacgaaaggaagaatattcatacttgatcagctcttagcttttgttaactattttattaaagaaaaaactctcttttggctgggcatggtggttcatgcctataatcccaacattctgtaaggctgaggcaggaaaactgcttgagcccaagagtacaagaccagcctgggcaacacagttgagactgtcgtcttacagaaaacattttataactagcctgcacacctgtgctcccagctacttgggaggctgaggcgggagaatcacttgaacccagaaggcagaggtttcagtgagacaagatcgtgccactgcactccagactgggcgacagagggagacctcatctcataaaaagaagcagccgcaacactgtgtggaatgtcatggtggtagattgggcacttatatataagttcatgggtggtggaactgccaaaaacattataggcagagaaggcaaaatctgtatccagaatacatgtctattctagtgaggacaaatctcttccctcacccctgcccttattcccataatagaagtccagcgtaatcaacttgccaccaggtggtagctagtttttgggaaatggtgcatattcagggct

SEQ ID NO: 210156 - DNA, 237 bp, Homo sapiens
ttctgagacatgcacctaggcggactcaacaaatattaaacatctgctcggtcagaccctctgctcaactctgcacacacaaaagacaatgagatgcagaatggtgggtgccaggggctggaaggtggagggttcagagagtcagtgtttaatgggtacagagcttcatttggggaggatgaagaagttctggagatggatagtggttacagttgcacaacaatgtgaatgcactta

SEQ ID NO: 210157 - DNA, 399 bp, Homo sapiens
ggttaatcccaaccacgcttagaggccccacctctcagtactgccacattggagattaagtttgaacatgagtttcattgaggataaacatccaaaacagctcatcccaaatctaaatgtttcttaaatcaactaatcaattaaaaaaagaaaacctctctgggctgaacaaggcgtatcagtgagctaaagccagcctacatgcctggcagtgccaatctacctcaaggtcctcagaactctccagtcccctcacctttccctaagaccaggtgacttgtggctccctgaacacagcaagcaggtcctcacatctgagcatttgggcctgagcgccctttctgcctaagtcacaggcccaacacatcctgctcggcagcctcagcaacaacttcctcc

SEQ ID NO: 210158 - DNA, 500 bp, Homo sapiens
ttctaattaccacaggcagattggctaaagaagaacaactttggaggtgccatggtctgggccattgacctggatgatttcacaggcactttctgcaaccaaggaaaattccctctgatcaccaccctgaaggatgctctgggcctgcagagtacaagttgcaaagctccagcccaacccattgctcccattgccgaggcaaacatcacatgcggtgtcagccacagtcgtagctctgggggccgctctggcaggagctctgggggcagccccagaggtagtggattctgtgctgacagggccagtggcctgtaccctgaccccactgacaagaatgcctcctacagttgtgtgaatggaaagactttcactcagcactgccagcctggtggtgtctttgataccttctgctcctgctgcagctggtgataacatttttcagatatcacctcacccagcctcagaagttgttgtgcaataaaaggttgagcattactgta

SEQ ID NO: 210159 - DNA, 454 bp, Homo sapiens
tctttttatatttttaaagaatattatatattgtcattatctatagtcaccttgctgtacagagatctgaaatgtattacttctgtctaactgtacctatgtattccatgaccaatatctccctatctcatttcctctaaaaaccccagcctctgggaaccatcattttcctctctacttcaatgaaatgaactttttttcaatttcatgtatcagtgaaagatcatgtggtatttgtatttctttgcttgtcttattttccgtaacataatgtcttccaggttcatctatgtgtttacaaatggtagaattgcattttctttcaggctgaataatatgccattgtgtatatattatatattttctttatccgtcacccactgatggacctttaggttaattccatatctcagctactgtgaatagtattacaataaacatgagaaagcagtta

SEQ ID NO: 210160 - DNA, 168 bp, Homo sapiens
tcaaaagccaaagggctttttttttttaagttactagggctcaaaattagattataaaaaatcgactagacatttcattcattttctatacaatacatatgtataagttaggacttttctctccttaataataggtgtgaatgaaacattgattgtgggcaatgttgc

SEQ ID NO: 210161 - DNA, 288 bp, Homo sapiens
ggtccactgcaaactgtaagctcatgctattccacttcaattaattcgttatcaaacattatgcacagagtatgcatcatccttttaaacaagtggatgacttccaataaggctgcagccttaccacagtcacaggggcaaacactggagatacacggattgaatcctgattccacctatctggttacacatatccttcagcaagttatttaacatcagtgatgatcagctcctcctatatgaaaggaggataatggctcctatatcgtggtagaattgttttttaag

SEQ ID NO: 210162 - DNA, 541 bp, Homo sapiens
gcacacgctaccacacctggctaatttttgtattttttgtaggggggttttgctatgttagccaggctggtcttgatctcctaggctccaagcgatccttctgccttggcctcccaaagtgaaccactgcacctggccaaacttttctattttgatgtaaaatttaaacagcctttttctttatacattatttattttttttctttttgttatggccaagagtttaaggtgcagttatactttatttttgattttgtctgaagaagctgtcctatcctggttgtaaaggtagtctctagtttagtcttctttttcacgtctaggtctctgcgtggtctggaagtgtgattttctgctgtgtggtagccagccaaggcttccttaccccgcctttgtacccccacctctctagggagcccaggcactacgtgtttccgggctctgctgtgtctctccttgtttcagcactatggttttacctctgggaaagcctttctaaatgttcctccactcctccccgactctccaggttgtcttgatt

SEQ ID NO: 210163 - DNA, 899 bp, Homo sapiens
aggggcagacacttaacctgtgtctaaagcactgctggccgccgattctacgccgcccggtcgccagggagagtgaatacagctagggacgtgaaaggcaggtctgggctgggcattgaggagggtattaagctaggaagtatgccttacctttatctaaatcgggcgggtcgtcctcccctcattggccttgtgcagctcggattcctctctcacccgcacccaggggtcttcccagagcattgcgtcgtctccagcccagggagccgccttctttcctaaactgctatagacactgtcctgatgtctaagacaatgtactttgtgccgcaggcctctgccttccctagccagagcgcgagctcagccgcttttgagagaaatctgccacctggcctacctgtgcacaacttcagagctttgcagggggtgacaagggctgtggcttcagggaaatgtcacgcgcactggcacctttttcgcgaatgtgaaaattgagaaatcaagaaggttaattatagggttgcccaggatctgccaagagcaaagaagaaaaccccatttcccaggcatgtgtcttgtgagccattttttatcaacccacttaagtggacaagctccaaaacacaacatgaagctgatgataatttaggcaatttacgtttgaaatcatcggcctcatctcaaggcagtgtcttagagacacaggtgggacctgatccctcaggaacagatagcgtccagctttgtggggattgacttttgagatattggagcacttcggggtcaattgaaacccgtcaggtttcacatctctgctttggatagaaagcccatcacccacagctgtcagagatgttccttgactcactggggctcatctgttgaatttttctatc

SEQ ID NO: 210164 - DNA, 395 bp, Homo sapiens
tggataataattacaattacttggggtcttttataaaatacagatgcttgggatttaccataaaccatttagataaggatcactgtgctgggacccaggcaccagtatattttttaaaagctcccagtgcttctaaagtttagtgaattttgagatccactgacctctcacagccagcagtgagaggacgaatgctttagtttgtaagcatgcatttctgttggatgttttaaatgaaagtcattaaccaaaaagcattgccagagttcagggtcatttagtttaaaatgaaacaaaatgcatttctgggacagaacagtaaggacatgaagagaaccagggtggtgtacacaggtgtaggtactatctctgatacagcacagatactgacccaa

SEQ ID NO: 210165 - DNA, 781 bp, Homo sapiens
ttgatagctttgatatcagattctgaaatgaaataaattttgtctcaatttgagagaaaatagtgataatacaggtcctttctgccaaccaactcaggcatatgggccttttatttttttgatcttttttcattcactacaattctaaattgaaaaatctcacattttcttctaaagttgatttaacaatatagttaacacttaaaaatatctaaaataaagaatataacacattctactgaaataggcagccagcagtttatacatatttggtctaatacattcctcaccttacataaatctccagaaaagctataggaaggaaacacattcccctgacacgacaggatgtaaaatggatataaaccaattactttttgcagttcccagagtctcaggaatactgacccttctgacttcattttcaagcaagaactctccacccccatcttgtaaggaaaaataattgagctgaatttctagcaagaagcgaatcaagattttcaaagaataatttcgctaggacctatggagcaaatcacctttcaaacatgccaaaggtagttatttgaatacatttaagcccctaatcacagaagtcttttgatgaacttttcccactttaaatacatcaaacgaagcaaagagagtagagaaagccattagaaaatcattataataaataccaacattgatctacttcttccctctcctttggaacctcccctttccttgtttttaaaccttttagttgggctttatatagcaaagacctcaaact

SEQ ID NO: 210166 - DNA, 620 bp, Homo sapiens
tccctaatcggaatcacataaagttacaaactaatctcccctcgagttctttgaaccttccttctctaccatagcaccttgcactttctaataaactatgaaacttctttcttttatagtaggtccacctctgcaataggaaaacagatttttgatacttggtctattatggaattatcagtgcagggaacagtgtcagggcacatggtaatcattcactgagtatttattgtatgaatgcatttccttacaatatgcactattgtgcactcatctatttattaggattgaatccctagattcaaaagatatgcacaaattgcccagaaaggtgtttttttttttttttttgggttcctttttatcccccctttctctgagtctacttgctagggaaccagaaaggttttaacaatttgttcttccaccaagggtctacgagaatgtcattttcctgccaccctcactaacacgatgccctagtcacattggtctttccattccttgatcttaccatgtttgtcctctcttgatgcatatcattgactatttcctcttcctgaatactctcctgccacacctttatctggtttaattcttcttatttaggattcacttga

SEQ ID NO: 210167 - DNA, 287 bp, Homo sapiens
tcctgagattgttgtgaagttaattgagactatacatgaagtctctgggccataactgatctcattacaccttaattcttgtttctattacttattttacttctgtctctgggaagttcagagtttaaaaattcaacttgaccacagcatctttacttggtcatttctgcaaccaccatgttccatttcttttgtgtttctatttagatcttttgttttaagctacccaatcctttttggaataatatggggtattattaaagtaagactaaccagcaaaattctgt

SEQ ID NO: 210168 - DNA, 456 bp, Homo sapiens
aggtccggagtttgagaccagcctgtcccacacggagaaaccccatctctactaaaaatacaaaattagccaggcttggtggcacatgcctattatcccagctacttgggaaggctgaggcaggagaatcgcttgaacctgggaggtggaggttgcggtgagccgagatcatgccattgcactccagcctgggcaacaagagcaaaactccgtctcaaaaaaacaaaacaaacaaaaaaaagaacacgactaattctaagaaatcaggcctttcaaactcacttgttctttccgtgattcaagattagtaataaccaatgataaagaccccttcctaaattcatctccagtttaaactgttacttttacatggcctaaaagtttactttagacaaagctatgcctagagaggctgtgaaccaaaaataaaattttaagcctcccaactaactgaat

SEQ ID NO: 210169 - DNA, 522 bp, Homo sapiens
gacttcggaatgatgtatttatttaatgtatttatttaaattatcgacatgaggtacatagattatatgatacatttattcttggaagtattattttataacattgaaactgattaatttacaacatgtatgttgttaccataaacacattctttggttcaaataaagtcttaaaataacagctctttaaaaaaaatttattgcttatttttggaagttggagaataacaagttctatagaattttccctggaaaacctgtcagtacagcttaaatattaattatggttctgattgcctttcctttttgtaaagcattaaaaaactcaggttatactttagcttggaaaccaaggtaaaattttgccattgccctccctcctttcatttgctcattcattcacatccttatgctggcgttatgctgggtgtttttatagtatcattaatgataagctagaagaaagttgatagcaattgctataataaggtaggtacagggttatccataactatgctaagt

SEQ ID NO: 210170 - DNA, 313 bp, Homo sapiens
tctcagacttggggcagccacggaagtcacccctgacaggcactgataagaagtacccgctgatgaagcagcgtgggttctactccgacatcctcagccctggaaccttagatcaacttggggaggtatgtcgtggcccccgaatgagccagaacctcctgcggcaggctgaccttgacaagttcaccccaagagtcggaagctttgaggttcctgaagacttccaggagcgcatggagcagcagtgcatcgggtccaccacccggctgctcgcccagactgacttcccactgcaggcctacgagcccaagat

SEQ ID NO: 210171 - DNA, 471 bp, Homo sapiens
  misc_feature (327)..(327): n is a, c, g, or t
agcacctgtcctcacattacgtattctcaatttcagcagcagtgtctcagattacactgagaaaacaacaggcatcactcttccatttcattttacatttaggtcctgcatggccttcccaccagaggaacatgccctaactttatagcgtttcagctgtttccagcattttcctattataaactctagcttaaagatccctacagataaatctgtacgttgctgtggtttcatttttttttttttaagacaaagttttactcttgttgcccaggctggagtgcaatggtgtgatcttgactaccacaacctttgcctcctgggttnaagcgattctcctgcctcagcctcccaagtagctgggattacaggcagccgccaccacgcctggctcttagttttgcatttttagtagagaggggttttaccatgttggccagggtgatctcgaactcctgacctcagatgatg

SEQ ID NO: 210172 - DNA, 358 bp, Homo sapiens
atgactgggtctcttgcatggtcacctagatagaagtgggaaccatcactaagacagataaagaagagtagtaaccatgggtgtgtgggggtaggatgaaacgggtgtccagctgttggcacagtctttaaatggggaatgttaagagattcattcagaggcaaagcagtaatggaggtcaaataacaccaaggtcagggctggtgcttttcctcccttttgctggctcagacttttgttggtaactcttggtagggcctaagtagtttcagacggtgtgacagattaggttaaaagcaaatgagattgactgggagagtcattcagcctgtggtgggagcagctgggggccaagctt

SEQ ID NO: 210173 - DNA, 469 bp, Homo sapiens
agaaaccaccacagacagcaaggagaatggatgatccacagctcctcacaacaacatgaatgaatcgcacaagatgagaaaaccaaggctctggacggagacttgcccaaggttaccaacaggaagttgcagagcagaaacctgaccacagggctcctgattccagaattagcaatcaggttaccatcagtcaccccctccagagggagggatttctgttgcccccaagtgtaaaatgagtgttctgacgtttgacacatggatagatttatgtaaccaccaccgccaccgtcaggacccagaacagctctgccaccccaaaaatctctcttgcgttctttatagttacacaatccccccatccctaaacctggcgatccctgatctgtcctccaccactgtgtttttgataggtatggtattaaatccacagatcaatgtgggagggtttacgtctataccacatgga

SEQ ID NO: 210174 - DNA, 193 bp, Homo sapiens
cctccgggtgtggtggggaaatgagggccagagacaagatcatggaggttaagagcacgaactttggagttaggcagagcctgggtttaactcacagcaccaccactcattcactgccacagaacttctctgagcttgtttcctcatctgtaaagtggggaaaatgtgaaaagttacatatggtgtttggcac

SEQ ID NO: 210175 - DNA, 628 bp, Homo sapiens
tggatacttgcctcccagatttaatattttgccatacttgcttcagaccttttcctccagagatgaccagtatcctaagttgatgtgcatcattccaaccatttctgtttttggatacttaaacctgtattcctaagaaatacagaatattgttttatgtgtttaaaaatgtgcagtgcatttggtgttcctgcttcaacagtgtttggatggaacagatccagggactctcttgggaaaatttggctatgttagtacatttcttttacctgcagtatagcattccattgtgttaatataagtgtatattacatattgtaacataatttataattatatataattatataaatatatatttataattattgattacaaactatagttgtaaattatatgttgcaattatttgcagtgatgatatgtaacagtataattgtattaataacaaaatatttataaccattctctcactgatggatctatgggcgactccagttgttcactgttaaaaacaatgctgcggctgggcatgatggctcacacctgtaatcccagcactttgagaggccgaggtgggcagatcgcttgagcccaggagtttgagaccagcctggccaacatgatg

SEQ ID NO: 210176 - DNA, 844 bp, Homo sapiens
gtggtctttccttcattgtccagtcccacgatgatgaccgtgtgctctggaagcgtcggaggaagggcagcgtcagggccaaacccgaagaccaagggactgtgtgcccccaccagacctcccaggaaggagatagcgctccccgcaggctggggacctctgcccaccgtaccgcgtctgcttcccacccagctccgacacctgccccactccgggacggtggaaaagacagctgagcccccacctcccttcacattccagaaaagtgtctgaaaggcccggggcgcttcggggcttgccaagagacggtgtttagagaaagagcataacgcgaagtcacaatcgcaggaaactcgcagcagccccccatccccgccgctggctccgtttagcggggagaaaggagggtcgcccagctttgcgtcctggggcgcaccgaagcgccgggacccaagaggagcaggcagggacgggggcaggggaggccgcggggcagtcgaggagcgcccatatacgaccctcggagcccgaggtccccccgtgcgtccgaccacagatcagaggagtcccagaagagggcgagatcaaagcgctcgcttggatgccctgtgcgccccttaccctggttcccgaagatgctcattaacttggcgatcagctgtcccatggcacttcccgggccggacaggtgcaggagggctcagcggcctcaggagcggagtcggccctggtattcggagctccgctcccccgggagggtctggcagattttgcctacgaagttagggaagccccacacgtcaccaacctgacctgggaaccctctgggacgctggcccttcgt

SEQ ID NO: 210177 - DNA, 651 bp, Homo sapiens
caaggaaatgtttgctattctcaccaacctagaaagctaacaccccagctatgaatgtcacccagcccagctggagttagtccttacagcttcctactgtcacctgagcatgcggctttggtcctcagattggtaggatagccaccgaacccccaagcatctcatccatgttccaagtaggatgcaggcaggagggtgaaaggacaagaatcaaaaggtcaagtttgaccctttttaaaaaactctccttaagctacaggaattttctgctggcatttcattggccagaactgaacctcctgaccatctttggttacaagggaggtgagtaaggaaggggaccactttatcaggcactttgctgcttagtacatcagttggaattctatcctcaaaaagaagggaacaacagatgtttgggatgccaaccaacagagtctgccatagttttaaagctcccaagccagggttgacagccaaagagatgaaatctttaaggcatgcttggtgttaggtcctgtttccccacttgacagcttccaggcggtgtagaccatagtggtacgtgccatggttgctacttgccagcatataggcagtgtagactgtaaatctctaagtgtaccctccgggccagactctgtcaattgg

SEQ ID NO: 210178 - DNA, 648 bp, Homo sapiens
caacaagtgaaggaggaagttttatttttcccattttgtagatgagaaaactgagcctcagagagattaagtagtttacccaaggtaatgtgatttgtgagtgggttagctgggaaatgaacacagatttgattgattccgaagctgacatgcactcctaccctctcaacctttaatgaatttttttcaagccacatagatggaaacataaaatcagttcaggacatatcgagtcatcaacatagaagttttgatctaatgtgataagctctgaataaataaaacgaaaagagaaggcctcagattgaattctggagaatgtttgtagttaatagatcttaatcacgaaagttttaagaataatggcatggaatatataaaagattttccccttttgttgtgtttggatacttgacatgcttattgatgcagttaataatgcacattaaaaaagaattagaataaaacaaatttgatgcatttttctttacatcaaaaatcataggtctgattttgtcattttaacttagagaacatctgttgagtgctcactgtgtgcaaagcatatcgatgccacagtcttgcctactttaagtttttatgtgtctgaaatttccatggagctaggaagaactaagatctaaaaaa

SEQ ID NO: 210179 - DNA, 402 bp, Homo sapiens
ggtgggggctggttaggagtcaaggagacaggtcgaggacccaggacccagagctgccccgcctcaagggcaccgggagacacggctgggagcacccgcggcacagcccagacacacctgagtccttgcctgagtcctcgcccatccttcacctggctgggccttggcttcttcatctctaacgtgagggtcaaccgcacccctcaaaggactggcgtgggtcagacggggaagtgcggctgctgcattggcaaggctggcgtggaccaagggcttggctgcatgaatcttactaccccactaggattactctttaggggcttggaagcaaaaagccatcgggggctggggagccgagccctgtcttcctgagaccctgtgacctctgtccactcgagaagg

SEQ ID NO: 210180 - DNA, 482 bp, Homo sapiens
accatcacagtgaaatggtggaggagagaagagacaaatatggagatcttggactcagaagatgatcttgggaagctatacagtgtagtgggggaggcctgggcttctgagtcaggcaaactgcatgggaacactggtgtggacactcacttcatggccttggacaagaaatatgcaaatctgttttctcatttgtcaaatggggataattatccctgtcttgtagagttataagtactatgtgaaataattgtttaaaaagttaatgccagctgagtgtgatagctcatgcctgtaatcacagcactttgggaggctgagacttgagaattgcttgagcccaggagtttgagaccagcctgggcaacatagcaagatcctgtctctataaataaatagtgccttgcataaagaagatacttaagaaatggaaattattagatatttgggacatggaataaaaggattattccaaagagaag

SEQ ID NO: 210181 - DNA, 394 bp, Homo sapiens
ttattctaaaaagcaaccaaagtattagaaatttaaagttattccagtctagaaagacatagttcagatcacacagggatgatagccccaggactggaataaaacctgcagatgatgaaaagacgttgttcccctccccacagaaaatgctgaaattccaggaacaaggtactatatacttgggatgattaagagcaaaatgcttttaaaaatcctctcagactaggattctgctagtagcagaaatctgttcaaattattactctcttctctttcaaagagggtgtatgtacaacaaattacacaaacgatgttagattttccccagaaaagcaaataaaactaaagacaggagcactattggggtcacagtaaaggtctgaggtcctgtcct

SEQ ID NO: 210182 - DNA, 891 bp, Homo sapiens
  misc_feature (340)..(340): n is a, c, g, or t
  misc_feature (343)..(343): n is a, c, g, or t
  misc_feature (564)..(564): n is a, c, g, or t
  misc_feature (885)..(885): n is a, c, g, or t
attaaaatgaaaaaaaaaagagagttcacaaagcataatacatgagactccataatggataaaactatacactttggtggtgttaggagctggattatgtcttccctcagaattcatgtgttgaaatctaacccacagtgcctcagtatgtgactatatttggagatagtctttaaagatgtttctaaggtaaaatggaggtgattcatgtaggccctaatccaatatggctggtgtatttataagaagtgattaggacacagacacacacagcaaaaagacaacgtgaagacacagaatgaaaatggccatctataaactaaggagagagacttcaganganaccaaccctgatgccgccttgatctcagacttacagcctccagaattgtgataaatagatagatagataatcataatcaatatgtagatacacagattctttttaacaattcactactgaatgtcattaggagatatggcaaattgcagactgaagcaataaattatgatgtattctcttacagaagccaaaaactgaaataaggagaatactaatttaanattcaaattaagtttgggggatggtgtgtgccctgatggggtgcgctgagcgagccaggaggcacggagtcactgcagagcgcagggtttcttgaccacgtggacaatgtaaatttgaattctagatccaagtaagaataaggaagtggcacccaatcctctgagttctgatctcccaggcttggcctacaagtttttttgtttgctttcctgttgcatctttgataccatttcctagaggctgctccatgatttaacttgaaattctgaaacaaagatagaggaggcagtgggaaaactcgaataactcattgagtctgnagtccc

SEQ ID NO: 210183 - DNA, 734 bp, Homo sapiens
aaattaggctagtacgaggctggttggaatcggctgatgaaaacacttgaaaggaggaagtgccgtcttgctaaggctggtgtgttcagaagaggacaccgtgaatgattctcctgactaagatggtccactaaaaggaaccagggctccgtggagaaatggcgacttctgggattaaggctggagaggaataagatgaacccagaatatattattctggcagacagtgaggaagtacccagagaatggtaggaactcatccaaaggacaaaagcttgaaggggctctcattgggcaaatctggaatcttttgagtaacaatcatgttagtattgaattgtaactcttttttttttctttttgtagctgggattacagatgcctgccactatgcctggctgatttttgtatttttaatagagatggggttttgccatgtcggccaggctggtcttgaactcctggtctcaagtgattggctcacctcggcttcccaaagtgctgagattaccggtgtgagctaccacacccggcctataactcttcttactttattataagcacagtctaagaatccactagtacctacaggtacagtaatataaatgaaaaagtaaagagggagaagaaaactctttcttatcaactaataaacgcagaaagataatggaataagaaaataccgcttggaactaccatagtaatgattatgtcagggagaatcatcagtgaat

SEQ ID NO: 210184 - DNA, 304 bp, Homo sapiens
ctgatgagagcttcagggtgcttccactcatggcagaagcggaaagggagcagatatcacatgccaagagaggagggaaggccgggcgtggtggctcacgcctgtaattccagcactttgggaggctaaggtgggcggatcacttgaggtcaggagttcgagaccagcctggccaatggtgaaactccgtctctactaaaaatacaaaacttagccaggcgtggtgttgcatgcttgtaatcccagctactcgggaggctgaggcaggagaatctattgaacccgggaggcggaggttgcagtg

SEQ ID NO: 210185 - DNA, 239 bp, Homo sapiens
cccttgaatgttgtatctcttatacataaaaatgataagtataatgataatttggggggaatattccttccttgtttttttccttttgcttccacctttttaattattttaaatacacatatttattaccattgattttctgtcattaatgttgtaaaacttggacagatacagtccttccaatatgatcctattggatgacttggtaacatgatgtgtgttaacagccaaattctgaa

SEQ ID NO: 210186 - DNA, 289 bp, Homo sapiens
tgctgattttcagatatgtgtttgttgttactgggaaagtagaactcgtagagccagaaagtcattatactcaagttttgtcttttgtaagtcttcatccttaagttcctggatgctcctttccatcagtttttttttttttttttggaaacaaattttggcagtgacccgagatgtgacccactgtcccccagccggggtaacagacgagactccatctcaaaaattgttggtattatttatttacagaattttataacatttagtgttaggctgtgcagttcaccaa

SEQ ID NO: 210187 - DNA, 559 bp, Homo sapiens
gctgagggagttcattaccatcagacctgtcttaaaaagaatgctaaaagggagttcttcaggctgaaagaaaaggacagtaagtactaacatgaaaacgtgaaagtataaaactcactggtgaaagtaagtatacagtcaaattcagaatactctaattctgtaatggtggtatataaatcacttatagctttggtatgaaggataaaagacagaactattaaaataataatagctacaataattttagggatacacaatataaaaagatgtaaattatgacaccagaaatttaaaatgtgaggagggtagagtaaaagtgtagtttttttttttatgtgaataaagtttttatcagcttaaaatagcctgttatgagcataggacatagtgaagaaatgtacaaaataaaataaaaattttaaaaaccctattataattatattttacgtaaatctcatggtaaccacaaagcaaaaaactttagtaaatacacgaaagataaaaattaaggaataaagcctaccactagagaaaatcacctaatcacaaaggaaga

SEQ ID NO: 210188 - DNA, 545 bp, Homo sapiens
cagtcctaaccagttactgcattcctagcaaatactgaaaaccttctcattaacttgttattttcttaagttttagtctattgtcaaggaaataattctacaatatatgtatgaaaaagagaaactatatgttcacttctttaaatgtgcctaaatgtcaccaaattgaaatatacaggagaatccaagtattcccatgttatctgctttccaagtttgctattcagggaattatagtaaaaacctaacattacaatgaggacaaaatcatctctccactttttctgtagtaaagtttgaccacttggtaatttcccaggccacatagagcagctcccctttgactggagggtgaaaagtattagagggaaaaataatcttttagaatataagctagactttaaaaaaatcataccatcccatttccttcccattatgatttgaatatttatcagaaaccttgggattttgaagagcatggtttaaccctatccttatttttcctcttttttttttttgaagtgtctttgcattatgtgggtttt

SEQ ID NO: 210189 - DNA, 424 bp, Homo sapiens
acaggattgagatcagtttgtcatcagggctatcattttttctggaggctctaggagagaatcgattatttgcctgtcacacctgctagagatcacctgcactccttggcattggcatcctcattccaacctctactttaatcatcacatctccttctctaattctgactcttctttcttttattaagatctttgtgattactttggatttaactaaataatcaagaatagcctcttcatctcaagatccttaacttaattacatctgaaaagtcctttgtcatttaaggtaatgtattcacaggtgttggagattaggtcacgtacatcttcagggaaatattctacctgccacatcatccatgataataatactttaatggttttgatttaccttttcactcatgcttatatgcttaatatt

SEQ ID NO: 210190 - DNA, 185 bp, Homo sapiens
acttgaccttgggtccatctgctgccagtgttcttgcttaaactaagctgtgctgtgtcggagcccatcatcagaaattacttgccttgtgggtgtgagctactttgaagctgtgtaatgctccaggtgcatattggattaaagatgtgtgtttgattacaggtaatgtcatttgaggactagaa

SEQ ID NO: 210191 - DNA, 136 bp, Homo sapiens
gagccctgcgggatgtcctctgcccatgtggctgctgtccctctgtccagcgctcagggcaatgcctctgggcaagcaggtgctgacaccatccgtctcacacccctcccaggtccccagggccagttgagtcctg

SEQ ID NO: 210192 - DNA, 114 bp, Homo sapiens
tgctatttgcccccatcagaacaagtggattatattggatcctctgtgtttctacttgatgttgttagcattgtcttagatccatagattactagttatctgtcagatgggaaa

SEQ ID NO: 210193 - DNA, 1097 bp, Homo sapiens
aagctaggtgatcatacagtcatttcaatggccaaccagttcttgctctacagagcttttacacctttttgggaaacctgatatcaaacacatttatgttatatatttgctcccttgcattaattctagatttttttttaatttcttttagaaagggcaggggggaagtgggtcagagcaaggttcaagaatcacattcatccttgctctaaagtgtttacttgccagcaaagaaaggcaaacacatttttatattcagaaagcagaccggtcattttcaaagaaaaatgactgcaaccatgcctgtagaatgtttctgtgcaagcgcactaattttctatcacctgcatgctgtatataatacatttgcctgtatactaggaagaaaaaccaggctgttttccctgagtacaatgcagcttggatggctgggagcgtaagccttccgtgcatttttatagtgtacatatttgtatatactaactatatcgccatgtatgaacacagattttgttatatttgcttgtttctgtttcctaccaaactggcccacaatggggattcttttgtatagaaaaaatatgcttgtaattttttcctggtcattctctttcaatagcttatgaaagaattagatctgagtttacaaagaaactataagaaccaagtttgtctgtctgcatgagtcccgtccaattgctggatctagggaggaaccaacttcctaattcagagttttccttttaaaggcatgctttacccccatgggaaaactgcacactcatccatgtagaattattctctttgtattttatctaatagtgcctgaaaatttttttaatgtcttcttagaagaagaattcataattgtcaaaatttgaaacattagcttaattttgtttttatgacctcaagattcttctccttatttattcggttgctgttgtaatggggccccaggccattcctgacatcggcgtgttcttcttctgcattaaggatgtttttgaaattacagagattattgagccaacaggctgttttaatcaaaaccatgtttcacttctttttgatgattataaattgtccttgcaatg

SEQ ID NO: 210194 - DNA, 157 bp, Homo sapiens
gaatggagcactcccaagtatttgacgggcttcttattctctccttttgggcatttaatacatctttaacacaaatcaggattgtagaagattagggcttattttcaaagtgtcttctcagcataaagtcagatgatgatgatgatgatggtggtgg

SEQ ID NO: 210195 - DNA, 744 bp, Homo sapiens
atcaaaacaataaagaccaaagtttggcaagaggccatggcctccatcttgaaagacaccggagggtcattaaatgtccctaatccacagaaagctctcacctaacagacaaaatccagatcgaacacttcctgaggaaactgtacttaaatgggacaaacattgccaggttggctttatcacactttgtagaaacaccctatggtggtgaagacttttaaaataatttcctcaactgtgacaactacatttattgtctccactcaatctccatttcttacccatgatttggaacttgaatgttgggaggccgagagggaaagcagcctgagtctgtggtggagagggagggaggagagtgcctggaatttcgccagaaagtaagcatgtggaagcactttgcctgtcttctcgaggacacctgtggacagcctacacacgaggcacgcggtgaggtccatgagatcttactcttgagtgacgcattcagctcatcttcagagacaagttggatttgccctttctcaagcctaaagcttggaaattttgttatcttaggctctttaatactctcgatgaataaaagaagaaacattgaatatgactgcttttttccccccaactctaaatggccttgtcttacttcgccagtctcattttctcctttcctcccccatttccttcagacacttgtaccctcagacatgtgaaattaattttggatcgatcactttcgacactggt

SEQ ID NO: 210196 - DNA, 262 bp, Homo sapiens
tgcactccagcctgggcaacaagagtgaaactccatctcaaaaaaataaaaaaaaaatgaagagattattccagtgtcggcaacatggcaaactttgcctatacaaaaaattacctcgtcattgtgatgtgtgcctgtcgtcccagctactcaggaggctgaggtagaaggatctgttgagcctaagagttcgaggctgcagtgagctatgattgcaacactacactccagcctgggcaacagaatgataccctgtttcaaa

SEQ ID NO: 210197 - DNA, 427 bp, Homo sapiens
agttatttcattatgtatatgcaaatactacaaaatacaaaaaaatcaaaaattggaaacacttctagtctcaggcattttggataagggatactcagctttagctcatttcaccttgaaatgcatttgtcagcggggtacggtagcacatgcctgtaatcccagaactttggggtgccagggcaggaggatggcctaaatccagaaacttgaaccagcttggacagcatagcgagactgtgtctctacagaaaattaaaaaattagtaggcatggtagtgtgcacctactgaaacaagtagtttcagctatttgggaaactgaggcagtaagatcacttgagcccaggagtttgagactgcagtgagctatgactgtactactgcactccagcctgagtgacagaatgagatcctgtctcaaaaag

SEQ ID NO: 210198 - DNA, 350 bp, Homo sapiens
aggcaagaaattgtttttttttttaatttttagaataccattttatagttaattaaatacaacagtctagaagaactttggagaacccaaatcttaggcattttccatttttttctcctctacttaaaaagctctactaaaacttgatttctttttacattcttgtttcaagaattttctacattcttgtttcaatagtgtagaattatctccatagactttattgtgtcatagcattagataattagtcctactgcctttaggtggagtagttagcattcacagaaatttaaggaatggcttacaacttgtcaatacaatgattgatggagcagagatatttattttta

SEQ ID NO: 210199 - DNA, 555 bp, Homo sapiens
cccgatctacaggaagaaaactggaaataagactgaggacttagtttaagatgttcctactcagcctctagcttttgtgctacagttccgggaacagactcctctctcctgaaaaccatttccctctgcagcattaaatttcaccaagatgtcttgcttgtgggaaagacttccaaggatgcctggagagaggaggatggaaatgtcctgctctctaaacagatagacagatgcagccagacagaaaatagtttatcttgctgaggtttctaatgtatttgaaagaggcctgggtctagaagtctacccagagggctctgtgttgtgcacgcaaagataagaaccttccctgtgggagttccagagccagttttcataaacacccatcggtgactgtgttcagagtgagttcacaccatcctgacctgccctgagttagaccttacatggtcttcctcctctaggaagcctctgcagcccaggaacctccccttatctgaaatgaacagcatttgaagcttcaccagacagaccagacagcttagccctcgtgtt

SEQ ID NO: 210200 - DNA, 532 bp, Homo sapiens
ggacaaaagctgtaagaaaaggtatggaaatgacatggaaaatttctccccaacctccacccttggctgccccaggtgcctccaacctgacaaagccaccagcaatcaaaaccctcctggcattgtggctaagtggttttccttgtgtatccttgagatgtttcttatgtgaatagtttaaagtgtaagggggagccaaaaagtattttaggatggagcgttcaatttaaatgatgccgagcctcagacctttgattttacaaggaacataaagcactggtctttgaacattatttgcaaaccatgttttatcttagttacacagagaagagaaggaaggctacgaatgaaggaaggctgataacttaagctttacactggattgtgaaagtgtaggggaataacaaagggtcatagtcctgggccatgagagttttgtacatatcgtgtagatgaatccatggctgaagtctggagacttcttatgaagaagtttattttaatcaataaatgtttttctatcttcaaaaaa

SEQ ID NO: 210201 - DNA, 444 bp, Homo sapiens
caatgtacaatggtggaatagaggcagaattaccacattaacttccgtttgagagagaattattggagacccatagctgtcacagttccacagcaattatgaaatgaaatcccactgggcaaatgttgccattcttccttactttgtgatagagtctgttccttgattaggctgtggttctgttcactgggagtggctctggtgtccttgtcctccacagctcttggttccaccctttgggagagtcttcattttccatcctcctcagccccttctgaagagaactttagagaataaaccattttggtctgctgagtaactttctcggccagcttcatggcattcaaaattgggagtccaaacaatctcagtctcttctaatgtaggctgactttgtcaatacagttttctcaaggctttgtgagttttctttgtatttgattt

SEQ ID NO: 210202 - DNA, 407 bp, Homo sapiens
cattttggacatttgatatgttagtgaatacccattaatagccaggctaagtcattaacattaggtaggtctagactggtgataactgttgaagctgtggaggggcgtattttctcaacccaagtcattgcatacttctcctagttaaagcctgatataaatgagcttatattctgaatttatacaatttaggattagattccctccctctaaaattttaggtaataggaatgtcagagtattaacaattatgagaatcataagaaaacaagacactatcaaacataaggagagatggggggaacagaacttacagaaatttaaaaatcatcaaagtggataacttattcagcaaattagaaataggtggattggaaggtgaatttgaataaatcactcaggatgcg

SEQ ID NO: 210203 - DNA, 161 bp, Homo sapiens
cctggacaggaacaggggcacatttaacaggaagaaccaaatttatctagatagttatgatatagacaatatgggaaatcaaaaaatgtttttctttctcatgcttaaggaaagtgttagtagcaatgaaaataatcacaccaccaaataggaatgtatga

SEQ ID NO: 210204 - DNA, 162 bp, Homo sapiens
actcagatgatccgcccaccttggcctcccaaagtactgggattacaggtgtgagccaccgtgcctggtctgaggagccactttcaatttcagttcaaacaagggcagggcagggttgctgcccaacacagaaggagaaagctttaggcctcagagatggat

SEQ ID NO: 210205 - DNA, 682 bp, Homo sapiens
gtgacaagagtgaaactctgtcacacacacacacacacaaacaaattaaatttattaaaagcacacactatagaacaattaaaggcactagcctaagtgctttgaatgtatgatgtcacttaacattcacaatagtcttacatggtgggtactaatgttatgtccattttgaagataacggataaaaattactgagacgttacataagtttttaaggtggtccagctaaaaaactgtaacattgaaactgggttgttttactctggaatatctgaaaccatgcttggaggatttggattggtattgtagttcaaataactttgcataaaatttgtcttatttgcaggtagtaagttttgcttcttattgatcattatttacaaatctcatcaaagttatatttggcccaagtaaagtagactgttttcttgctctttagatgatttttccccgtttactctagaataagatcaatattatcctgctggatttaagttcatactattgtgattctaaggatatactaaactactcagcaaagttcaccaaatcacttcatccatgaacacatcgagttaacgtccggtcctgtgttgccacgttggcccggttcccacccttctctggactctcgcctccctatatcccctctgtctcgcagggccccggggctgaccggggc

SEQ ID NO: 210206 - DNA, 709 bp, Homo sapiens
ggaatatccatgaagatttctggaaaagggtgacaatttctcagaactgtggtgccatccatttttccatgaaatatgggtgttctcggaactgtcatggtgttggtggatgtctgatttgtatgttaataagtgtataataaggtcccaggtgaaagctaggtcaaatccagtgccatgttgggtcaagtaggacttagccagcttggcaaacatttcggttttcagggtctctttggctcctagtttgtgcagctatttcaacagtttcctttttgctagtcatgtgaaactactgcatggaatcttctattctcttgtgaccaccctatattatttctctctcagaagggccaaataattgacgtttttatgccattctgagactacagaaagaaaaaaggtcttgagacttctgggggtttggaggaggtggtgacacatgttgtaggagggtgaaggaggaagggcaaaggcaccaggggaggaaaggcaaaggttttcttgttatgtagataaagtctctcaggtaatcgcagaatagctgacagcctgtgacaaagtagttttctctcctttgagtcagtcttagattcctctttaggcaggaaagggagcctcagagaaagccagtacttgcatccactgtttactaatgtagatttccttgataggtatacaattcttttacaaaaaagagcttttcaga

SEQ ID NO: 210207 - DNA, 579 bp, Homo sapiens
tctgccatccatgcaccacggtagtctagagcaactgagaaaaccagatgcctccatagaacccacaggtgtagacattaacaataggacactgtggatctttgtgttgatttcagccacccacccaagtcattaatttatagtttatgcccttcacaaaggaaatgtttttgctaacaaatctcttatgatttcatctatttgtcttttcctctttgtgttttgtctcatacaaataatagttaacatagtgacacaaacaccactaaaatacttcagtatttttctcaggacttattcattttacctggaaggaaattgccgtataacccatgccattagaaaattaaaaatgcaaccatttctgcagctcgtacgtcatatgctatgtaatgaaaacgtgcctagcctcctactcccttgtatttgccaacagaacttaagcaagttctgtctgggctgcactcacactttcttagtgccagggagatgattggatataaattacatagcttatatttcctaatatactaaaaagaaagggaaaaacagaaaaggaaggaagtaaaggaaggaaaa

SEQ ID NO: 210208 - DNA, 397 bp, Homo sapiens
  misc_feature (25)..(25): n is a, c, g, or t
  misc_feature (358)..(358): n is a, c, g, or t
gactctagaggatcccctgtgccgntcccaacgcatgtccctccccgaggggcaccagggcaccctgtctctatcctggcgaatatgctgcgcaagtcgcccggcatctgccttctccttgccagtaaaaaagcaacactgcgggcctccggggatggcagggagctggaacggggacacactgacttctgcaactcagcaagtatcacctctgtcacctccgcctccccgttggattctgcccagcccctgggttctaagattgctgtcccattccacaggcaagccatgagactggggccatgcccagctgggcatgcagaagatcatagaccccctggcccgtggccgtgccttncgtgtggcaagatgacactgcggaaggcctgattgcccc

SEQ ID NO: 210209 - DNA, 206 bp, Homo sapiens
ctgcctgcgtctctcccgcgcagtcttccctcttccttctcctctgcgaccgggacacgaaacaaaggggaccggcgcactgagggcccagagtagttttcttgcagcccggcagctcttctggaatggaggcgcctttgttttgctgcccaagctggtgtttggccccaggcggtactaaatcccgtcgtctaggagaaagcgga

SEQ ID NO: 210210 - DNA, 132 bp, Homo sapiens
aaactttgtgatgcggcaaaccaaaccttactaatttaaaaaggaaaacaaaaggctaatgtgtcagaaatgaatatataaactgaaacagctatagggaaataagactttcatttttaagtcatcgcttta

SEQ ID NO: 210211 - DNA, 454 bp, Homo sapiens
ttttttctaagctttcccaccaatgtggagaagtacaactccaagcaaactcagtgtgcaaaaaaacatgggctatcaaaggagaaaacatgttaggaaaattgagaaagtttgccatgagttaaatcacccatctcctaatctgggctcctatcagattgcaaaatgggtgatttaattcatgggaaactttctcagttttcccaacaataatctggaaggaacagcagcagagggcaaaccttttctctagagggccagatggtaaatattttttacattgtgggccatagggtctctgttgcagctactcacctctgccatggccatgtaaaagtagccatagacaatctgtaaaggaagatgcatgtgcagggtgcatgccagtccccatctatggtgtcccttacagggtagcctgccctgagattgttcttaaaatctatgtacattg

SEQ ID NO: 210212 - DNA, 534 bp, Homo sapiens
gtaaatggaatcatttgaacgtactttgtctgacttttttcacgtagaacattttttgtgagatttatctatgccattgcttatattagtagttcattttttaaaaattagcaaaacttcaggctttatttgaatttcacaagttttccattaaaatcagctgatcaccaccatagtggtcaattgggaagaaaaatacaaagcactgatttggtaaagagtgtagctatagagttagacaagtataatttggactggcattaatttttattttaattcatactggccatgtatgacttcagggaatgtattgacttccacgaacttcagattcctcatttgtgaaataagaatggcaatccacaatgcagagttggttttcagattaatgagataatatatgtgcctgtttaacttagcataagaacttaataaaagtttgctaaataaaagtataaaataaataaggagaaaatacagcagaccaacttaacatgagatactaagaattcacagaagataaaaccaacataa

SEQ ID NO: 210213 - DNA, 236 bp, Homo sapiens
taaaaaacgacttccttagtttgatgtagtctgcagacatctcatcatcacaaaaacttgaaagcacttacagcactaagaaactacctttgcagattgtaaaaaaagatagaatcctacttagtgttttgatcacacctgcctatttccccaaggttttactgcagggttaaagaatgaataagcatctagttatatttaataaactccatgccttatggctgattctaaaggca

SEQ ID NO: 210214 - DNA, 324 bp, Homo sapiens
tggtaaatataaaaggtagactagtcagaatcccatactctaaatgtctgtcaaattcgtgtggctccttagtagagcagcgttggccatctgctgccttgttgttctggctgggcagctctgtgccagcccaggggaggctgagcaatccaggagatggtttaaagtgactgtgggctctggctctatcaccccacgtgcagtgggcagaagtactgcctcagctgcagcagagattggtagagcaggtgccgcaagtcttcacagatgacagtggaagacttattctctaagccatctgaagctctgaccagtggccatgac

SEQ ID NO: 210215 - DNA, 299 bp, Homo sapiens
ttacatatgaaatttggataataaagcacatatttcatagggttgttgtgaagatcaaatgagtaaatgtgtaataagcacttagaagaaaaccgtgcacatagttaactactatataagtgatagccagtgttgtttattagtttgattatcattaccatcaatgctgcacgatttcaattcaaaattttctcgagtgcccacaatatgaaagacactataataaatatttgtgtaactcaaagtactttctttagttgaaaacaacaaaaaccaactctgggtaaaatttgacaaaa

SEQ ID NO: 210216 - DNA, 417 bp, Homo sapiens
atttggtgactgaggtaatcaaccttcactagtgatattatgataatatattttgtcaatagaatgctgttttgtatttagttttataaaataggtcatttaaaaaaaagaaattcaggccagctgggcatggtggcgcatgcctgtaatctcagcactgtgggaggcagaggcaggtgtatcacttgaggtcaggagttcaagaccggcctggccaacatggtgaaactttgtctgtatttaaaaaaaaaaaaaaaaatacaaaacttagccaggtgtggtggcagacgcctgtactcccagctacttgggaggccgaggcaggagaatcgcttaagcccaggaggtggaggttgcagtgagcccagatcgtgcgccactgcactccagcctgggtaacagagcaagactccgtct

SEQ ID NO: 210217 - DNA, 529 bp, Homo sapiens
ggtacccaccgcaggaccattggcggcagcatggtttggagggccacaagagggccatttagtggagccaaggatatacagatgtgttcatggtttagcctgaggttatggagggcccgggggaaggaggccacagaacagacttttttcttttttttttttttttttttttttgagacggaattttgctcttgtcgcccaggctggagtgcaatgatgcgatctctgctcactgcaacctctgcctcccaggttcaagcgattctcctgcctcagctgggattacaggcatgcaccaccacacctggctaattttgtatttttagtagagatagggtttctccatgttgctcaggctggtctcggactcccgacctcaggtgatccgcccgcctcggccacccaaaatgctgtgattacaggcgtgagccactgcacctggccttgcatttctgattaatgagagaaaacatattttcagagtttgctgggcactagtttccttttctctgaaatgactgttcatttt

SEQ ID NO: 210218 - DNA, 189 bp, Homo sapiens
atttttttaatgtgtcttataaagtcagtcttagaaaacattcctaaataatctcactattacgtggctaaattgtactctactagagaacacagaggatgctaaatctctgattataagaatataccgcctgtaatcccagaactttgggagaccaaggcgggcggatcacaaggtcaggagatccag

SEQ ID NO: 210219 - DNA, 243 bp, Homo sapiens
tgcacagagagataaggttagaaggagacaggagaaaacagagcaggaggcagcagaaccaactgtggcttggaccagggtcacaatcttacaagcctgccacgttggctagttgccagaggtccagcgtgtgacctgggagcacgggccttgaccccaaaggggcagctgcttctgtgccagctgacccccccaactgcaggactgtgggccttgactagccaaatctacatcttcaaggtg

SEQ ID NO: 210220 - DNA, 217 bp, Homo sapiens
agggagcagtaattccaaggtctggctttctgcaggaggctcagttctagcttcccaccttatttaagcccaaggccacatctactgtctcactatagatgttacaatcctgaggcccccatctataattttatgtgtctgtgcacacatgcacacatattaaccctctggttcctgtatacatttaggctagatagctcatcccccaataaacaca

SEQ ID NO: 210221 - DNA, 588 bp, Homo sapiens
ggggtcaccgtctgtctgctgtgcctgcctgcatcataattggaacctgtgctgtgttgtactcaatctcgttttctcacaccactaattgtgtgtagcacttcctgtgtgtaacatttctcctactaacctggcagtttttctcctcctcctgtcttttacagggctgtcatgtccgcttcttaaaggtagttcttcctctgctctttcctcatccactttccttccacaaaacacttgccttggtttttgtggctcccgggcctcagcctgcagccatgctctccacccttaaggatgcaccgcgtgttctggtagcttgaatctcacacctacttgtgtcttagtctgtgtgctcccttccaagcagccacggccctcccatgaaaaaaaatgccatgtcttaatcacccagagaatagaccagtctcccctcctcttcagattaggttagtttaaaattttacctgctgggcacggtggctcacacctgtaatcccagcactttgggaggccgaggcaggtggatcacccgaggtcaggagttcaagaccagcctgcccaacatggtgaaaccccgtctctacc

SEQ ID NO: 210222 - DNA, 1924 bp, Homo sapiens
agtgtaataaggtcccggagaagtgtcactggccctgagtgggacccggtagcccgttcgctccgcgccggcggcctgtccccgcggcttggcgggctagggcaggggaaatgttgcaggaggagtcggacctctctctcattattgcccagatagtccaaaagctcaagggctccaatttgtactctcagctggaacggcaggcctgggccagtcttcagagacctgagattaaacttgaatcactgaaagaagatattaaggaattctttaaaatatcaggttgggagaagaaacttcagaatgctgtttatagtgaactgagtgtgtttcctttacctagtcatcctgctgcacctcctgaacatcttaaagaacctttggtatacatgaggaaagcacagggaagttgggaaaaaagaattttgaagagtttaaatagtatgtgcactgaactgagtatcccactggcacgaaagaggccagttggagaacagaaagaacttcttaataaatggaatgaaatgggaactgatgaaccagatttaagccttttcagacctgtttatgcacctaaggattttcttgaggtattaattaatcttcgcaacccaaattatgaaaacggtgattctcttagtttcaggactcatttgggtttaattcaagttccactgaaagtaaaagacatccctgaattgaaagaatgctttgtggaacttggcttaaatataggacaactgggtatagatgattctacacaagtgcctcctgaactttttgaaaatgagcatgtacgtattgggcaaaaagttctagcagaacaagatagtgctgctgctcaacagtacatcagacaaggaagtcccacggcactgagagctgaattgtgggctctcattttgaatatttccagccaacctgaggatgtcttgtattatgagcagcttaagaccaatgtgatacaacatgaccttttggtggacagtctaatctataaagatgtgaagttgacagcaagcaatgatgattattattttgtatttgaagattatttatatcaggtattactttgtttttcccgggatacatctgtgttgagtcactttgcattcaacagtgcctcgccaccaaaatcatacataagaggaaaactaggactggaagaatatgctgtcttttacccaccaaatggtgttatcccttttcatggattttcaatgtatgttgcaccactttgttttctataccatgaaccttccaaattgtatcagatattccgtgagatgtatgtgcgttttttcttcagactccattccatctcttctcatccttctggtattgtgtcactctgtctgctgtttgaaactcttcttcaaacttatcttccccaactcttttatcatctacgagaaattggggctcaaccacttcgcatatcatttaagtggatggttcgagctttctctggatacttagctacagatcagctcttgcttttatgggatagaatcctaggatacaactctctggaaattcttgctgtgctggcagctgccgtgtttgctttccgagcagtgaacctgatggaggtgacatcactggctgcagctgaagcagttcttgctgacctttctactttaaaagttatgcctcttcttcagatttttctgtttgctactgtcacctgatcttcttcacagtcactggcaacacatctagtttttcattagaaacaaatcatgaactatgcaaactctgcataaaaccaaaatgaaactttgcatataagccaataaagatcatgttccctcttcagttaaacctaagtagtttctcactttttgaaacaataactctgcaccaaatattgcatcgcatgctgctgattttcaagagagaagcaataaacacaacttctgct

SEQ ID NO: 210223 - DNA, 1832 bp, Homo sapiens
cagcagagaattcacggacagaagaacaacacagcagggcagagagccacagagccactagcagatgtcagggagatgaagagaggggccacagtaaaataagactctgggatgaaggccagtcttcagagacctgagattaaacttgaatcactgaaagaagatattaaggaattctttaaaatatcaggttgggagaagaaacttcagaatgctgtttatagtgaactgagtgtgtttcctttacctagtcatcctgctgcacctcctgaacatcttaaagaacctttggtatacatgaggaaagcacagggaagttgggaaaaaagaattttgaagagtttaaatagtatgtgcactgaactgagtatcccactggcacgaaagaggccagttggagaacagaaagaacttcttaataaatggaatgaaatgggaactgatgaaccagatttaagccttttcagacctgtttatgcacctaaggattttcttgaggtattaattaatcttcgcaacccaaattatgaaaacggtgattctcttagtttcaggactcatttgggtttaattcaagttccactgaaagtaaaagacatccctgaattgaaagaatgctttgtggaacttggcttaaatataggacaactgggtatagatgattctacacaagtgcctcctgaactttttgaaaatgagcatgtacgtattgggcaaaaagttctagcagaacaagatagtgctgctgctcaacagtacatcagacaaggaagtcccacggcactgagagctgaattgtgggctctcattttgaatatttccagccaacctgaggatgtcttgtattatgagcagcttaagaccaatgtgatacaacatgaccttttggtggacagtctaatctataaagatgtgaagttgacagcaagcaatgatgattattattttgtatttgaagattatttatatcaggtattactttgtttttcccgggatacatctgtgttgagtcactttgcattcaacagtgcctcgccaccaaaatcatacataagaggaaaactaggactggaagaatatgctgtcttttacccaccaaatggtgttatcccttttcatggattttcaatgtatgttgcaccactttgttttctataccatgaaccttccaaattgtatcagatattccgtgagatgtatgtgcgttttttcttcagactccattccatctcttctcatccttctggtattgtgtcactctgtctgctgtttgaaactcttcttcaaacttatcttccccaactcttttatcatctacgagaaattggggctcaaccacttcgcatatcatttaagtggatggttcgagctttctctggatacttagctacagatcagctcttgcttttatgggatagaatcctaggatacaactctctggaaattcttgctgtgctggcagctgccgtgtttgctttccgagcagtgaacctgatggaggtgacatcactggctgcagctgaagcagttcttgctgacctttctactttaaaagttatgcctcttcttcagatttttctgtttgctactgtcacctgatcttcttcacagtcactggcaacacatctagtttttcattagaaacaaatcatgaactatgcaaactctgcataaaaccaaaatgaaactttgcatataagccaataaagatcatgttccctcttcagttaaacctaagtagtttctcactttttgaaacaataactctgcaccaaatattgcatcgcatgctgctgattttcaagagagaagcaataaacacaacttctgct

SEQ ID NO: 210224 - DNA, 850 bp, Homo sapiens
  misc_feature (759)..(759): n is a, c, g, or t
  misc_feature (782)..(782): n is a, c, g, or t
  misc_feature (793)..(793): n is a, c, g, or t
  misc_feature (813)..(813): n is a, c, g, or t
  misc_feature (825)..(825): n is a, c, g, or t
agtgtaataaggtcccggagaagtgtcactggccctgagtgggacccggtagcccgttcgctccgcgccggcggcctgtccccgcggcttggcgggctagggcaggggaaatgttgcaggaggagtcggacctctctctcattattgcccagatagtccaaaagctcaagggctccaatttgtactctcagctggaacggcaggcctgggccagtcttcagagacctgagattaaacttgaatcactgaaagaagatattaaggaattctttaaaatatcaggttgggagaagaaacttcagaatgctgtttatagtgaactgagtgtgtttcctttacctagtcatcctgctgcacctcctgaacatcttaaagaacctttggtatacatgaggaaagcacagggaagttgggaaaaaagaattttgaagagtttaaatagtatgtgcactgaactgagtatcccactggcacgaaagaggccagttggagaacagaaagaacttcttaataaatggaatgaaatgggaactgatgaaccagatttaagccttttcagacctgtttatgcacctaaggattttcttgaggtattaattaatcttcgcaacccaaattatgaaaacggtgattctcttagtttcaggactcatttgggtttaattcaagttccactgaaagtaaaagacatccctgaattgaaaagaatgcctttgtgggaacttgggcttaaaattattagggacaaactggggtatnagaatgaattcctacacaaagtngccctcctggnaaacttttttgaaaaattgngcaatgttacgntttttggggccaaaaaaaggttcct

SEQ ID NO: 210225 - DNA, 424 bp, Homo sapiens
agtgtaataaggtcccggagaagtgtcactggccctgagtgggacccggtagcccgttcgctccgcgccggcggcctgtccccgcggcttggcgggctagggcaggggaaatgttgcaggaggagtcggacctctctctcattattgcccagatagtccaaaagctcaagggctccaatttgtactctcagctggaacggcaggcctgggccagtcttcagagacctgagattaaacttgaatcactgaaagaagatattaaggaattctttaaaatatcaggttgggagaagaaacttcagaatgctgtttatagtgaactgagtgtgtgagttttcccacctattttacaatagtattttgtttagctatatttactttgtgagtaataaaaccagtattgttatatatacttgttgtatta

SEQ ID NO: 210226 - DNA, 1729 bp, Homo sapiens
agtgtaataaggtcccggagaagtgtcactggccctgagtgggacccggtagcccgttcgctccgcgccggcggcctgtccccgcggcttggcgggctagggcaggggaaatgttgcaggaggagtcggacctctctctcattattgcccagatagtccaaaagctcaagggctccaatttgtactctcagctggaacggcaggcctggggaagttgggaaaaaagaattttgaagagtttaaatagtatgtgcactgaactgagtatcccactggcacgaaagaggccagttggagaacagaaagaacttcttaataaatggaatgaaatgggaactgatgaaccagatttaagccttttcagacctgtttatgcacctaaggattttcttgaggtattaattaatcttcgcaacccaaattatgaaaacggtgattctcttagtttcaggactcatttgggtttaattcaagttccactgaaagtaaaagacatccctgaattgaaagaatgctttgtggaacttggcttaaatataggacaactgggtatagatgattctacacaagtgcctcctgaactttttgaaaatgagcatgtacgtattgggcaaaaagttctagcagaacaagatagtgctgctgctcaacagtacatcagacaaggaagtcccacggcactgagagctgaattgtgggctctcattttgaatatttccagccaacctgaggatgtcttgtattatgagcagcttaagaccaatgtgatacaacatgaccttttggtggacagtctaatctataaagatgtgaagttgacagcaagcaatgatgattattattttgtatttgaagattatttatatcaggtattactttgtttttcccgggatacatctgtgttgagtcactttgcattcaacagtgcctcgccaccaaaatcatacataagaggaaaactaggactggaagaatatgctgtcttttacccaccaaatggtgttatcccttttcatggattttcaatgtatgttgcaccactttgttttctataccatgaaccttccaaattgtatcagatattccgtgagatgtatgtgcgttttttcttcagactccattccatctcttctcatccttctggtattgtgtcactctgtctgctgtttgaaactcttcttcaaacttatcttccccaactcttttatcatctacgagaaattggggctcaaccacttcgcatatcatttaagtggatggttcgagctttctctggatacttagctacagatcagctcttgcttttatgggatagaatcctaggatacaactctctggaaattcttgctgtgctggcagctgccgtgtttgctttccgagcagtgaacctgatggaggtgacatcactggctgcagctgaagcagttcttgctgacctttctactttaaaagttatgcctcttcttcagatttttctgtttgctactgtcacctgatcttcttcacagtcactggcaacacatctagtttttcattagaaacaaatcatgaactatgcaaactctgcataaaaccaaaatgaaactttgcatataagccaataaagatcatgttccctcttcagttaaacctaagtagtttctcactttttgaaacaataactctgcaccaaatattgcatcgcatgctgctgattttcaagagagaagcaataaacacaacttctgct

SEQ ID NO: 210227 - DNA, 1383 bp, Homo sapiens
aaggctggtaccggccgcgatgtatggatcacctaaggattttcttgaggtattaattaatcttcgcaacccaaattatgaaaacggtgattctcttagtttcaggactcatttgggtttaattcaagttccactgaaagtaaaagacatccctgaattgaaagaatgctttgtggaacttggcttaaatataggacaactgggtatagatgattctacacaagtgcctcctgaactttttgaaaatgagcatgtacgtattgggcaaaaagttctagcagaacaagatagtgctgctgctcaacagtacatcagacaaggaagtcccacggcactgagagctgaattgtgggctctcattttgaatatttccagccaacctgaggatgtcttgtattatgagcagcttaagaccaatgtgatacaacatgaccttttggtggacagtctaatctataaagatgtgaagttgacagcaagcaatgatgattattattttgtatttgaagattatttatatcaggtattactttgtttttcccgggatacatctgtgttgagtcactttgcattcaacagtgcctcgccaccaaaatcatacataagaggaaaactaggactggaagaatatgctgtcttttacccaccaaatggtgttatcccttttcatggattttcaatgtatgttgcaccactttgttttctataccatgaaccttccaaattgtatcagatattccgtgagatgtatgtgcgttttttcttcagactccattccatctcttctcatccttctggtattgtgtcactctgtctgctgtttgaaactcttcttcaaacttatcttccccaactcttttatcatctacgagaaattggggctcaaccacttcgcatatcatttaagtggatggttcgagctttctctggatacttagctacagatcagctcttgcttttatgggatagaatcctaggatacaactctctggaaattcttgctgtgctggcagctgccgtgtttgctttccgagcagtgaacctgatggaggtgacatcactggctgcagctgaagcagttcttgctgacctttctactttaaaagttatgcctcttcttcagatttttctgtttgctactgtcacctgatcttcttcacagtcactggcaacacatctagtttttcattagaaacaaatcatgaactatgcaaactctgcataaaaccaaaatgaaactttgcatataagccaataaagatcatgttccctcttcagttaaacctaagtagtttctcactttttgaaacaataactctgcaccaaatattgcatcgcatgctgctgattttcaagagagaagcaataaacacaacttctgct

SEQ ID NO: 210228 - DNA, 1854 bp, Homo sapiens
cagcagagaattcacggacagaagaacaacacagcagggcagagagccacagagccactagcagatgtcagggagatgaagagaggggccacagtaaaataagactctgggatgaaggtatgaccaggacaagggccaggccagtcttcagagacctgagattaaacttgaatcactgaaagaagatattaaggaattctttaaaatatcaggttgggagaagaaacttcagaatgctgtttatagtgaactgagtgtgtttcctttacctagtcatcctgctgcacctcctgaacatcttaaagaacctttggtatacatgaggaaagcacagggaagttgggaaaaaagaattttgaagagtttaaatagtatgtgcactgaactgagtatcccactggcacgaaagaggccagttggagaacagaaagaacttcttaataaatggaatgaaatgggaactgatgaaccagatttaagccttttcagacctgtttatgcacctaaggattttcttgaggtattaattaatcttcgcaacccaaattatgaaaacggtgattctcttagtttcaggactcatttgggtttaattcaagttccactgaaagtaaaagacatccctgaattgaaagaatgctttgtggaacttggcttaaatataggacaactgggtatagatgattctacacaagtgcctcctgaactttttgaaaatgagcatgtacgtattgggcaaaaagttctagcagaacaagatagtgctgctgctcaacagtacatcagacaaggaagtcccacggcactgagagctgaattgtgggctctcattttgaatatttccagccaacctgaggatgtcttgtattatgagcagcttaagaccaatgtgatacaacatgaccttttggtggacagtctaatctataaagatgtgaagttgacagcaagcaatgatgattattattttgtatttgaagattatttatatcaggtattactttgtttttcccgggatacatctgtgttgagtcactttgcattcaacagtgcctcgccaccaaaatcatacataagaggaaaactaggactggaagaatatgctgtcttttacccaccaaatggtgttatcccttttcatggattttcaatgtatgttgcaccactttgttttctataccatgaaccttccaaattgtatcagatattccgtgagatgtatgtgcgttttttcttcagactccattccatctcttctcatccttctggtattgtgtcactctgtctgctgtttgaaactcttcttcaaacttatcttccccaactcttttatcatctacgagaaattggggctcaaccacttcgcatatcatttaagtggatggttcgagctttctctggatacttagctacagatcagctcttgcttttatgggatagaatcctaggatacaactctctggaaattcttgctgtgctggcagctgccgtgtttgctttccgagcagtgaacctgatggaggtgacatcactggctgcagctgaagcagttcttgctgacctttctactttaaaagttatgcctcttcttcagatttttctgtttgctactgtcacctgatcttcttcacagtcactggcaacacatctagtttttcattagaaacaaatcatgaactatgcaaactctgcataaaaccaaaatgaaactttgcatataagccaataaagatcatgttccctcttcagttaaacctaagtagtttctcactttttgaaacaataactctgcaccaaatattgcatcgcatgctgctgattttcaagagagaagcaataaacacaacttctgct

SEQ ID NO: 210229 - DNA, 1280 bp, Homo sapiens
aggtttccctgacttcttaaaccccttccaatctgttacttcttagtatatgaatgttggacaaaaaccagcccaataaaatgtaataggaatacatttaagtatcaacaaattgtatttaagctccaaaaagtcaataatatagaatgaagcatacctgatttgacagcaattccaatgaaaaagagttaatacaggccaagaatgtctctactgcttccctccaagtgctctgggctgtgacccagtgaacatttccagatcacagcccatgtttctttctggttgctcactctctgctgagaccctgctccacctcagatcttcacttttgaggcagttgctcgtcatttccagcccaaccctaatgccaccagctttgtggggccatctataagactatcagctggctttgctctcccctccttttgaaacaaccacatttcaccttacctaggaattactgaagttatcaaattgctatgcaaactccttgagtcagggaccagccattccttatattcatggtttctggatccacattagttccttttgtgttgcaggtttttaacaaacattgattgaataaataattggataatatgaggttagcactgcttagaacagatatctttgaccaaatttatgaaaacacatgcatgaaggacttctccctgttttcttcagtccagtgctggctgacttagagtcttaggttccaccatgaccaccatatttgatgagaaacatcagcagactctagggtacaggtgaaagtgacagtgatgcgggagacacctggaaatggtgggaaacaattggacatgtttatcttggaggaggaaaaaacaagggtaatcaggtagctggcttcctcatatctttgaagggctgacttatgaggaaggaagtagactgtttttgttgattgtaagggaaaaactaggtctaattggagagtgtatgtggaactctttagcagaggaagtggctggggcctaggactgtcaactcccagatgctggtgtgacttggatgttccattaccactaattaggagtgatgttttaggcaggaaggactagcgcagtggttcccaaaccttgctagtcctcagaatcacctgaggacttattaaaaattcacattctggctggctggcttatgcctgtaatcccagctctttgggaggctgaagtgggaggactgtttaagcccaggagttcaaaaccagcctgggcaacatagtgagaccttgtctctctacattaaaaaaaaaa

SEQ ID NO: 210230 - DNA, 532 bp, Homo sapiens
ttatccacatattatacattttttattttagttgtttaatgaaaataattgtaattcttttcagttctgccaaactgtttcctatccatgtgtcttatgcaagtacctgcaagaaaaagatgagggtttatctgttctacacccagagtacccaatagaacatcttggatgcatgttattgaaggcttaataattctaaatattcttcatatataacaaatgcttttgtaaatgaaaaatgcatcacgcaattttgatgatcaaagattaatcaggctgggtgttgggggctcacgcctgcaatcccaacactttgggaagcaaaggcgggtggatcatgaggtcaagagatcaataccatcttggccaacatggtgaaaccctgtctctactaaaaatacaaaagtaagctgggtgtggtggcacacacctgtagtcccagctactcggaaggctgaggaaaaggaactgcttgaacccaggaggtggaagttgcagtgagccgagatcatgccactgtactccagcctgg

SEQ ID NO: 210231 - DNA, 282 bp, Homo sapiens
tggtaggggaaggtagttgctagccaatgaatttcagatgatttcctacaatgctgagcaaaagttaaatgtttacacactgaagtgtgcctgcaaggccacaggtaacacatttactagattagtgaattgtgtctgtgtttttcttagaatactggaatgaaaaactgtatccaacttgtccctctttttgcaagcaataactgttaagaattagtcagcagtaagtatggtcatagactaaaataatgttccaagtgagtaaagagggcaagatattga

SEQ ID NO: 210232 - DNA, 155 bp, Homo sapiens
ccatgtttacgcctccctatacaaggtcagccctttgcctaacctctgagacacttgaggatcacatcgtcagactgtctccttattgtaatagtccccccccaacccccacaacaatccttttgaataaattctctttttatggaatccagatt

SEQ ID NO: 210233 - DNA, 500 bp, Homo sapiens
attgtagataattgctaagatttctttcttaaatctttgacagaagtgacagtaacccctatatctatagccaactgatttttgacaaagttccaagaacatacattggggaaaggacagtcttttcaataaatggtgttgtgaaaagctagatatccacatgcaaaagaatgaaactagacccccacgtcccaccctttacgaaaatcaacgcaaagtggatcaaagacctaaatataagacacaaaactgctagaggaaaacataggggaaacatcaggacataggtctgggaaaagattttttgaataagatttcaaaaccacaggcaacaaaagcaaaaataaatgagattatatcaaactgaagagtttctgtgcagcaatggaaacaacagagtagaaagaacctactggataggagaaaatatccgtattcatccaacagggggttaatatatatctagaatatacaaggaattcaaacatctcaacagcaaa

SEQ ID NO: 210234 - DNA, 522 bp, Homo sapiens
agtttcagattttgtctgaccgtatgattttcgtagaggtagacagaattacagatacctatttaggaatgtctctgaaatccaaaaaacatggttagaccttataggattgtataatgagtttcatcacgaagatctgtccttgacttggggccagaacaaaaatgttgcccaatcaaacggacaaaactaagccgacagcttcatattgggaacatttataagtctttaaaaattaagacaaaaattatttgtataagtatctatgcattaggtggctttatctgatttccatttagtttttagtctgatttctagttagttgtcttgctaacttttccaggagctttctcctatccaagtactaaccaggcctgatcctgcttagcttctgagaacagatgagctccaatctgaaatataacagcacttgtattcccatgagtttctcatatttgaaacatctgcattattttgactcctactttgtatagttttaaaagaagtcatgtaagtctcaaa

SEQ ID NO: 210235 - DNA, 407 bp, Homo sapiens
tgggcaatcctctgctcagttttaacgaggaacctcatgagcagagacttagaatggggctttagtctagagctccttagcacatgttattagaccctataaaccatctcattaatttttacatctctaagctaactggatcagatgtcctgcttcttcctgggcacataaatacaatattctctcccaaagtcaccatacccaaataagttcttccataaggttgcttagagattgtaaataattcatgtaaagtattaaacatggtttcttacatgtagtgagcagccaggaaatggtagctgctattttattattgctgctatcattattgcaatgtgtacctactgtgaacaaagcagcattataaatggaaagtaaagctggttggtggcacattcaaaact

SEQ ID NO: 210236 - DNA, 328 bp, Homo sapiens
acagattccttcattatacattcttttaataaggaatgagtgattaattacccaggaatgccaatgttttcaatgagtctgcaacacacatttattttttctgaagagagaaacagtatctgctccacctgcatgccagggctgtcaactaataaaacatcagaagtgacatgcaaaaacgaaagcagaaacagtgaacctaaaactgtctgacaagagttttcagaaaaatcaattatagagaatcaacagcaatttgattaaaggtttaagatcttttcatatttaaagtcctacaactggggagctcaatttcaacctcaattaa

SEQ ID NO: 210237 - DNA, 341 bp, Homo sapiens
cataaaaaggattgaaaagggagaaattaaggtaaccagtttttcaaggattcaggcttgccttttagccagattgtaaatacgatctggcagcaaatcttcttagggtttatattgagcttttgcataattaaccatatgtcttacagttaaaggaaaccattttaaatcttatctgaagtgagatgaagtataaactatattacttcctattattttaaaattgttattttaaaattttatatatagtaaaaatgaaccttttgaatatacagttctaatacatgtacggtttcatgtaaccatcaccatagtcaggatacagaacagttctaccaccc

SEQ ID NO: 210238 - DNA, 126 bp, Homo sapiens
tcccggggcagggtggctggagctgagtgagcaaggatgaagagggggagattaattcaggaagatcccgtgagcactgaaggccatgctaaagatgtgttcttttattttttttttttttgagat

SEQ ID NO: 210239 - DNA, 199 bp, Homo sapiens
ggttttctctcttcgacagagtcagatttcctacgcacatcgcagactttctgttcgtactgtgagcttcttccatgagctattttggggccgtaactgagttgcaaaaatctgtttcctggtttttgtattgaggttttatgttttgttttaaaacacacacacacacacacacacacacacacacacaccacaaaac

SEQ ID NO: 210240 - DNA, 374 bp, Homo sapiens
gaggttagagtatgctttggtcagcctggttgttatgttattttttattttatgacggagtctctgtctctcaccgagactggagttcactggcacgatcccagctcactgcaacctctgcctcccaggttcaagcgatcctcccatcctggcctcctaaatagctgagactacaggctcagcctcccaagtaactgcgactacaggtgcacgccaccacacccagctaatttttgtatttttagtagagacagggtttcaccatgttggccaggctggtcccaaactcctgacctcaagtgatccacccgccttggcctcccaaattgctgggattacaggcatgagccgccgcatctggccatcctggttat

SEQ ID NO: 210241 - DNA, 378 bp, Homo sapiens
cagaatcactaaacattgtggattttcagccatttgacattttaaggtacaaatagactttccctgcgttattaattccacatgtcattgctgaatactctttggttattcttcctttgaaatgtcaactttttgttcatagagttctactaacataggcctcctcctgaagatgattcgtctaggtttattcaatgtgtattctgtcacatcctaccttatcttcaaaaagggtgcattcattctctctttcccaaattgcaattttttgagtctgctggacattcttacagcttaatattcttttcaacaaactgaaacgttggtggaaggatggtggttctcaatgtaatattttgtgtgtaacgctagcaaatc

SEQ ID NO: 210242 - DNA, 115 bp, Homo sapiens
aaggtgatattaggttaagtttcaaatatgtggaagcagtagggtataccgaaatctagatgtcctttaagaatggatgtacagatttggatttaaagttggtggtagtcactgt

SEQ ID NO: 210243 - DNA, 351 bp, Homo sapiens
acagaggtgaaaggggactggggcaggtatgttggggctcgtgatacatgctcccaagcctgctttaatcagtcatatgcatcagggtaaggttgagctctgctgctttaaggaaagtctagaacccagggatctagtccagttagggtagggggaccttacagtgtcgcaggtgagaagggtgtggaggggaagcacctggaaactgctcatgtctccctgatctgcttccttagtctcgtttatttatttatttatttttgagacagagtcttgctctgtcgcccaggctggagtgcagtggcgtgatctcggctcactgcaagctccgcctcctgggttcacactatt

SEQ ID NO: 210244 - DNA, 319 bp, Homo sapiens
gatccctactaaatggctgtgtgacctggggaagtacttctgctttttgggtttcttcatttgaacaatgaatggaggactaggtaattggaatgctgttaaaccattcatgagaaatgcacccccatgatccagtcacctcccactaggccccacctccaagattggggattacatttcaatatgagatttgggtggggacacacatccaaactatatcagcagtactggacatttttcatgagagagaaggggcacaagaggatgtctggagctagcctctagaatgttggtgtggaaaatctctccaatgtttgaa

SEQ ID NO: 210245 - DNA, 188 bp, Homo sapiens
ttatcacttcaaacttctaaatgcccatgttgataattggtcccaaaaagacattatcagttggtgcagaagtatattcctgtgagctttccataggtttctccaaaaaaggattgggtattttggatttccagctatcttggtattatctgctattctaatccagccatcacgaaataccaaaggag

SEQ ID NO: 210246 - DNA, 603 bp, Homo sapiens
gggagctcagcgaggaggagaggagcctgggcagctgtctctgtcctccaccccttttcctaaatttaggggaagctgagtcaccatgccagctgcagggagggaaggaaacaccctccctggagatggaccgtgggtttagggaagcagcttggggcaggccagctggctcaggacctggtgtggggacacaggctccctgctcctatacttcagagcagagcagagtccccagctccactattggtataatagcttgaaattggccattgcaggagtatttacaccatggaaattggcaatcagcctcacctcccatagagagctggcctagcagtaacaattccttttacctgagcatcggaacaaaggatgggcagttcttaacctcggatgaaacgctccatgggtggtccatatgggctttgacttctgccttctcccacatctgggcccctgagataaagatacccccctggctttgtcagcagagatccttttcttcttggtttttttgaggtgagagggatggggctttctgaattccctgggaatttaattcctctcccaatattttgcaaggttggagtggtggcctaaaga

SEQ ID NO: 210247 - DNA, 428 bp, Homo sapiens
cggcccactgcaacctaagcctcccaagttctagccattctcctgcctcagcctcctgagtagctgggactacaggcgcccgccaccacgcctggctaattttttgtatttttagtagagacagggtttcaccgtgttagccaggatggtctcaatctcctgacctcaggtgatccgccagcctcggcctctcaaagtgctgtgattacaagcgtgagccactgcacccagccaaaggcagtcttttagaaggactgagacttacaagaggctaaaaaggaaatctcaaaattttcgactcatcattcatatatatatatagatagatagatagatagatagatagatacacatataaataatgagtttctaggtcccttggttcacctccattgtaagtgaatttagttttcttttggctgcagtat

SEQ ID NO: 210248 - DNA, 392 bp, Homo sapiens
gaggaacacatgctgtgattcagcttgcctctgtcaaggctgatcagaccagttagttgtttcttactgtttttcctaaaacagatgtcaagagacagatatgggaattctgggacagtagaataggtaggtaccctgattacacgtaactgggtctgttttagccaagtctgttttctacaaatggatcactcatgggagccatttattttcccttaaaaattatttgggtgtgtttttatgctgtacatgaaagcagtggcctctgtctcttgggatgactggcacagaaatatccttatccctgggataaggctatttgactccttggatcatctcctagagataggaagatacttagactgaaagacataatttacttggcctggaga

SEQ ID NO: 210249 - DNA, 168 bp, Homo sapiens
attcctatcagcaaagtatgagagtacctattttacccatagccttgccaaaagattatgcaaacctttggacatttatctactgatgggacgcaccagtcttgctcccatcagccagtcttctatgtaggcagagctttgtcttttcaaagggggtggggtagggtc

SEQ ID NO: 210250 - DNA, 369 bp, Homo sapiens
attacaggtgtgagccaccacacccggcctagaagaagatgaggattttgaataggactcctaagagatcacttgtagtgtcttaaatatgccatttaagaaagaaaagttgcatatagaggtttaggttaactctgagaaaagccaggcctgccattcaaaatacagcactttccagagcatactgctttaaaaagttgaataatacttggtttcaaaaaccttgtgtaaatgcattatattttatttatgatatgtgcttcctaacaaatttgaaagaaagagatcttagtgtagcttccatctagtgataatgccagctgccctttattttggattttcccgtgctatttataaaaccaatctctt

SEQ ID NO: 210251 - DNA, 771 bp, Homo sapiens
ttgagaagagttcagaggagcctgactagagttagggtaaggaagaggggctttgtcacaagtgaagaaactaactgtaaatcaataagatttagaaggaaaaacgaactataaataaattacagaaaaatgtaatgaccacatagcatatctgtctgtgtatatctttaggtcttttttgttgataacacatcagtttataatattaaaatgttcaaagataaaaatgaacgttcacgtcacccctttcacctgcttgttccctgggaaaagatgttagatcctctgtaaagtctggagaatgtctttataataacacatcttgacatgtgcatagatgttttgttaacaaaaagtagactcgtagcatttcaaaacgttttcttctgtgtgcagtgtgatttctgctccttggatggatttcattacttttctataatcagcatccttctgtgtctttctataaagtttgtacagatagggagacacataaaagtgttaatgtattgatagttttgaccttataaatgtttaagactactgaatggcacaaaaccaacattgtaacatgtataatgtgcaacatactactgaagagatcagattttaaaatggacaaatgtataaagaaaaaaataggcagctcataaaagaagaaatgtaaatggccgatggaatgtatcttaaaatagtcaaccgttttgtaaacaaggaacttcaaattaaaatgatattggctactgtcaaatatttaaaagatgaacaatgttt

SEQ ID NO: 210252 - DNA, 457 bp, Homo sapiens
tcatttttccccatcaggcttctccacactacatctgactaaagtaacagcctcctaactagggttcctgacccaagaacctctaatttcagctttatcctccctgctatcagcagttccacctaaaactcagctctcacacctcccctggggagaacacaatggcatggcacatgtgaatgtttagcagtgcttttattgtttaattgttctgatgggagcaagacatcttgctccccatcagggacattgattttctcaaagaggaggaacatgactgtttcttggaagagataatgacaaagagggaagacttggtggtagcccctgcaggcatcacactgatgggacgaagatgcgccaactaaaaatattaaacacaaactaccacctacctccctcaccaaagcccataaaaataaaaaattataacaaaccctgatgggagcaagatgcg

SEQ ID NO: 210253 - DNA, 220 bp, Homo sapiens
tagcaggagcacttcaacagaacagaggtgagattagtgtcagatcactaaatcctaagtctcttctgtgcatctctacctgctctatttcatcatgctcccttccctgcacacctccagccgtctgtctactaacaagagacccgtacctcagtcccactgagccaggtgggactgggccaaacctccctatttgattcttgcctcatcttccctggga

SEQ ID NO: 210254 - DNA, 390 bp, Homo sapiens
ggaccattgctatacatctattaaatacactctgggtttaaaatgttttatcactgctcaaagtgcattccacattcaagctatgctcaattaattggaaattctcaagtgtgctgtatacagttctctttaatttctgcatccttgcatcatattcctatcactgattagaatgttctttcccatgtccatctcctttttattgctggctaacttttccttattgtttaaacctctattcaattgtcacttcctccagaacaactcttcaaatttccaggatgatacggtgttttgggtcatcagagtcccttgatcttaattgtagccttattgtctaactttcgtattagaatttacatccttgaggttagggataaggtatgtgtg

SEQ ID NO: 210255 - DNA, 487 bp, Homo sapiens
aaatctgtacctaagactggtgcgtgagagactcacgttcctccatttcgaatctggttaacttgctatgattgagaagctcgctcacaaatcctcaccctctcattcctatcctttctggattgagtgaaagattttcaggttgtgaaggctgaagaaaatggctgctgacttcacaacctgtttcagccaaattgcaaagccccaaagggtcagtaaaattcttgctgggcttcatcagacattacatttcataggggcacgggaggagtgtgctcttctgtctaatgaaatgtgggccttcagcctcacttccactgtgattcttgaaaaacatttatttcctcactaacggttcagtgttcagcaacctgggaggtttgccctagtactattctacaaggtcacaggtatactttgcaaggttctgcctctctttctctcggagagcttattctctcttgtggcctaaacctcacctctgtct

SEQ ID NO: 210256 - DNA, 418 bp, Homo sapiens
tgcatcttgatttgataaaatccactattaaactgggaaagacttctggagggacaccggtaccaccacccagaccacttagccatgggcttggtctctaactaaggcaggtgtgtgctgtagcaaacatctaacgttttagataaggccatacagttttacacacacgtgcacacacgcacacacacacacacaccaggtttacaatggaaaaactttaaaaccaacaagaaatttaaagaacagggtggtatcaatttctgatacaccaagtaccagaaaatactggagcaccatctatcgcagtgctactcaaagtgtggtctggtccagcattgctttttactggtttgcaagtgagaaacaattgagtgaaaccttttagaaacttgtatagcaatttaacattgccatgaca

SEQ ID NO: 210257 - DNA, 350 bp, Homo sapiens
tcctaattccaatggggaatacattatacaaacaaagaaaaataaacaaaaataatgatttcaggttgtagtcagtactcttaagaacaataggctgggagcagtggctcacacctgtaatctcagtactttgggaggctgaggcaggtagatcatgaggtcaggagtttgagaccagcctgaccaacatagagaaaccctatctcttctaaaaatacaaaaattagccagacgtgattgtatgctcttgtaatcccaactactcaggaggctgaggcaggagaattgcttgaacctgggaggcggaggttgcagtgagctgagatcacaataatgcactccagcctggg

SEQ ID NO: 210258 - DNA, 351 bp, Homo sapiens
gcatttgtgctagtttcttatcttaggtgatcagaaaggaagtgacagaggcaaccacttttagtgaagatacatgtagaatcttcagcaagtgatattgctacaaatcagatggcaccacccagatggtaagttcactgtgtttattccaactctgcattccactgtcagtaggatggttatctatgcattcagcactgcacaaattgtacaagccagtgagccttctgcccagaatcataaaatgaaagcaagaatattggaagccaaaaagacttcttcatatgtttgaaagttcagcttttccttttcattaaaaattcacttccccccactccccatgcaagaatt

SEQ ID NO: 210259 - DNA, 384 bp, Homo sapiens
cacagtgggatccacggcctcactcaaaagagagctatggttcccagatccctgacaagagggccacaatctgaaaaggggttcctggttagctcttttaggcttagcctgagaacagaattagcctcatatttttaggccatttgccatacacattttctctcattctcaactgatacgggtggggggagattttcgcagtgatgttggtaatttatagttagtaaataaaccatgtttccatatgcaaggattcacaccaggggatcctgcccacaggtatctggaggtcaaattcgtatgtgctttctgccaatctgagccactgcctctgtgtctctgagaataatatactctgcaagaagggacgcacaagcaatagtg

SEQ ID NO: 210260 - DNA, 369 bp, Homo sapiens
ttttttctcactggggcaccatctttgcttttcattacactctagaccagtttgacatccctatgtccagagctcttcctctatgtgggttgatttggtttttgatgtcactgagcgctacattttatacttgtcacttatggatgtcattctagtgtcacaagagctcttttcaaggtatcaagtgatcaaaatcatttatatagagatctcctgaaaacatgtgtgaccatctatcttgggaagtttcataaacctgatgctattttgttgtttccattttgttttcccatatactgaaaagaacagggccatgagcggttcttatgcaatatggtttgatatatattttgttgagatgacctaaca

SEQ ID NO: 210261 - DNA, 1499 bp, Homo sapiens
  misc_feature (1243)..(1243): n is a, c, g, or t
  misc_feature (1247)..(1247): n is a, c, g, or t
cgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggtttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgtttcaaaaatgaaaaacacacctctatnaaantgtgtactgggaataagctttgtatttacatacacttaggggaattgttaacaactctgtaatgtttggaccaaaccagatgatattacttttgctataaaacttattacactgtaccttttaatacaagatagcccagaatatttctacagttagaaattacgtttttgtttacctcacgacatagaagaatataacattcttaaactgctggatgatctgaaagacattagtcaatttcatgatctcata

SEQ ID NO: 210262 - DNA, 551 bp, Homo sapiens
  misc_feature (372)..(372): n is a, c, g, or t
  misc_feature (390)..(390): n is a, c, g, or t
  misc_feature (416)..(416): n is a, c, g, or t
  misc_feature (424)..(424): n is a, c, g, or t
  misc_feature (550)..(550): n is a, c, g, or t
cgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacngatcaagtcctctataangcagtctttgatagagtcataacgtnttggagantcctgatgtgtgaacacaggagtatgccgtggaaggcacatacatccataattgtttaagaatgggagactcctcagcaggccgttggattgaagagattgatatgagtgagagcggagccctctng

SEQ ID NO: 210263 - DNA, 449 bp, Homo sapiens
actatccagatgccatggttcaatccagactccctaggaaagaagactctaagtcatccattttatttcatttcccgttttgtgtggttcctggggagaatgcattgttatgggggtggccattgttttaatgggcttgggcatttttaccacactcagtagggactttctgtcccccaagggatctgatctcaaggagacaattctcagaaaagctctcataaataacagtgagtcagaaccacaaaattaagatgtttttagtttcagagtaggcacctaaatgtactctacttggtttatgacaagttaagtataatctgaaactaacacaatctaaaatgtaatggcacaacaggagaactgaacatgtttgtgtttttctaaaaagaaaattaaatctttttttttcattggttcaacccaataaacaaccattaaaatgtaaa

SEQ ID NO: 210264 - DNA, 506 bp, Homo sapiens
atgatagactggattaagaaaatgtggcacatatacaccatggaatactatgcagccataaaaatgatgagttcatgtcctttttagggacatggatgaggctggaaaccatcattctcagcaaactatcgcaaggacaaaaaaccaaacaccgcatgttctcactcataggtgggaattgaacagtgagaacacatggacacaggaaggagaacatcacacaccggggcctgttgtggggtgggggtaggggggaaggatagcattaggagatatacctaatgttaaatgacgagttaatgggtgcagcacaccaacatggcacatgtatacatatgtaacatgcacgttgtgcacatgtcccctaaaacttaaagtataaaacaaaacaaaaacaggcgtgggggtggggtgtggacctgtggtctcagctacttgtggggctcgggatcacttcagctttggaggtcaaggctgcattacgccatggtcgtgccactgtattt

SEQ ID NO: 210265 - DNA, 388 bp, Homo sapiens
atgtactctgtggatttatagttgaagactgtagggagtgttattgccccgtttgtcttcaccactgatgagatgcggagggaaatgcaatcttcccatagctgagcttatgtcaaaaagaaataaaaagtgagatgtgtctgaaatcacataactcatgaagagtaaatagagttgcaaaatatgccatattctctgtttatttatctggcaagagcacctgtaagatcaggactggcagtcaaatcacacggctgtcatctcttcccatggaggggttcagaaccactgattctgccaggtctctgcaattgcactgcatggaactgggactggtcagaggatttactatttactcaaagaatctgcagttgttctactgactaca

SEQ ID NO: 210266 - DNA, 482 bp, Homo sapiens
tttgatgctggtatccatatccctccttctcatcaacaacaaaaaggatgactacttaagattctgttgtcttaaaggctttattaagttattgcccaaggattatccatctgcaaaataaaagcaattgcaatttctgcatgactgcaagaaaaatagatactattccttagtatgctattttacaagtttcttaaaggttatttgaaatttcagatggtaacaagcttggaattgtctttttcttcagctatggactgtatcaaagtttatgggctataattgtattttggtttctgccaggcatcaggatagctcatttgcatgactggtacaaaatttacttattcagtgaatcatgctcagctgctgtactgttcaatctgtaataataactgcagggtgactgactaacgataactaatcttctctcaactacaaaagcatgtaaattagtaaaataaatgtttagttgtgtatgt

SEQ ID NO: 210267 - DNA, 1549 bp, Homo sapiens
ggagcgtctctgcccggccgcccatcgtctgagatgtggggagagcctctgccccgccgccccgcctgggatgtgaggagcgcctctacccggccgcgaccccgtctgggaggtgaggagcgtctctgcccggccgccccgtctgagaagtgaggagaccctccgcctcgcagccgccccgtctgaaaaggtggctgtcaatagattggcccaaaaggaagaacaaggaaaagggcaccaaagaagataaatgaaaatacaagggtataagctgaactgtggacatcctgccactgggaattaagttaaagtagaaaaaagcagaatgtaatggggagtcccctcacaagaagaatttggatcaaagcatggcagtgaggggaagcattgagcagtgccgatttcaaatgaagactgacttgatcctgaacataacctacaagaagaaagggaccacaggctatacacaaagcatggtgccggcatctgcttctggtgagggcctcaggaagcttacaatcatcttggaaggtgaagaggaagccagcgcatcacatggcaagagagggagcaagagagaaggggacagtgccgcacactttaaaaaaaaaccttatctcacgaggcagaactaactgagtgagagttcactcatcaccaagggaatggtgctgagtcattcatgagggatccccctgccgcccccgtgatccaatcacctcccaccagaccccacctccaacactggggattacatttcaacatgagacttgggggggacaaacatccaaaccatgtcagtcttcaacccctcttcctgacatacaactcctaaaactcttagaatctccaaagtgctgtctttttatgtgttagtaattggctagtggctcacagccccttggtagcttcaggatggggcctggtcactggaaagaccaagtcataattagagggttgagactttcagcccacccccaacatctggggagaagagaagggccgaagctcaaattgatcaccaatggccagtgttttaattaatcatgtggccaggcgtggtggctcacgcctgtaatcctagcactttgggaggctgaggcaggtggatcacgaggtcaggagatggagaccatcctggctaacacggtgaaactccatctctactaaaaatacaaaaaattagctggatgcggtggcatgcgcctgtagtcccagctactcaggaggctgaagcaggagaatcacttgaacccgggaggcagaggttacagtgagccgagattacaccactgcactccagcctgggtgacagagccagactccatctcaaaaaaacaacaacaaaaaaagacaaataaaataaataaaaataatgaatcatgcctatgtaatgaagcctccataaaaacacaaaagaatagggttcagggagcctctggatagctgaatatctggaggctcctagagagtggcatgtccagagggcatggaagctctgtgcccctttttcaccctatacacctcatcatctgtatgcttggtaata

SEQ ID NO: 210268 - DNA, 1627 bp, Homo sapiens
ggagcgtctctgcccggccgcccatcgtctgagatgtggggagagcctctgccccgccgccccgcctgggatgtgaggagcgcctctacccggccgcgaccccgtctgggaggtgaggagcgtctctgcccggccgccccgtctgagaagtgaggagaccctccgcctcgcagccgccccgtctgaaaaggtggctgtcaatagattggcccaaaaggaagaacaaggaaaagggcaccaaagaagataaatgaaaatacaagggtataagctgaactgtggacatcctgccactgggaattaagttaaagtagaaaaaagcagaatgtaatggggagtcccctcacaagaagaatttggatcaaagcatggcagtgaggggaagcattgagcaggaaaccatgagaccaaaatttaaaagccagagcttcctgactccaaaatcctctttctttcctgttatcctgctgaagtgccgatttcaaatgaagactgacttgatcctgaacataacctacaagaagaaagggaccacaggctatacacaaagcatggtgccggcatctgcttctggtgagggcctcaggaagcttacaatcatcttggaaggtgaagaggaagccagcgcatcacatggcaagagagggagcaagagagaaggggacagtgccgcacactttaaaaaaaaaccttatctcacgaggcagaactaactgagtgagagttcactcatcaccaagggaatggtgctgagtcattcatgagggatccccctgccgcccccgtgatccaatcacctcccaccagaccccacctccaacactggggattacatttcaacatgagacttgggggggacaaacatccaaaccatgtcagtcttcaacccctcttcctgacatacaactcctaaaactcttagaatctccaaagtgctgtctttttatgtgttagtaattggctagtggctcacagccccttggtagcttcaggatggggcctggtcactggaaagaccaagtcataattagagggttgagactttcagcccacccccaacatctggggagaagagaagggccgaagctcaaattgatcaccaatggccagtgttttaattaatcatgtggccaggcgtggtggctcacgcctgtaatcctagcactttgggaggctgaggcaggtggatcacgaggtcaggagatggagaccatcctggctaacacggtgaaactccatctctactaaaaatacaaaaaattagctggatgcggtggcatgcgcctgtagtcccagctactcaggaggctgaagcaggagaatcacttgaacccgggaggcagaggttacagtgagccgagattacaccactgcactccagcctgggtgacagagccagactccatctcaaaaaaacaacaacaaaaaaagacaaataaaataaataaaaataatgaatcatgcctatgtaatgaagcctccataaaaacacaaaagaatagggttcagggagcctctggatagctgaatatctggaggctcctagagagtggcatgtccagagggcatggaagctctgtgcccctttttcaccctatacacctcatcatctgtatgcttggtaata

SEQ ID NO: 210269 - DNA, 2104 bp, Homo sapiens
gatgaactgccggtcttaaagggaaaggctgcaggctgcctctgacttgctcctgacctcttcacccctttcccaaccccagctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctgagtggctttgagaatcagatgagactgtgctggcgaaggccctgtgggaatgaggaacgctgtagtgtttgctggtccctgtttctgcccccaggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggaaaaaatga

SEQ ID NO: 210270 - DNA, 2143 bp, Homo sapiens
tccagtcattcggctcagtaccccggatccggcgctgccgggtctcggttcgggttcgttgccccggtgccgggaccgggccggtctctccggccgccccagccgggctcagcatccggagctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctgagtggctttgagaatcagatgagactgtgctggcgaaggccctgtgggaatgaggaacgctgtagtgtttgctggtccctgtttctgcccccaggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggaaaaaatga

SEQ ID NO: 210271 - DNA, 2223 bp, Homo sapiens
tccagtcattcggctcagtaccccggatccggcgctgccgggtctcggttcgggttcgttgccccggtgccgggaccgggccggtctctccggccgccccagccgggctcagcatccggagctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaagggtaagcagggctgccggctccagcctccgggagcaacaagggaactgattggatgcagttcctctgggcaggctggtgggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctgagtggctttgagaatcagatgagactgtgctggcgaaggccctgtgggaatgaggaacgctgtagtgtttgctggtccctgtttctgcccccaggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggaaaaaatga

SEQ ID NO: 210272 - DNA, 2570 bp, Homo sapiens
gatgaactgccggtcttaaagggaaaggctgcaggctgcctctgacttgctcctgacctcttcacccctttcccaaccccagctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctggtaggtcagctgccaggtaggaatttgttccccagggaggggaagagaaaggaaaaagtcagggaggcaggacagtgaaaacagccaaatttggtgccagccccatcacaggaggcgacttgtggcaggtggcttccgccctgtacctgggtggtctccccagtgtcctagatggagagtttagagaggcagtggggcagagtgactttcagggcatagacactggagctgcactcgctggtgtgaactctacttctctcctttactagctgtgtgaccttgaataagttacttaacctctctgggcctcagagtcctcacctttaaaatagagcaactcatatctgatggggctgtcatgcagatactgagttaatatacgtgacgtgccttgcacacagtacgtattagctgttgttatctacaacatgcacaaaagataacgtttgctcagtttactccacagagtggctttgagaatcagatgagactgtgctggcgaaggccctgtgggaatgaggaacgctgtagtgtttgctggtccctgtttctgcccccaggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggaaaaaatga

SEQ ID NO: 210273 - DNA, 1753 bp, Homo sapiens
gatgaactgccggtcttaaagggaaaggctgcaggctgcctctgacttgctcctgacctcttcacccctttcccaaccccagctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctggtaggtcagctgccaggtaggaatttgttccccagggaggggaagagaaaggaaaaagtcagggaggcaggacagtgaaaacagccaaatttggtgccagccccatcacaggaggcgacttgtggcaggtggcttccgccctgtacctgggtggtctccccagtgtcctagatggagagtttagagaggcagtggggcagagtgactttcagggcatagacactggagctgcactcgctggtgtgaactctacttctctcctttactagctgtgtgaccttgaataagttacttaacctctctgggcctcagagtcctcacctttaaaatagagcaactcatatctgatggggctgtcatgcagatactgagttaatatacgtgacgtgccttgcacacagtacgtattagctgttgttatctacaacatgcacaaaagataacgtttgctcagtttactccacagagtggctttgagaatcagatgagactgtgctggcgaaggccctgtgggaatgaggaacgctgtagtgtttgctggtccctgtttctgcccccaggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgaggtgggctggggagggtctgggctgagtgctgagtgatgcagaatgctggggtggacggaggcaggacccttagattttggggatgaaataaaaagcagacaggcgcttgaagggcacattcatgccg

SEQ ID NO: 210274 - DNA, 1973 bp, Homo sapiens
  misc_feature (1)..(2): n is a, c, g, or t
nncacgggccgggccctgctacctcagggggagcgaccacgctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctgccaggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggaaaaaatga

SEQ ID NO: 210275 - DNA, 2063 bp, Homo sapiens
  misc_feature (1)..(2): n is a, c, g, or t
nncacgggccgggccctgctacctcagggggagcgaccacgctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctgagtggctttgagaatcagatgagactgtgctggcgaaggccctgtgggaatgaggaacgctgtagtgtttgctggtccctgtttctgcccccaggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggaaaaaatga

SEQ ID NO: 210276 - DNA, 2244 bp, Homo sapiens
tccagtcattcggctcagtaccccggatccggcgctgccgggtctcggttcgggttcgttgccccggtgccgggaccgggccggtctctccggccgccccagccgggctcagcatccggagctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctggtgaggtcctgggaggggcgaggctgtgaagtggtggggatggcttcaggggctgagctctggcatggggagaccatgccttgtcctcttttctgagctagtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctgagtggctttgagaatcagatgagactgtgctggcgaaggccctgtgggaatgaggaacgctgtagtgtttgctggtccctgtttctgcccccaggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggaaaaaatga

SEQ ID NO: 210277 - DNA, 1604 bp, Homo sapiens
gatgaactgccggtcttaaagggaaaggctgcaggctgcctctgacttgctcctgacctcttcacccctttcccaaccccagctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctggtaggtcagctgccaggtaggaatttgttccccagggaggggaagagaaaggaaaaagtcagggaggcaggacagtgaaaacagccaaatttggtgccagccccatcacaggaggcgacttgtggcaggtggcttccgccctgtacctgggtggtctccccagtgtcctagatggagagtttagagaggcagtggggcagagtgactttcagggcatagacactggagctgcactcgctggtgtgaactctacttctctcctttactagctgtgtgaccttgaataagttacttaacctctctgggcctcagagtcctcacctttaaaatagagcaactcatatctgatggggctgtcatgcagatactgagttaatatacgtgacgtgccttgcacacagtacgtattagctgttgttatctacaacatgcacaaaagataacgtttgctcagtttactccacagagtggctttgagaatcagatgagactgtgctggcgaaggccctgtgggaatgaggaacgctgtagtgtttgctggtccctgtttctgcccctgccccttatgtttacgtttgcagcctgaagcactttaatttttttttttttggtctgttcctgtaacttattttccaactattgcttccaactgaaataagactattaaatgcctgttcaggagggaaaaaatga

SEQ ID NO: 210278 - DNA, 153 bp, Homo sapiens
atggttgcgtagcaatgtgaacgtactgaatgccactgcacacttgaaagtggctaatatagtcaagtttacatgtattttaccataataaaaatggtgaactgtcattatcttgcattgttgatgcttttgttcaaatcctgggaaatatga

SEQ ID NO: 210279 - DNA, 417 bp, Homo sapiens
tgggccaggctcgtctcaaattcttgacctcaggtgatcctcctgcctcggccccccgaacatgctgggattacaggcatgagccaccacacctagccgagtttgtgtgttttttaaagaaagacaggattttaaatttttattggaaacctcctggggcacctcatctttgggaatttttgcttcaaataataaagattatatatcgtttcttacttggttttaattgggttgttaattgtagccttgagttttgctgttttgggtacttttgcaccctctgcagtggtcttgtgttttgttattagtatgtctttttggaagaaattgagaagccttatttattagagtcttttaatcttagttctctcagttgtttccccaaagctcaaaggagatgaggaagtgctactatca

SEQ ID NO: 210280 - DNA, 722 bp, Homo sapiens
cagcgcataaatattttgtccatgtactaaacacgcgtactacaaacaccattagcctgcgccaccgtacttcacgcacgaaattacggggatctcgacaggtgtttgactgtctgggatttatgcctcaagctaaggatatacctagcggagtcctctgacatcgaccacatgactccactgcactctgctgcgtacatacttaccctcccgtgatccctggtcattatgcgtttaagtggctattaggcccctgtggggaagaaatgagagaagagaatgaatctgaccaatgtgtggggacccgtggaaggtctgtgttgagaaggacacccaagagcatcttaccctagccctgcatgtcgtgggaggaggcccacatacggcaggtgacatgcctggcaccacacggcacattaggggcagtgccagcaaaacaaaatggtccagattattggtagtagctgtagtttgagatggtctcactctgtcatccaggctggagtgcagtggcacgatcatagttcactgcagcctccacctcccgggctcaggcgatcatcttgccttagccttctgagtagctgggactacaggcacgcaccacatccacctaattttttaattatatttttcttagagacagggtcttgctatgttgcccaggctagccttgaactcctggcctcaagcaatcctcccgtcttgacctcccaaagtgc

SEQ ID NO: 210281 - DNA, 524 bp, Homo sapiens
gactgtaagcttccatttctggtgagttagttctgtttgggcttgcatgtgattttctcacaattctatgagctgagcgcctatttttcactatgtgagtctcaaacttttcctctttcctgcaattagggcatcaccatatcctctccagaaaaaggccttctcacacaaattttgtgtgtagcaaatttctctgaatcattggagctagggaggaaggtgctggaaggaaagagaaggatacatatcagagcacagcattaagtaataattgttcttagaaatcctttggcatcttcatctccaagactttcttcactagctattttttttataatccaaaattatgtctaactttttttctcttcctcagaccaacttcttccatccccttacgagatatgcacacgttgtttacattgtagacatatagcatttatctcttctttctcttgtgtcattagttttcttccttcaatgaattattctcatcagtacactaatattctgtgatttttccagtt

SEQ ID NO: 210282 - DNA, 237 bp, Homo sapiens
ctcttcagagaaaagttattcagagtccatcaggaaaatctgacactgcctagctcttaagggatctcacaggggaagtcacaccgtctgttagcactaagtgttcaagtaaaggtgtgtaaaagaggtgccgctgatgggagaagatgcgcgcatcttctcacatcagaatatacaacaggtagtgataagtgctatgaaaataatgcacttataaaaagaatacagacatgacag

SEQ ID NO: 210283 - DNA, 519 bp, Homo sapiens
tgcactgttctcatctcctcttcctctcccctttgacaagcctgagagcaatcactgcatccgattgagcactttgaacagccaggttcaaagtcctgggggagactcagtagggatactttcaaaccacccactagaatggattcattactctttttacttagcctatagattttctttgattttctgtccataatgaaatgtatgtcctctttccagaatcctagggaatgccaaagtctttgaaataaaaagccttctctgttggctagcttcagagggaggcatacaatgcctctctaagcaatttgttgccaaaagtttcttatctatgaagcaactatgagtcaggagagctgggctcagggttagtttagccttcagatgactgcaggaatctaggagaatggcatgaccctttgggacctcatctgtaaaccaactgtttttaacatttaatggacctcacactactttgaaaatttgatgaaaggtataataaacctttatctccccaga

SEQ ID NO: 210284 - DNA, 277 bp, Homo sapiens
taatcctctcagctttcactggcacttcctttttttcttgtgacagagaaaaaaaaaaacctgtcccatctgatccaataccgtcttacgcagcccctccaaaaaagcagcactccacctgttactgcgtttctcctgcgtgttcagcgttctcctcctcactttccctttttaaatgttgtctttaaaaaacaaaataacaaccttttcttgacaaaaacaactcacttaaactaccacccaacctacaacctttcttttataactaagcttcttg

SEQ ID NO: 210285 - DNA, 230 bp, Homo sapiens
agaggaggagggagagagggatagggagagagagatcgagggagggagagagagaaacaagtaaaagaggaaagaaaagagagaaaacaagaaaaggatagagaataaaggaagaaaagtaaagagaagcggaacttggaagggaaggagacagagagaagagaaggggagggagagcagcttgacaggtcagctcctgcagagtttctctggctgtcctccaaaagatg

SEQ ID NO: 210286 - DNA, 714 bp, Homo sapiens
aaaatctgtggataatgtataataagctgatgtacatcctactagaactgaggtatttcagtttgtgacaaattatgtcttaacatgttacctcgttaatagtcattggttcataaatgctggggattttaaatttaactctttttatacctaatattaaaaattaacccaatttaacattatttcatctaccacattactggccttgttttgattctaaatctcatgtcctaatttacaaattaccaaattaattcaaatgtataacctctttatgatttgaggcccactctggaaaagaaaaatactagacatttctattaaagtcatgagtgatttttatgtgtcttgtggatccatcccccagagtcttgtcttatatctttatgttctaacaatgaagtttttttaacgtacttttagcaaaatatacatatatttacacaagtattttagagttacctacagtaggatttagaggtcttttattcccatgattatataacattaaacaatatgtagcccccaaataaatttttctgtgggaacttcttcacgttgtctgcacatgacagttgatcttgggttgtttcagtactttccttggttttcctcctgtgtctttagccattccctagaagtcccctttttctctcccttacaactgatggtctctatgagtccacttttagctcccttctcttcttctatact

SEQ ID NO: 210287 - DNA, 584 bp, Homo sapiens
caggatgtgttcgctgtctcatttaatgtctttccaggcctgatactttaaaaggactcaccttcttccgataaaagttcttttcttttctcatagatgtaaagccactagttttgcagagttcacgaggattagaagtagtataagtaagatagaccaatgctcagcagacggaaggtgtgagaaatactagatgttatattagaggatgaatatcctcaacagtgcacacctcaacattcagtacacagccagcattatttgtatgtattcttggtaccaagaagagccaaagaataatatgtaggaggacaagggtcctccttgccaagctttttacatgcgctgcttagaaaagccagattttgataatggggaaagggagagagtcagcggctctgtcacaataactcagtctgataggcagtcttgcctaagtgaaaaaccaaactgcttctttgcttatagtacaagaaaattttggccaagggcattctactgcatgggatctggccaaaattgttctttgtaaatgctgtactcaaacaatggcataagtaaatctcatcaaattgtttttaaaa

SEQ ID NO: 210288 - DNA, 195 bp, Homo sapiens
tgttcccagcaggtgtttcctgccaggacaagatgagctgagtggcagagctaaccctgacactgagttgagggttcgctggtcccatctgacattgaaattgatgggactagccatcaaaaaactccaggggccacgggacctcttcctatatcatgaccgcagacctaacatatttaaccattaagtaagaga

SEQ ID NO: 210289 - DNA, 667 bp, Homo sapiens
gggtgatgctgggcaatcacttcctaaggtccctagcctcagtttcctcatctgtaacacggggtggtatgtcacaacattgtcagggtattgtgacagtcccatccacgaagctgtagtggggcctggctcgacactcggcacattccaaatggcatcggagatctggcagaggcccctcctggctgaagccaaatgtgggtcgcaggagccccaccgttcagggagtcagaccagtcaggacgccatcccagctctgcccaactctcagcctgacctctcgcaagcctttccctttcctggccctccaccttcccttcttgaaaatgggcacagtggcccctaaggaccggtccagcttggacattcccactggggcgaggtgggccacagggagttcatagcccttgtttttgtagttctatttcctacctgtgggacctcctgaggggggatgggctaatcaaaacttctctacactggcagggcgtggtggctcactcctgtaatcccagcactttgggaggccatggcaggtggatcacctgaggtcaggagttcaagaccagcctggccaacatggtgaaagcctgtctctaatacaaaaattagctgggcatggtggtgggtgcctgtaatcccacctactcctgaggctgaggcagga

SEQ ID NO: 210290 - DNA, 506 bp, Homo sapiens
ttgtaggtacagattgccttgtttaaataaaggaatcattttttctttaatagaacctaattttttaaaagcacatttaagttgtgcagttgtgatttgaaataataacaaaaagtgattacacctaaaagttctaaactggtacaatattatcatgccattagctgtgatggagctgaaagctgatagaacttacacttgtatctcatgactctgtttcctttgaagtaagcactggtggctgaccgagtttaatgtcccagctttttggatctctaagaggattacagtgtaattttataacctgccacaaattcctctctatgcaacttactatgtgctatgtatgtgtttttaaaaaaatcaactggagcatgtgcctgtagtcccacctacttgggaggctgactcaggagaatcatttgagcccaggaggcgggaggttgcagtgggctgagatcacaccactgtactccagcctatgggacagggagagattccatctt

SEQ ID NO: 210291 - DNA, 196 bp, Homo sapiens
tcagtctgattcgagtatatctgttttggcaagttgtgggcagctctcttttacttttgtcacccagaggcttccgtagacaaaaggaaaggagagaggtgtgttcaaagacccccatggcgaagagcccatcccccaagcctgacacaaccctccctcccagcggacccctcttctggactggcttcgctgttgg

SEQ ID NO: 210292 - DNA, 788 bp, Homo sapiens
ctttaggcgtgtgtgatttgcaaaacattctgtggcctattttcctacctcacacactaaaatcattcaataattaaatggaaatatcaataaggagtaggtaaatcttccaagtaaatgtatataaacctgtttataaactctttgaaatcaaatccagaccatttacatcagaaattagttttcaaactaatattcccaaattaactaacttcacctaggttgtgagtattgcagcgtcttatttctaatcccagtactactattggtgtgagtcagtaaagatgcctggtgactggggtgtgaacttataaatggcacatttggtatcacatcaataaaacattttcttgagaagaatataattttagtagaattttctccaaatggacgtatcagctgttaagcaaataaaaatgtcatacatagtaaaagctttcagttatcggcaaatgtccatgtaattctacaattcactgtcacatctaaccatatagcttttacttactgtgtttacaaacaaaaaaatgctgttttttactgataagtatttcagtaagtataagtacttattcctgattaggatgagatttacttcatgttagggttttattacttttgtgggtgggaaagactatataatctgccattccttactctgtgtcattctggtcaagatgatttatccggggatcatggaaattacttttggaaaatcatttttgggaagagttcccgttgttataaccggttagaatgacgataaggggacatattaccggacagat

SEQ ID NO: 210293 - DNA, 419 bp, Homo sapiens
aatctaaactcaatctagcctatacttgacatttgtaaattatttaaaaattaatatttttcttctttcctgttttcatggaggctgcttcttcctctttgaccatgccaaaagcaaaatagtaaaagagttcatatatcctacctctgctcagagcaagatctcatcttagtccacagtcctacctgccatcttttgggattcagttgacaagttgcttggtgttgcattcttggtgtccttgccgggtcttttgtttttgtttttgatgtgttgtgacacaagagtcctgttgttggtagaagagtggttagctgaacagattatgttgctcagaaaatcctatggttataagagagggtaaggatagatcataagtggaaacatgctgaaatctattaaaccatctttgtttgtga

SEQ ID NO: 210294 - DNA, 434 bp, Homo sapiens
tctgcaatattgaacaattatatttttaaacacttttatttcaagatttgatattaattataatttatttggcttttattttactaggcaattttgaatttattttaatatctttaaatgtgaaaaatcattttaagttttacttttatttttatttagatttttattaaaatgttgaaattctatatcctttgaataaaactattttatttctaaaaaattccttagatcaataatgtctcatccattttcatgttaggacagtcctgaaaggactccaaatccgttcttccctcctccccgaccaattcatcctccccactgctgcttcagtcattctttctttcttttttctttttctttttttttccagacggagtctcgctctttcacccaggctggagtgcagtggcgtgatcttggctcactgcaac

SEQ ID NO: 210295 - DNA, 387 bp, Homo sapiens
actcaattgtacgtccccaagctgagcagtgagattctgattcaggcattcagtattgggaccaagggagagttaagttagtcttttccaacatgcaaaagctgtagggcttgaagcagagaaagtcaattcacagagaaaatgaaacataatttctgttctttctgctagtgtggggagaggaagagggatctcagttacttcaggactttcatgattcttactctacttcttcctgaagctacaccgtgatcctgccctttgttctagaaataaccacctccgtcagctacctagagttagtttctgatactgcagttactatttttcatcaaaagatgatgtttgttttgttgttgttgttgttttgggtgagaaccattaaga

SEQ ID NO: 210296 - DNA, 237 bp, Homo sapiens
acctcgcttagtgctccttggcctcgcttaggcctcctgggcagggggagctgtcctagttcctcaaaaccaatttgcctgaaagcatattggattactcactttacagtaatccgtgcgtgagagacaggggcggtctcttttgagttgtctgtgactttttagatgcctttttcctatttgtctgcttttgggcattttgaggatttttagccaggttgtctaaagcagttcttc

SEQ ID NO: 210297 - DNA, 324 bp, Homo sapiens
gtatgatctaatggtaagaaactggaagaaacatagcaagtcatttgttcagattcttctctgtgtccctgtgtctccagagataaggatgtcctttttctccaggtatagagtgggtacctctagaaagagggtcttatgacctgcttccagggaaggtcagagaatccttcctaagttttatgacctgtttctgggaagaagtgcaggaggaaagtgagtgagactttcctgcttctgctgttttctcaaacatcaagatgccatattttggagtagcatgtcttaaacctcatcacccgtctcaggtgcagtttcatcgcc

SEQ ID NO: 210298 - DNA, 357 bp, Homo sapiens
catctttagtagagacacattgtcgccatgttggccaggctggtctcgaactcctaacctcaggtgatccacccacctcagcctcccaaagtgctgggattacaggtgtgagccactgcacctggcctaatcccttattttctaaggtgagagatattttaccaagccagtcttgtctggggagggatatttctaagggattaaaggacagccatctaagtcttggctataacaagggtcatcaagtgaggccctgtcagcaatatgaaagttaagagctgagttttgtgccctgtaattttctaatagctccacagcgtatgtgctatgtatatttggtaaagcactccttaacta

SEQ ID NO: 210299 - DNA, 532 bp, Homo sapiens
cctttgcagggacatggatggagctggaagtcattgtcctcagtaaactaacacaggaacagaaaatcaaacaccacacgttcttgtaagtgggagctaaacaatgagaacacatagacacagggaggggaacaacatacactgggtcctgttgtgggggcagaaggaggggagaatatcaggataaatagctaatgcctgtggggcttactacctaggtgatgagttgataggtgcagcaaactaccatggcacacttttacctatgtaacaaacctgcacatcctgcacatgtatcctggaacttaaaattaaattaatttataccaaaatagtaattctaaatagattctacctcccccaaagaagatttagtcttgagaatacaatgtatttatggcctaaaataaaatatttaatatttaaatatattttgtagttgcatacctatgttttcacaaagtgtaaagatatttaaatattccactcaaaaaatctaaatgtgactgtaaacgcatgtacatttcaaatt

SEQ ID NO: 210300 - DNA, 369 bp, Homo sapiens
ctcatgcctgtaattctaccactttgggaggctgaggcgagaggattatttgagctcaggagttcaagaccagccagggcaacatagcgagacactctctctataagaaacacaaacaaaaaaaatgttaaggcatagcactgtagacttgagtgtgaattagaaatatcgctgtcaagtcatgaaatgttttttaccttcaaaatatattctctagttctgtttactaaaatagcccccatatattgacaagtctaccaagtaacatagggcatccctggagcccagcttgtgataaagaaattacacttttcactaaaagaaaaccagagcttcttggataaatgactgattccaaacctgtggcaa

SEQ ID NO: 210301 - DNA, 344 bp, Homo sapiens
gcatcccaccccggcctcgccgcccgacgcgggtcccgaaaggcaggtgcgagcggcgaggccgacgcccgcggcgggtcctgcccagccgcacctgcaggcgcccaaacttgggcacagtgggtcgcaggcggcaaggtcccctccccgggcggcgcaggagccggcacttacacggagagcggtatctgctgctccgagcgcaccacgtcccccagcgcggcgtagagaagcgcggcagcgagaagcgccgaggccccccgggacgcgcggcgcggcgagcccggcccggccatgctgggctccctccgacgcgcccgctgcggcggcgacgagagcggccg

SEQ ID NO: 210302 - DNA, 270 bp, Homo sapiens
cgccttttaaataccaacagaagctaacacattctcacttatttttaaagcacacactaataatatctctggattcatttacatttgagtctccttgtaactaaactcacaaatctgttaaacagctatcaagaaaaaagagtatagtttgtgctcatggaacaaatttaagctgctaatgctcatcactttagcctgtatccaacatgtgaaaccacaggtgattccaaaaataaaatattaaaatgtaagttcagtttaacataatca

SEQ ID NO: 210303 - DNA, 341 bp, Homo sapiens
taccggagggtctctgcactgtactagaaaggcatcacctctgaaatccgacatcccagtgtccattctggggcacagcttcccctcctttcaagtctctctcttcctccctctccacaacacagaggcctttagctccccagcccttactgttcagtgcgtccacccctccttgtctagaccctgaagtatattacatcagctactctcttgtgagctcctccagtactctgccccttgtccttctattgccctagtctagggaaatcccgaacttgggatcaacccatacatcctctttttctacctttacagctgggctcctgagcactgctggaggt

SEQ ID NO: 210304 - DNA, 468 bp, Homo sapiens
ccttagtacatatttattacaattaacttatataatttctccatctatgcatatattttatttgggcaaagtggctggccctgacttttacctggtgatttcagatgggtaacatccaaatggtgaaattataaatgtaattatcacaataaatagtttcagatttccctgcacttaacatttatacattagattttgttaaagaaatcagttacttttactttatagtagtgacatctcattggtctctaactaccctccctcatacctgactagtgtcatttgtcatcgtgtcctgctcgccagtctcatcctccccactagagtgggagcttctgagtgcacagggtccaagtgctcgtcctacagccgccacagtgctcagtgaattagggaaaagttttgctcccgaaagctcataacttggtttcagttttaataaatgactatataaagttttgtgataaa

SEQ ID NO: 210305 - DNA, 505 bp, Homo sapiens
actaaactacacccccatgtctcctaaacaaagaacccatgatctaatccagaatcacatgttagtttagttgtcacaagtctctactctccttcagtgtgccatgggatctgtgtttcctggtcttttcatggtttttacatctttggcggagttaaggccagttattttgtctaatgtccctcagtttgtgtttgatactttctcatgattagactcagattagacagttttgatggcaatacagaggagatgccattttcttgctgcatcacatcaggtggtacttaatgtcagcttgtaccattactactgatgttaactgatcacttggttaagatggtatttttcaggttcgtcacctttcctcattagacttcaccccctagttttggcattgattgttgcctgagtcagtttttacaacattggttgccaaatgtgatttcctaattatagcatttgttctacagttattagtatttggccttgtagtgttaggtag

SEQ ID NO: 210306 - DNA, 353 bp, Homo sapiens
cactccagctggcttctgagtgtttgtccctcacataggattcctgaagactgctgctgtcgctatagtcgttgagagtgtctgaatgtttgaccttcaccaaacaccaaatattctggccctttagtcttgtactttccagcctccagatctgtgaacaataatctctgttgtttatgaattactcagtctgaagtattttgtaatagtagcctaaagagactaagagagcatcacctgccctgtcacctcatcacctcattactgaagctatactaacagcagtcacttttagtgggtacttcatgcatcagaataaagggaaaaaattgcaaggcatactaaaatccaaa

SEQ ID NO: 210307 - DNA, 585 bp, Homo sapiens
ccggcaaataccgaatagctgtcgttgtagatcatgtacccagcccgcccccacagcatcaccatcggcacgggtgaggcgagcatgcgtggccagaagctggtctcgaactcctggcctcaaatgatctgcctgccttggccttccaaagtgctgggattacaagcgtgagccaccacaccaggcctttacctctttttaattggctatcattgtttatagcattgtcacagaatgaactgaaaatctatccattgtagagccaaacatcagtaatatactatgattgcatttccttgttcactgcttcctgttttcacttgtgtaattttctgaacacatgtgtaccgagggtgatactttgcttaattaagcctggttcccgggaagcctctccctctgcttctccagtgagactcgctcttccccatgtctgttgctgaattctggaatctctgcttcttccttgctttagcttctgaagagacagaggagttgtctgcattctttcatgtcttaaaatggattacatacagtattactgtttgtcttgcgtgccagaaggagggatactctagatcacca

SEQ ID NO: 210308 - DNA, 476 bp, Homo sapiens
tctttggggaagtggagaaggaatgttaacatgtcgtgatttgcagtggcaaaacctgggacactgaggcctgaggggtcgcagagctcccaggggttagagcaggcaagagcccagtccctcctgagcaggaggtggaggggaagtgtgccagctcccagtcagcaggtctgggtccagtaccgcctgtctgcttgatgtctgtgggtaagtagctgtgccctgctgctatctgtagactggggatacccctgcaaccccctgaggctgtggtgaggatagatggaggtaaagcgtgggagaactgcctaggacatggccacacatggccaaataatgatgatgttcccgcataatccgacaaaccgctgcatgactctggacctcagtttccccagctataaagtgggataggttaggatcgaggggctcatttcagatgctacaactttagtgtcagagccaggagagagaat

SEQ ID NO: 210309 - DNA, 461 bp, Homo sapiens
gcagagagactagtcgggagactactgcagtaatacaggtaaaagatgatggtgtccatttccaggtagtagcagtggacacggtgaaaagtgattggatttgggatctaatagagccaataaaatctcctagttggatttagatgggaaacaagagaggaggaaacttgactccaaggttttgggccttccaagaaactagaaggatggagttgccttgagatgagaagactgtaggaggaatagttttgagtgggaagatcaggatctcggttttgggtgtgttaatgttccgatgcctatttgacatgggtctttcaaatagagcagatggatatacaaatttggagtttggggaagaagactggacttgagatacaaatttaggtcatcagatggtgtttaaactgagtgagacaggatttaaatccaatgagactgggtaagtgagtgtaactaga

SEQ ID NO: 210310 - DNA, 480 bp, Homo sapiens
aaaaaagcaaagcaggacaaccacccactcaggaacgacacagggccagaggagcctcccccacccagggaagtggtgctggaaaatccgaggtgactggggaccagagcaggcccctagtttactggagtagtcatggaaaagtggccagactgtttcttacatgggtctccactcccatatctcctcactgggcaagtcctccaggcttgggtttccagcctcccttcactgggactttggagccagtagcagctctgcagcaacctgggacagagctcccactgggagggtggtgtttccatcttttctgccttgcagccctcacctttgctgtttccaggctctggagagtccatgggactgaagcctggtctgaaccccaagcacagtacccatctcaccaaaaagtggtcagacggttctccatgtagatcctggtcctcacttctcctcactggacagggctgcctgacctgg

SEQ ID NO: 210311 - DNA, 348 bp, Homo sapiens
tgccaatatgaaaatggggaagaagtctcagagagagtattccagctaggttttgaagccaaagtagaagtttgctgagcatgacagaaagagagagaaacaggtatacatcctaatcaagaggaccaggaattgtgaggagcttaaggtacaaatgagtggctggagatgaagttgcagaggtatgctgggagctgtggatggctccactatgggttctgaactgggtaaggcactgggagccagggtccccaaaacacgcacgaaacaactggtggtggtctcccacactcagagattacttaaatattactggatacaatctgtaaaatttatgacgttccaaag

SEQ ID NO: 210312 - DNA, 605 bp, Homo sapiens
tgaaggtaagcacctctccactttctcctgaatcttgagagcttgctttgacctagggtatctgtggaatgaaacaatgactgctaaagcttttacctgtagctcaaggcagagaggccttagacaaaccactcagtgggatccaaggcatgatgatagaagaggtggccatattaccacctgccagaagcaatctgggccttttggctaagataaagtatagcagcttagtggcctagaatctcccactccatcccatgagttattcacccaggtaagacaataaggttgacagaatccttaaggttcatccttttggcctcctttgttttgcattatttcattggccaagcccatcacctggagctttgcagtggctccacagttgtttgtttaatggatacataagtgcatgaacaagtgaacacaattgtcacttgggagaagaggtttcttagcagccagtaaacgattagcttggacttttatgacttattatcctggggtatctcagctatcaccagcaggtttaacaaaaaacttataagcaggaaagctggcaacaatagcagttaccacgcggtgctgagagtgacacaagcatt

SEQ ID NO: 210313 - DNA, 201 bp, Homo sapiens
cacgctgctcacactgacaaacaataccaagtactatttaattattatgcagtattgctatctatatagcaatatatatatgctatatatatatttgttaaattgctcatagattatatcctcctacagctattcttctgcaacttacagcttttcaagtctgttttgcaaacatgtccatgttgatacatgtagatctag

SEQ ID NO: 210314 - DNA, 468 bp, Homo sapiens
ccctaccacatgctcaacatggtattgagtcctcaagaatataaaaagaaaatacaacaggaaccagtagtcattaactgtttgttctggactttaataaaagtacagagggtcttggagtacaaaggcaaagacatttagctgtgtatagaatgggtgggggaatgtgttccatggtttggcattcagttcagcaacattcctgagagaaatcaactagcccccttatagagaagaggaaactgagatttaaaaagtggtcctggccgggtgtagtggctcacgcctgtaatcccagcactttgggaggccaagacaggtgaatcacgaggtcaggagttcaagaccagcctgaccaacatggtgaaaccccatctctactatacaagtgtccaggcatggtggcgagtgcctgtaatcccagctactcaggacactgaggcaagagaaccacttgaacctggcagg

SEQ ID NO: 210315 - DNA, 212 bp, Homo sapiens
ggctgggggatcatctcagaccacatagtgtctggcctggtacacctctgataatcaggaagtgagagcctgctttgggttggattcttcttccttgctgtcctgtgagtactctggttggagatgggtttgtgtacatcttgtcaacaggttccacccactgtggaccttgacctccagctggtctctgctaacagaatgagaaacctgtg

SEQ ID NO: 210316 - DNA, 884 bp, Homo sapiens
gtaactattcatctactcgtgagttaggtatatctacctacttaaactaagaatagatagataatagataatgtacagctgtatattggaatgacttggatttaaatcttagctggaaaatcagttcattaatttgagcttctgattttctttgatgtatgggaaatgctttataaattaaaaagtatacaggtagatttgattattattaataatttggagcctgtgagctttcaattttttttagaacttctgaggcaaagagcttttctttatgatagttgctagtcacactacatgtgaatacacagttgaacagtggtctttgtctatgacatcctgttagcagtagttcttacccagattcccatataccacaggaccagttatatctttttcccccagttacaactgtattgaggacaaatcagttatgatttagttatttctagaagcaaacgttgctttagacaaaaaaggagttatttagcatcgtatgagagagaattatgtttcaactttggcagatgagactctaggcctttatttcagtatctgagatgcaaaaaatattgagtacgtgacataaaatttgacaaaactagatattagcatgtgaaataacaatatgtggatctgtttgcaaataaatgacctaatggaaatgaaaagagaaaacattaagtaactaaagagcagtgaccatggtgtctactgattctttaggtattctatgtgttgggccactatatagtcttgttgagaaggcaggtttggttccttaattaacagagagggaaaaatcacttttctagcgtactttgtttttattaagaggttttttttttttaaaggtaataaactaagaatggacaaagcagaga

SEQ ID NO: 210317 - DNA, 353 bp, Homo sapiens
ttcaacacccaaataagagaaagagaaaagggaggcccaggtagaatctgtggttaaggttaaacctgcaaaaggtaagcctgcaaagaccgccctgttccaggctgcctttttttttttttttttttttttttttttttttgggggccccccccccccccccggggggggggggggggaataaccccgggggccccccccctttgggggtttttgggggcaaaaatttcccccccccctttttttttggggggggggggcttttttggttgccccccagggggggggttttttggggtttttttttttttttttttttttaaggggcccccccccattttttttgggggtgg

SEQ ID NO: 210318 - DNA, 422 bp, Homo sapiens
aagaggtgccctcagattcccctatttagattctgtgaaccagtgataagtctcctcttctgtgtgattggtgttgcccttttgggatgtagacattttggactaaggatttagagatttttttaccgagacaggattgtatgcgtactaagatgtccttaaagctggtactttccccttttatcactaatggctgctatttccagagctgtgggctttatctgaccatcttgcaggtatgttgaaagatttgactagcacttaaaaggtatgttcagaaaatgctattttaagtgtttcttctttaccctatttcccccttgttgaacagtgcaaaactaccaggttttatgttccactgggcagctgctgctggtctgatgtatttctctctgtccctcctcctccttctgtctcccctc

SEQ ID NO: 210319 - DNA, 455 bp, Homo sapiens
ccgctgctttaatacttttagaggccctcaaaataagtagaggcctttcctacagggcctgagaaggccaccgcagtcatttcttccgttctgtcagacataattcctcagtttagccttcccacctcaatacagtctgataactgtatttattagtcaaatcagccaagcagtttttcaggctcttagtattcagtgaaacctttatatcccttacggtcctccatcttcaagaaaagtagaatggactaaaggtcttttaaaaacatatctcaccaagctcagccaccaacttaaaaaggactggacaatacttttaccactttcccttctcagaattcaggcctgtccttggaatgctacagggtacagcccatttaaggtcctgtatagacgctcctttttattaggccccagtctcattccagacaccagaccaacttagactgcgcctc

SEQ ID NO: 210320 - DNA, 428 bp, Homo sapiens
tccattgtctgtgtagtgacctctgctcaaaatttccctgtgtcctgggccctcttcgtcctctgttagcctctttcagtccccttttagcaaatgcttctgagccactgttaggactcagacacgcacaggctgggtattcaggtttctgtgattgccctcaggcttatctacctagattttccttagctgttgccagtttccacccaggcatctcattgctccagcccctgattgagctgcagtcttgtgatgttttgcctgggaagtaacaaaagccctctttcccctaaaggtagttggatggcatgctttctaaaccctatagttcagtcagtaaatgctacgttctaggcctccatgacttgttttgtgatttttccaaaccagtgctttttggaacttaaaaagataaacaatttctttca

SEQ ID NO: 210321 - DNA, 1240 bp, Homo sapiens
cacttattgtgcactttattcctattattattacattgtaatatataatgaaataattacatgactcaccataatgtatggtgaaggaagccctgagcttgttttcctgcaactagatggtcccatctgggggtgatgggagacagtgacagatcatcagacgttagattctcataaggaatgtacagcctagatcacttgcttgcacagctcacaatagggttcatactcctggaatcctagaatcctagaatccctactcctagaatcctagaattagagaatctaatgccactgttgatctgacaggagatggagctcaggtggtaatgcaagcaatagtgagcggctgtaaatacagatgaagcttcactcgcttgcaagccactcacctcctgctgtgcaacccaatttctagcaggccatggtctatggcctggggattgaagacccctgctccaagacttacctcccactgagaactcaggcaggatgcttggaggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccagcccagagtcaaccccaacgctgcagcagaagcggaagcccagccgcggcagccgcgagtgggagaggaaccagaacctcatcaatgcctgcacagaaggacatgccccccatgggggtcccctgtgattcccaaggaacttgcccctgcggggcctccccaggcacatccccagcgtggtggtccctgcccatcacgccagacaggattaccaggctggagtaccgttggaacaaggccaaaagagcgagggggggccaaaatgggctgaaggacaggccggcacacggatataaaacctcaaggaactttaagcacaaaaggccaaccagggggaaacttggggaaactgaacagtggcca

SEQ ID NO: 210322 - DNA, 389 bp, Homo sapiens
gcaggagaagaccctgcctgaacccagctatgtggagaggcccacgggatggaggttgaggtggagcatgagctgcccctgagcagacagaacaacacaaaggggctgggaattgagagtggcggtgcccacagggagcccacaggcaggaagacccaggctggaggatcagggcccccacggaggaagactttggactaaaagtcacaagaccttgcttttagtgccagctttgtcactaactggcaatttaccgtaatgaaatcaccgatactggcccaaccttcatttcttcatctgtaaaacatattgccagggacgaagtttgcaatttcgttgacttcaaaaggtggctgtgggaataaactaagatactggaagagaaatgg

SEQ ID NO: 210323 - DNA, 563 bp, Homo sapiens
caggaaaatgtgactaacaatgaagataaaatatatatcaatcaaagctgacctagaactaattcagatgttggatttggcagacgtattattataggtgtattccatatgttcaaaaagttaagtagagacatggaagatattaaaaaaaaacacaaatcaagcttctggagatgaaaactacaatgtgtgagatgaaaaatacactcaatggaattatcagcagattagacatcgcagaagaaaaggttggtgaacttgaagacatagcaatagaaactatccaaaatgaaacacagagagaaagagaatttttaaaaattaacagagcatcagtgagttcttggacaatttcaagcagcataatatatgtgtgctttcagtttctgaaagaaggaggcagaaaaacaaattgaagaaataatggccaacatttccccaaatttcattaaaactataaagctacagatccaggaagctcaatgaacccaagcacaagaaacgaagataatcacaccaaggcacatcattgacaaattgctcaaaaccagtgataatgagaa

SEQ ID NO: 210324 - DNA, 460 bp, Homo sapiens
agaagaaaatccatcttttccattcttcctgccttaaaaaagacctgatatgtcaagtgaacagtacttctacacccttctcctctccagcctcaggttaatttaaaaagtcactcaagtttgaaaaggacacaaaaactataaccaaaggcaaactcatgattctttcaacaagtacttattgagggcttctaatatgccaggcactgttctaggtgctatagatacagcagggaataaaacaaagacctctgccctcaaggagttcatatgcagccaacagctcatcaggcagtgaaaggtgctgctgagcccaagggtgcagggatgggagggggtgatgtacctgaagtggtcagggaaagtctccctaacagggccatctgagcagaggcccgaggaatggggagcaaagcacaccatatctgcggggggagagcatcctctaaagagaaaggag

SEQ ID NO: 210325 - DNA, 298 bp, Homo sapiens
aaatataatactgtataagcactaaccaaaagaaagctggaatgacttgattaatatctgataaaatagacttaacaaagattataaacaggcattaaaaaggtgtatttcataatgatcatggggttatttcaccatggaagcacaacattgttcttaaatattcatgtacttaacaacagagcagtaaaacataaaacaaaaacagaattgaaaagagaaatagattcacaattttagttgacggtttcaacactcctctctcagtaatttatagaaaaagtagacagaaaatcca

SEQ ID NO: 210326 - DNA, 239 bp, Homo sapiens
catgtaaaagatcaggcgttttcttttcaaccttggtaaaggtcagtaaacacaacagtcagaaggcagaaaatggagtggatcaaaatgatgatcatgaaatagcttagaaacaagctggtcaggacttcagacagccagtgataaggcaggagaccatggaaagtgtattagtacattttcaccctgctgataaagacatacctgagactgggaagaaaaagaggtttaactggact

SEQ ID NO: 210327 - DNA, 225 bp, Homo sapiens
cacgctgtttacatggggcatagactgcttcatgaacgcttgactgcagctttgccttcctcatgccctcaaaaaggaaggagctgaccaaagcttactataccatagctggggtctgggacccccagccaggtctcacagatgatctgggaatggcctccctgttgctctcaggggtccggcagtcacacagaagagtcaggttgaaatcttggcaagactttg

SEQ ID NO: 210328 - DNA, 449 bp, Homo sapiens
acctccaacaccggggattaccaatttggcatgagatttgggtgaggacagatccaaaccttatcagtcactaatccagaaatttttttagcatttaattgatcaagcttttcgtagtgatcagtgataattgatttttgtaacataaaaccctagtatgagtacaaaatcctaattgctttcaaagttaattttttaaatgtacaaagatataagctaaatcatcaaaagctaaattatgttttaatagttacaagtataattttctagttcatacaaaattagcattttctaaatgctaatagggttttattaatgttcagggtaactttatattcctttgttgtccactgggtgtcaatatgataaaatgacattgaataaatagcaataaattaaatatatttacagaaacattttatcaaattaagattaaaatctttattatg

SEQ ID NO: 210329 - DNA, 429 bp, Homo sapiens
gctgcaacctctgcctcccaggttcaagcgattctcctgcctcagcctcccaagtagctgcatgcgccaccatgcctggctattttttttttttgtctttttagtagagatggggttttaccatgtaggccaggttggtctcgaactcctgacctcaggtgatccacccacctcggcttcccaaagtgctgagattacaggcatgagccatcgtgtccagccagtattacttcttgatagaaaggtgatgagaagtagggaacacacttgaggcatgcttaggagtcatgcttgatgaggcttggtggttggttaaaggtagaagatgaaggagatggaggaggcaaagatgattttctaatttctagcctgcatgtctgagtggatggcagtgtacccacagctgagaaagactacaaaggcaagagc

SEQ ID NO: 210330 - DNA, 575 bp, Homo sapiens
aagaatttgacaaaatccaacaccatttcatgatttcaaaaacattcaacaaactaggaatagaaggaaacttcctcaacctgatgaagggcatctgtgaaaaatccacagctaatatcatgcttagtggtgaaatattggatagtttcctcctaagttcgggaactagacaacaatttctgctcttgccacatctagtaacattgtattgaagtttccagtcaggacaattaggcaaaaaatgaaataaaaagcatcctggttggaaaggaaaaactaaaactatattcacagaggacatcatcttgtatgtagaaaatcctaaggaaccccttaaatactattagaattaataaatactgatgattgtaagataaatcatcactacacaaaatcaattatattttcatatactgacaatgaaagacctaaaaatgaaattaagaacaactccatttaaaacagcatcaaaaagaacaaaatactgaagaaaaacttcacaaaagaagtaaaaaatatatactcttaaaattacaaaatattgttgaaataaattaaagaagatataaataaat

SEQ ID NO: 210331 - DNA, 232 bp, Homo sapiens
agaggctcccggtgtctagtttaacagtctctaccactcccagtgttttattaacccaacctgatttactgattttattgacctccttagtttgtttttatgggctttgagtttgctacttctgtttggttcacattagaagcaacccatataataaagcaaaggctttccttcttatgtaatttataaggcttttttgtcaagaatttgaaatatttgtgagcagcgttgg

SEQ ID NO: 210332 - DNA, 426 bp, Homo sapiens
ctcccaggaccaggagacaggggatgtggtattagaggattttctatgttggtatgaaaggaaatgttccctcaactttctcattcatatataaaatgaattttaaaaaataaatgaatcccaggcaagaaagactatgtgtgttcactccctggttttcttcaaaatgcaagatgcgtggtatttacatacacttacagctatgcataatgaatgtgatggaatttattagcacagccacaaatacagggctttgaaaggaaaccaagagtaggacatgaattgttcctgtaatataatatggcgctcctttcaatttttccccacctagagcttcacacatagtttacaacgattctggcaaaggtagggtatttcaacacaatgaaacataactaaataacttggaaccaaatgctgtcattc

SEQ ID NO: 210333 - DNA, 180 bp, Homo sapiens
acttgggggcagcaattataatcataatgttcaatttctcaagctaaaggttgtatattatattattctactttttatagacatgacatacttcacaatttaaaaataaaagatttttgtccttgtatgtctgattgaacataatgtaatttccttataaaggaccactccacctccacc

SEQ ID NO: 210334 - DNA, 741 bp, Homo sapiens
gtgtggcctgcaggcttccagaaaaaaacaggagatcagtgagctagcagcagagaagccttcctggaaaagtcttcaaagctacatctatacctgttcctgtattattgaaaaataataacaagataaacctggccagctatacaaatgctctgagggttgagataacatgcaaatgtagcctcacatatcaatgtgtgaaagctggacagaccacacagctcagaaaaggaagtacactctgcatagctaacttgcacattcactatccaagctgcaccatcttcggggtcattgtgtgccaggcatatcaactcttttcaataaaaatgcccccagaagactggaaactggttattccttctcttattacggagaggatacctgccttttgtcagcccccagtgagaagacaggagttgagacgatgactcctgtgcttgctcaattggagattgtgcattgcagacattggaacagggagaataaagggatcattcaatgatgtgtgatgtgactgtgtattgtctgaaagcaccttgagttaggatagggaaagagtagaggtgagagagggtaatcttcccatgggggagagaggaagaaggaagagtgatagcgtgcaagtcactgagtcttgagaaggggagtacacggtagaggaaatgttagtgcatgaccctgcctgcggcaacacctgtagaagacagtctcaggctcaggtgggagtgagacttataa

SEQ ID NO: 210335 - DNA, 282 bp, Homo sapiens
aaatatctccataatctctgtcttatctttcaccctcttaatgttgtctctgatgacagtgatcttaattcaaagaagtctaattattaagagggtgaaaagataagacagagattatgagaagatatttgcaaaatatatatccaccaaggactcacttcccatgtatctgctacaaatcagcagggaaaaaacctcccaatttaaaaatgggctaaagagttaaataggcactttacacacagcaaaaaaggatattcagtagtccaataagcatatgaa

SEQ ID NO: 210336 - DNA, 764 bp, Homo sapiens
cccgcgccgctgcgggcgcacacatgcacccaacagacggtgaagactctccacctggcaagaaatcctcctctcctctcagctgtcaccatgtccgacaactttaatcttccagaagtgatggcttaatggatgggactccggaagaacaaggagggctcgctcttctccagcacatttcactttctcctcctcctcccccctccctagagcagcttccaccaaggaaaaaaaaaagaaaaaagttaatatctccacccaaaagttctctggagaaaaaaaccaagcaaggaattgagaatcacagtggacaggaacttttcgtggccagagcgccctcgacgttggggagcgaggctgactctcctgggagtgctggtacggagggcggcgggatcggccgtctgtcctgcggtccccacacctggaaagaactgcgaagtggacgcttcgcgtctggctctgatcagacagataaactgccgtagtggaccggcctcctgatcaccttctccactttcccagggctattttccccagtcctttcctaggcgtttgccaatctccccgacactcaccaggcggcgaagtgaggaagaagccgtttcctgatctccctccacctccgcagaaactccgggcagcaattccttttccccgctgctagggagcctgaaggccaaagccgggtccctagccccgcgggcggtccgcgcggagcccgcttggtctttgcgtagttggcgcacccggcgcaggcgctg

SEQ ID NO: 210337 - DNA, 616 bp, Homo sapiens
ttatatatgatggatatatgtatggcatactataaataaaataactgaagacagaggagagaaaaaccatttgctagattcttaaaagattcccagtttggtgggcctcagaaatttaaacagacctaccataagacccaacaattccactcctacccaaatgaatgaaaatccaggctcaaatagatacttgtacaccaatgttcattgcggcattattcacaatagccaaaaggtggaaacgatccaagtatccatcaagagatgaacagataaaatgtggtatatacataccacatttatttatatgtgtaatatggaatattattcagccacaaaaaggaatgaagttctgaaacatgctacaacatggatgtactttgaaaagagtatgccaaagtgaaataagtcagacacaaatggacaaatagtacaggattccacatatacgaactatctggaatagccaaaattcatagagccagaaggtagattagaggttaccaagtgcctgggggagggagaaatgaggagtcactgcttattgaatacaaactgtcagtttggagtaaggaaaaagttttggaaatagtggtgatggttgcacaacattatg

SEQ ID NO: 210338 - DNA, 406 bp, Homo sapiens
tccttaattcttccactataacttgtgtgtatttctttataattctatcttaaacaacatatttcttgattttgcctgtttataaactttacataaattgaacaatgctgtgtgtattctcctgtgacttgccttttcttttcaacgttctattcacatttatccatattgatgtgtgagctgtagcttatttgtattcactgctgtatggcattccattgtgtggatattccacaaattacctcttttacttgtgatggacatttgggttgttcatattttcacatgtctctgggtatacatgtgcaagagtttctgtaggctatgtagctaagggtaaaatttgtgaactttagggtatatacaatttcagtttcctaggtaatgacaaattatttctcaaaat

SEQ ID NO: 210339 - DNA, 521 bp, Homo sapiens
gcaggctaggaatggccaggctctggtctctcctcatccagcaggctagccttgcttgcatcctcagggttccaaagacagaacaaaaaaaaggcttcttgaggcctaagcccaggactgacccagaatcaggttttcagtcctggttcaccagttacatggccttgggcaagaaacctctgcatgcctcagactcctcatttgtaaaacgaagattaagtgagttaacatgtgtggaaagagctcagagctgcgccaaacacctcataagtgctatacgaatgtttgttactatcagtgaactaataaggaaaatgatatggtccatgttcctcatagtgttgaaatgtaccgggctggtcatttaggtatcattcactcattcacagaatatcggatgtttgctaggagccaggcactgtgctgggtggtggggataacacattgaataagataagtttgctcttagatggctcagatagttgggaaaactgaatgtagcttccgtgatttgatttgct

SEQ ID NO: 210340 - DNA, 754 bp, Homo sapiens
cccaaagtgctgggattacaggcatgagccaccacgcccggcctcctcttccatatttgtagctcctttctccaacagggagaagcctggccccatgatccttactgtattcactgatgtggtcaatcctcctggatgtaacctgtctcccacttttactgccttggctgccccctactcccagcataccttaggtttcaattgttctgcgaggggagatgggagtgtggaagggaggcagggaaagaggatgctttatacttcttagcactgactatgggatagacactgttctgtgttgtcttagaatcctgacaaccctacgaggtaggaactatgattgtgcccattgtacagatgaggaaactgagaggtgcaaggtcattgcatagtcacccagctgttgcggcaaacggtagctcttgcttcaaagccaccgttctgaaccacaaggcacccatccctcctactcccctaccctgggaaaccgaaagagtttctaaaagtcactttggagaacagcatgattcagtatttggtgagccctaattaagttttatgatcacaagtgacaaatataaaaccaaaaccaaaatcttattttaagaatttatcaacaacaacaggccaggcctagtggctcatggctgtgatcccagcactttgggaggccgatgcaggcggatcacttgaggccaggagttcgagaccagcttaaccagtgtggagagagggagagagccagtgtggagag

SEQ ID NO: 210341 - DNA, 769 bp, Homo sapiens
ctagaaatggatttcagattgttgaaaccatagatgagatcacccagagggaatatagggtgaggtgacagccaagagtggaaccttgaaggacatcaacattggagtagagtcattgaattaaatgcagaaaggaaaataaataaataaatagatgcaggaaaggaaagggcattgggagagagaagaaaacaactagcggagagcagtgcatgaatgcgaaagggggaagctaaatgtccatgcggattcagcttgcagtgttgtaactgttcattttatatgaaagtaatatgttaacagccccccacataccaccactttgggattcaagtatacaccaataattaccatcagaaggaagcctgtccccatagcaggtacggattgccacaacccactttagaatcctgtcactgtctggctttgtcccagtcacattaatacttttggcttagcccaaggaatcctgctgaggtttattataaaccattttttggccagacgtggtggctcacacctgtaatcccagcactttgggaggctgaggtgggtagatcacgaggtcaggagttcaagaccagcctggccaacatggtgaaaccccgtctctacaacaaaaattagccaggcatggtggtacgtgcctctagtcccagctactggggaggctgaggcagaattgcttgaacccaggaggtggaggttatagcaagctgagatcgcaccactgcactccatcctgagtgacagagcaagactccatctc

SEQ ID NO: 210342 - DNA, 449 bp, Homo sapiens
ctctagcaggctccccgtatacgtgtggaattatttttttttttgagacagagtcttgctctattgcccaggctggagagcagtggtgtgattagagatcactgcagcctcaaactcctgggttcaagcaatcctcctgctttggcctcccatatgttgggattataggcgtgagccaccatgcccagcccttccctgttttctttttccttggccaccttcccctgctcatctctctgctctgacagctcctaccatctttccttccaacttctaggaatgtgctggctgactgtgagctctctttcttggaaatgcctttccagctcctgtcccaggctcacaggcatctcagtggcttactgtgtcacctgcgccctaggttggttgtctagaccccacacctctgttgtcctaaggctggggaccctcacggtcccagtgctgcc

SEQ ID NO: 210343 - DNA, 293 bp, Homo sapiens
tcagggagaagttggcagtggccagactacagcgagaagttgcccaaagaacaagtgagggggccatgcatgagaagctgatacatgaacctggaagaggagagacacttacggtcttcaaagccgagaagcgattgcaggaggtgacccgtagagtctgaacgcaacagaattcagatgcgtcttgcagcagcagttctccaggatggaagaaacagtacgaaatctattgcagagtcaaggatctccagagcagaaaaaagaagaaactgttaatataatggtctatcagg

SEQ ID NO: 210344 - DNA, 577 bp, Homo sapiens
  misc_feature (461)..(461): n is a, c, g, or t
  misc_feature (525)..(526): n is a, c, g, or t
caagcgaattaaccctcactaaagaaaaatgtcttcaccccaaaatacaagcaagtgttgatttttcacactaatgggaaacaagaatagactggaaaaagttccctaaaaacccatttagtctgtatctttttatcttttgtcagttactaatgtgtaaccagatgacccaagctgagtttcaccacctctcctttctttattcttaccaatccattccaagtgctaatgaatggtgaggtctgggaacccaaagatacaagaaagaaggcatatggatgatagaaaaaaggtaagtcgagagagagagagagctgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgangtcggcaatatgttgtttttctggaacttacttatggtaaccttttatttatttctaatataannggggagtttcgtactttagtgagggttaattgggcggaattaaccctctca

SEQ ID NO: 210345 - DNA, 420 bp, Homo sapiens
tgataagattttaattattatttgttttgtaagcacaaaaagatggagtcataaaatcttaaaaatctctgcagaatttcacttctgtagaagtgaaagggaaagatagctaggatttttaaaagatgaacatagtagcattgattctgcagctgcctagagttaggcctgggacaggtggattatttggaagaggaatgtgtaggggcagatgtgaacttatttttgcttgctggcttgtttgtttggtaaaagtacaaaaatcagccaggtatagtggcgcgtgcctgtagtttcagctactcgggaggctgaggcagaagaatcacttgaactcgggtggtggaggttgcagtgagccaagattgcaccactgcactccaacactccaacctgggcgacagagtgagatgccgtctc

SEQ ID NO: 210346 - DNA, 1623 bp, Homo sapiens
tgtgacacactgggctgatttcatgacccaaaaaccatttgccacctgcaaatgatttccacaaggaaacacctggctgttgtccagcctcttgattgaaggagatacttggccatggtctaacctcttggttgaatgaaacacctggctgcagtctaacctctcggttgaaggaggcacctggccgtggtctaacctattggttgaaggaggcactggctgtggtctctcagctgaaggagacacttcgccacggtctaacctcttggttgaaggagacacctggctgcagtctaacctctgggttgaatgaaacagctggccatggtttaacctctcggtggaggagacacctggccacagtctaacctcttggttgaaggagacacctggccacagtctaacctcttggttgaagaaaacagctggcttcagtctaacctcttggttcagggtgtggtcactctgggaaacttccagagcaactattttatctacctctagcacaggttgccatcccctctcagcctcctcttggtctctttctgtgattgtgaacttccctcaaggaaacatctccgactcctcttctccctaaataggtggcacttcatgctgagcagaacactcctagtgggagctgatacatgtctctacctcctgcaaagtagccaagtggatcaaatccagtcaccagaattcctttgcgttttttcagaagagattcctggggcagaagctgagctctcagtgctctgaagatgggcggaacttctctgtgagagataagggaaggatttccaagctgcaccaggaaggagccagaaaaggaggctgtcgcgagcaagatggccgacactggagcttgcaatgtgacccctcccacaaacccccagccttcaaattcttcacaaatacttggatgtgaggagcatctggaaactttgtgcccaaactagctctggtagaatctaagcattaaatgcagatactagaagcacagagccagtgtggcataaaaactggcagaaataactaggcaggagctggactgactcccttagagctgtgaaggtgggttcagatcaagtgagacccacactctgaaggtcaggaagccctgctgggatcagagggaaatctgacataatggtgcccctgcagagctcacagcctagggaaaggcacacacacaggattctaagacaaatgctgtgtcggagaatgaaaaagaaaccatgagaacccagaagagaggacaattaaccttccgggagtcaaggagggcccaacagtagagaggctatttgatctatgccttgaaggcttttactatctggaggtagagtggtcaagagctcagagaggtagagcaaatcaagatccctggacatgtctcaggccctaggagtcagaatctcagatggagggctggggacaccttgttaaaagcttcaggtgattctgaggctcagccaggtcagggaaccaccagcctggaggacaaccacagctgcagccgagccactctcaagggcacctgcctccccctgccctgaattgtagggcaccgtgtgtgtgtgtctgcacatgtatgtatgcatgtgtatgtgtgtgtgcaca

SEQ ID NO: 210347 - DNA, 371 bp, Homo sapiens
cagctggaagggaaggcaccgatggtggcaattgcattttaaaaccaactaatatttcttagaaactctgctttgataagactggcactggctggcttttgcaaaacataaaaaagacaatgagaacaaacacacccagccagaaactgcctggccctccttaaaagtgactccatttcacgactttattgtttggtaaaaccataggcactcttctcatccatgtaaatgtcatctcaagttttctctcaataaatatctcccttcaattaaacaaagactaatacttttatttttaaaaaataaaaataaaactttcaatgagacagggaaatctgaatttttattttaacttttttttttttttttaa

SEQ ID NO: 210348 - DNA, 379 bp, Homo sapiens
tttacatccatgagcatctaatgcttacttctcacttataagtgagaacatgtggtatttggtttggtttctgcataaattcatttagaataatggccttcagctgcatccatattgctgcaaaggacataattatgttgttgttatggctgtgtgtaatattccatggcatatatgtaacatattttctttatctagtttaccattgatgacacctaggttgattccatgtctttgctattgtgaatagtgctgcaatgaacatacatgaatgcatggcttttttggtagaatgattcatttttggaagatgaaaaaaattctggagacagatggtggtgatgattgcacaacaacatgaacataatcagccgggtga

SEQ ID NO: 210349 - DNA, 364 bp, Homo sapiens
  misc_feature (234)..(237): n is a, c, g, or t
  misc_feature (327)..(327): n is a, c, g, or t
tctccactctctgtctcgctcctgctccagccatgtgaactgctgcatcccttccgccatgattttaagtttcctgaggcctccctagaagctgagcagatgccagcatcatgcttcctgtacaacctgtggaaccatgagcaaattaaaccagttaagtctcccaggaaaaaaaaaaaaaaaaaaaaaaaaaaaaaaaaaaaaaaaaaaaaaaaaaaaaaaaaaaaaaaaaannnngggggggggggggggggggggggggggggggggggggggggggggggggggggggggggggggggggggggggggggggggggggggggngtgtggggggggggggggggggggggggggggggggg

SEQ ID NO: 210350 - DNA, 986 bp, Homo sapiens
gaaaggaaggcctatgaaaatcagaccatgaagtcttatttttcattctttggtctagtaatttaatttcattttccagattattaatgctgcagtttattatatatttgatgctgaattgctgaatttgacttgtccaaatgacatcaatcctgcctttatctcattgccagaagtagtgaatatattgctttttatcctggtgaaagggaagattcaaagttgtttgaaggagaggggctgatctgtgtggtggcagtagaacatattctgattgatgtcctctaaccttgcaaacttgccagagcatccacctagttcaaccctagttcagttatcatggtggaaacccattatgggcactcttagcaactattgtgcctatatattaataagtctactgaataacaattagttcatccccttacttcttcagcccttacttccacattgaaagaagtaaaaagtagaactcaccaattgctatttaagcacatttgctagttttgtaaagtctatagacttctaagaggaatatatgaaacctcaagtaaatatattaaaacatgcacaaaataaatatatttatgatatatactttttattgtaactatcaaattttaatcaaaaaatttgtaatgctagggaaatctcaggttttactaatggaattatgaaaaaatattaatcttaatacaatttgtaaaatgccttaaaagttagatgttgaaatggacttccaggtcctgtagctacttctattgaaattatcatcataatgttttacaaaatgagaaaagtaatacagtttctctttccagttgccctgaagcagactaactgatgcttgtaaagatgtttctcagcataaatggattgttagagaatgaacttcagttaattttgaccttaaaaaaaagtcacgtagatatgtattttcatctgaaacattttcaagagtcttgcaaacaagtcactctaaaata

SEQ ID NO: 210351 - DNA, 375 bp, Homo sapiens
cagtacctgcaaaatgtctgagcattatgttgatttttttcctttattaaaatgtactgtttaatcttataagaacaatatgcctgttattttatagaatgtctctaaatttggatttgtttaaggtttctttattcaagtttgataaggttcaagttatagaagcctggtagactactgcagaagagatgttgtagtctcagtaaatcatatcaggggacacataatgtttgttccagtataggtgatgttaactttgatcacctggtcaaagtggtatctgtagttttctccattataaaattatttttccactttaaattaattagtaatttatagggaggtaattcaaaatatcctgttcattaaactgtt

SEQ ID NO: 210352 - DNA, 231 bp, Homo sapiens
tggcaacaacaacaacaaaaaagactggtccacagagagagagctgcaggaccaagtaaacgtctgatttccaagagaaaggaaatcttagcctgaaaagtgaaaagaaagcagccaacataaagactaaattagttcccagacagataaggtggaaagtgtaagggagtgcagagaactgaggaacagctggaagaaatctttctaaaggatgaattccgggccgggcac

SEQ ID NO: 210353 - DNA, 410 bp, Homo sapiens
catcacagggtcctgaggcgacattcatcctcagcttatgaagatgatgggattaagagattaaagtaaagacaggcataggaaatcacaagagtattgattggggaagtgataagtgtccatgaaatcttcacaatttatgttcagagattgcagtaaagacaggtgtaagaaactatacaagtattaatttggggaactaataaatgtccatgaaatcttcacaatttatgttcttctgccatggcttcagccggtccctctgttcagggtccctggcttcctgcaacagttgtctcatgtcccacaagcttttttttaatgtcttactgagcattcatgcaggtgaaaaatctgtttatatttatgagcccaaacccaactattttgcatataaacaaaatatgctg

SEQ ID NO: 210354 - DNA, 345 bp, Homo sapiens
aaacaaacaaaaacacaggatagtcttcttggccctacctgttggtgccaatggaaggataattcttagggccagggcacaagtgtcctgagttccccctgccagtgtggaaaaccacagatgcactggacggtgctcctcagagccagccttggatgctggctgctgctggctccccaattcctggttttagggacctctaagatggccccaatgtcctaacccgtccaccccactaaagagggacagtcccataatggtccaactctttgacaagaccatgagcaaggatgaagaacaaggggtagttgaccaacaaggccttcattcctgtccctctttatt

SEQ ID NO: 210355 - DNA, 236 bp, Homo sapiens
tggtggcacaccccgtagttccagctacccaggaggctgaggtgggaggatggcttgagactaagattgcagtaagccaagatcacaccactgcactccagtctgagcaacaaagccagaccccatttcaaagaaaaaaaacagacccaacactccacacagtatgttctttactgtaaatagaagtgcggacataaacaaaaatttacactttcacatactgcaaaacaaaaata

SEQ ID NO: 210356 - DNA, 555 bp, Homo sapiens
taggagagttatttaacatgttcgacttgcatctcccttaaatgtataaatgggataaaaacagtggcataccacgggtagggcaggaatagtttcccctggtggagttgataaaggggtgtgctgtctttagagaattttagaacaataataaaatcaactaaaagtctttttaaaaattatcaccaaatgctgacaattctaaatgaggtcagtgagtaaaactaccccctaccctgatggccatggaatcatgcatttctgaatgtacttcagtatgtacctgatagattataaaatgctacaaaatgtaatttttaaacaatttccttcaaattcatgtgacttgtgagatttggagggaaaatactggttctgtttttattttttttaaaaagtatagcaaatctgatctgcaaaaattatttggtcatattgttagtgatgtcattttttttgagataagtgacttatttaccacagaattctgtggagaatgagtgaaaaacatcctgtttttgtgtaacagagaaataaacattaacatgatagctt

SEQ ID NO: 210357 - DNA, 351 bp, Homo sapiens
gctcggtaccctactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctcatttatttgcttaaatggaaagtgtgggagccactaccctctcttttgatctgccaaggatttcctctcagagctgttgcacagacagagattgtacttggtaag

SEQ ID NO: 210358 - DNA, 470 bp, Homo sapiens
agtcattgagaggtggcaaattttagtttacctatctgtaaaataaagaatagcatatttctatgggccctgtgaaattaaagatatcaatgattctatgtcgatacaagtatgtccactcactggtgacatgtcaaagaatgccaaaatctacaacaatgtgagagtgaaaaaataatgttcataaaattataaacaagaaatttcacatagcataactacagataagaagaataaaaaatatgtaaagctcttttatatgtttgcccttgatagagtttattacaattattataaattgcacaaaattatttgttgaaataaagcatattaattacttatatattcaaaagttaaacattgataaacatcttgctatgtgtatggaactctattgacttttttgtccaactttctgaaggcaaaatacgttgaaataaacaaggaggaaataaaagtgattctactta

SEQ ID NO: 210359 - DNA, 495 bp, Homo sapiens
gtcagataaagtagggaagaaaataggagttataaggcagaatgaaatgagcactcataccagaggcccagagacagaataagtcacgtgtccaggcagatgaaaaaagtggatagctaagacacagaacagaaaatataccactagaaaataagctccttgaaggcagagatctctagtccctagaacaatgcctgacatatgagtgtttaataagtatctgttgataaaggaatgcatgaattaatacagcacagaaaaatatgcaacatgacatacttatatgcatagaagcataggcagtttttcagaaacaatacctatatcttttggccctttcagccttactccctaagaccgtcttaggggcttagggagggatagcattaggcgatatacctaatgttaaatgacgagttaatgggtgcagcacaccaacatggcacatgtatctatatgtaacaaacctgcacgttgtgcacttgtaccctaaga

SEQ ID NO: 210360 - DNA, 502 bp, Homo sapiens
gttgtgggaaagcagcaatgtggacgaatctcaaaagtatttccttaaggccaagcaaggtggttcacgcctgtaatcccagcactttgggaggccgaggggggcggatcaccaggtcaggagattgagaccatcctggccaacacggtgaaacccccctctctactaaaaatacaaaaatttagccgggcatggtggcaggcgcctgtagtcccagctacttgggaggctgaggcaggaggatcgtttgagcccgggatgtggaggttgcagtgagctgagattgcaccgttgcactctatctccagcttgggtgacagagcaagacctgtctcaaaaacaaaaccaaaaccaaatacatacacattgaaaaatgctacatatttgtcatgattatatgcaaatgtttgtaaataacttatggaagatgaattggaaagatacctgcaaggatggatgctgatgggagaagatcatcttgctcccatcagtttagcagtgg

SEQ ID NO: 210361 - DNA, 435 bp, Homo sapiens
ctcccaaagcgctggaattacaggcgtgagccgccgcgcctggccaggcctgggaatttaacctgtggagagttctgtttttatgcagtattttacttccaactcccttaggtctcagccttcaacttctatccctgggtagatattaaaacccaagtcactgccaggctcacacctgtaatcccagcactttgggaggctgaggtgggcagatcacgaggtcaagagtttgagaccagcctgaccaacatggtgaaaccccatgtctactaaaaatacaaaaaaattagctgggtgtggtggcatgcgcctgtaatcccagctactcaggaggctgcggcaggagaatcgcttgaacctgggagagggaggttgcagtgagctgagattgtgccactgcactccagcctgggtggcagagcaagactccatctc

SEQ ID NO: 210362 - DNA, 415 bp, Homo sapiens
ggtgtcagtttttattttaaagcttcattgtttagtttatttttatattttacttcagtagtaatgactattaactatgtgctagacggtgttctaaaagcattacatagattcatttagttaatttttatgaaactcttatgaagtagagaagattctttgtacatttatttataatagttgcttgaggccgggtgtggtggcttatgcttgtaatcccagcactttgggaggctgaggcaggtggatcgcctgaggtcaggagttcaagaccggcctggccaagatggtgaaaccctatctctaataaaaatacaaaaattagccgagcgtgattgtgtgtgcctggtagtctcagccacttgggagggtgtgaagcaggagaatcacttgaacccaggaggcagcagttgca

SEQ ID NO: 210363 - DNA, 540 bp, Homo sapiens
gggcagggtggtctcatttcctgacctcgtgatccacccgccttggcctcccaaagtgctgggattacaggcgtgagccaccgtgcccggccagttttgtggtttttaagccaagaaattttataatcaaatattttcaagggatattcttagatatattaagagaaatggtctcatgaataagtttggcaaacactgggctaacttagacattatttactgcaataatagagcctttaatatgctggtgtgaatttttaatctttccaagagaacaatattgtatttatccattgtatcaatcagtgtcccggaagaagacagattgttcactcacagtggataattaaacatttaatagagaaacaagaaaaaaagaatttcaggccaatatacctgacgaacattgatgtaaaaatcctcagtaaaatactggcaaactgaatccagcagcacatcaaaaagcttatcctcaaaaaaaaaaaagtttatcctccacgatctagttggctttatccctgggacacaaggctggtttaa

SEQ ID NO: 210364 - DNA, 370 bp, Homo sapiens
agataccaagtaatacagtaataattaacatattaagaagaaaattttcactaaaagattgccaacaagacttcttagaagcacatcatgacgtagaatggttgatataagtgtttattaccaggcgtggtagctcacgcctgtaatcccagcactttgggaggctgagaccattctggctaacatggtgaaaccccatctctactaaaaatacaaattacccgggcgtggtagcgggcatctgtagtcccagctactcgggaggctgaggcaggagaatggcgtgaacctgggaggcggagcttgcagtgagccgagatcacgccactgcactccagcctgggggagagagcgagactccgtctcaaaa

SEQ ID NO: 210365 - DNA, 224 bp, Homo sapiens
aattatactctgcctttttattcagtctatagtagtgcttcaaaagcaagacagttttcctaatacagggagagaggccctgtttaaaaaaaaatctatttggggtactctgtttcaatctttgtgtctttctctttgcccagctgcaccccttcatgggacagggaccccaggaaggaatgtcccacccagactctggagttgcttttccagttcattgtgtg

SEQ ID NO: 210366 - DNA, 360 bp, Homo sapiens
ctcaggtgatcagcccccgcctcggcttctcaaagtgctgggattataggcgtgagccaccgcgcctggcctacataagccatttctatgaatctgttactgtggactcacagtcattgtctgcaaaaagtatttcctgagaaccactgagagaagtatgtttggagctgcatagaagaatcacagcgcaggccgggcacagtggctcacacctgtaatcccagcactttgggaggctgaggcgggcagatcacgaggtcaggagttcgagaccagcctgaccaacatggtgaaaccccatctctactaaaaatacaaaaattagctgggcatggtggcaggtgcctgtaataccagcta

SEQ ID NO: 210367 - DNA, 176 bp, Homo sapiens
cacccatctccccccaaagaaaatcccacaagcttaatatagaaaacagaaaacactaaatggagggcttaggattccaacccaaggctatcagattcaaacaagaattgcaatctttggccaggcatgatggctcacacttgtaattccagcactttgggaggccgaggtgggtg

SEQ ID NO: 210368 - DNA, 243 bp, Homo sapiens
gcacccaacctttaacaccttttatcacctgccctgcctgatgatgatgggctttggggtccagtcacatctccattccctcacttgtggcaggcaccagggtaaccagcaagcaagccctgaaaagagagaccttgcccggaaacgttgcagcgttctcttacgtgtatgctttgccttctgagaatggcgagcattgatgcaagtgtatcccttttaagaatactcaatggggccaggcgt

SEQ ID NO: 210369 - DNA, 519 bp, Homo sapiens
ctgagattgcacaactgcactccagcctgggcgacagagggagattctgtctaaaaaaagaaacccaaaaaaacaaagaaacaaaaaacggaataatattccactgtatggatggaccacattttgcttattcattcatcatccatcaaggaacacttggttactcccaccttgtggtcattgtgaatgatgacgcaatgaacatgggtgtacaaggatctgtctgagtccctgctttcaattcttctgggtatataccctgaagtggaatggctggattacatggtaattccatttttaattttttaaggaacccgtatactggtttccacagtagccgcaccattttacactcccaccagcaatgcacaaaaatgtcaatttctccacatccttgccaacatgtgttgttttctgtgtattccacccctgccccccaccgtagccatcctaatggaggcaaagtggtatctctctgtgattttgatatttttaattcaaataaaccttagcacctgt

SEQ ID NO: 210370 - DNA, 291 bp, Homo sapiens
gaaatgagttccaagctttattcttctgcgtataggtggattagaaagcttttcaaatctgtcccggatttggactctgactagacatacttagctcaggccccgccacgcagaggccttccttcctcattaacatgcatcccaacatgggacgtgggaaatcattttgattctttgttttgcgaggggagttgctatgtcaataattaaccgggtgaccttggggaaacccaaaggcatctgtgagccttggtaacttttgcagaaaataaatgtgaagttttggctgaa

SEQ ID NO: 210371 - DNA, 515 bp, Homo sapiens
agtgttgggattacaggcatgagccaccatcaccatacctggctaatttaaaaaaaattttgttgagactgggtctcactattttgctcaaggtagtctcaaactgctatgctcaagcacccctcccaccttagtctcccagagtgttgggattttacaagcatgagccaccacacctggctaagctcagttcttaatgcttcatttttacttagcaacctctggcttattctttgaaggtacttctttatgcactctagcttaaacacccttttgagaactctatttgctaagctgtcgaatttctgtgtccagtggcttttgtgtggttggtgtaggctttcatgtaattttaaaaattcttgagtgaactagacttgttttaaaaagttagccatttttatatcatcattcagaacttttttgatttcacctccaagagttttttttatactagtacctctttgaaaaaagcagcattatgacaatattaccttttttttaaaaaaaaaaaa

SEQ ID NO: 210372 - DNA, 390 bp, Homo sapiens
cagggttaaggcacagaagaaagttcagcacatgagagacatttggaagttactaagggcatagtatatcatcatcaaatagttattatggacctattatttgctaaacatattgcttcccccatgattctcaaacatcggtgcccagaagaatcacctagagagcttgttaaaaaccagatttctgagctccaccttatgaatatgcatttgtaccagcacccaggtgaatctgaggcaagtgactaacactttgaaaacactgtgattggccgggtgcggtggctcatgcctgtaatcccagtactttgagaggttgaggtaggtgggtcactcgaggtcaggagtttgagaccagcctggctggcatggtgaaaccccgactctact

SEQ ID NO: 210373 - DNA, 461 bp, Homo sapiens
gatctacaagtgccatctattcaggggactaaatgtgatttcttttcactgcccagtggctggtaaggaaggaagcattttgcattttcagcttgtaggatggttattggtggtcctaccatcttgctcatgttcaagtttggtcgtgtagatgaagagcccagcttcccagctcttagtttttcttttccctcaggccattcataatttagctaacattctagtccattgaccagcatgcattttgaaaggtgagctggcaagcctgtaactgtgtgcaaggttgttctcatttaggctccaggaaggatatagtttccccataagaaagaaaagtgggcgagaggctgaggtgggaggtcacttgagtccaggaggcaaagattgcagtgagctgagaaccatgccactcactgccttccagcttgggtgacagagtgagaccccatctcgaaaaaaaa

SEQ ID NO: 210374 - DNA, 439 bp, Homo sapiens
aatgtgattcaagatgtaatcaacataaagcttgattgcattattttgcatgctaagttttccaaatccagcttcgtgtcacacctacagcacatctcactcaagctggccacatccctgccatccagacgtaaaacagtcacaagacagggctggcagggccgcggaggaggccggcaggggccatcacggagtgcccatcctgcactgtggtcccagcaagtttcttcctcctggcaagaagcctgtcccaggctggcaggggacagcgtgaggtgcagcctatggactgggaaaggggtgtggaagggccacacctaagtcctaaaatccaggcccagaagtggcccaactcacttctctgcctttaatctcacaggcatacccggtggcaaaggagtatgggaaatggagtcaggctgggtagccacgagcccag

SEQ ID NO: 210375 - DNA, 552 bp, Homo sapiens
tacaatccattattctgttctggatctcaaacatgctttctttactattcctttgcacccttcatcccagcctctctttgccttcacttagactgaccctgacacacattaggctcagcaaattacctgggctgtactgccgcaaggcttcacagacagcccccgttacttcagtcaagcccaaatttcatcctcatctgttacctatcttggcataattctcataaaaacacaggtgctctccctgctgatcatgtccaattaatctccaaaacctcaatcccttacaaaacaacaactcctttccttcctaggcatggttagtgtggtcagaattcttacacaagagccaggaccacaccgtgtagcctttctgtccaaacaaattgaccttactgtcttagcctagccctcatgtctgcatgcagcggctgccgctgctttaatactgttagaggccctaaaaaatcacaaactatgctcaactcactctctacatttctcgtaacttccaaaatctattttcttcctcatacctgacgcatatacttt

SEQ ID NO: 210376 - DNA, 243 bp, Homo sapiens
gatcctggaccttcagaaggtcggttggtgttatggagatgtgactggttcttgcagggatgggttcccctacaagggccggggggggactgcatacttctgacccctgggccctccttccctcccagcctgcacagccctctgcagtggagcacactgcaaagatgggatttaaaagtttcaccaagattgacaccaatcattcactcatccaataaacatattttaagtacccatggtttg

SEQ ID NO: 210377 - DNA, 601 bp, Homo sapiens
  misc_feature (401)..(401): n is a, c, g, or t
aaaactaaatgccagtttcactaggaccacccttgatgaagaaatatacattattaattttcttaaacttcaacttggccgagcacagtggctcatgcctgtaatctcaggactttgggaggccaaggcgggaggatcactttgagcccaggagttggagactagcctgggcaacaaggcaaaaaaccgtctctacaaaaaaatacaaaaaattaaggccaagcgcagtagctcatgcctgtaatcccagcactttgggaggctaaaatgggaggatcactttgggtcccagagttcaagaccagctagggcaacaaggcagtaatctcagcctcccaaagtgctgggaccacaggcgtgagccactgggcctggcctaagttgaaactcttttgtaactntgtgttgccattggaataaagcatttgagacagttcttgggagagtttcccgttgttcatgaggcattcgtagagactattctcttgttctagtctagaaatttctgaagatgggagtaggaccactgtcactaaggcttgacatagtatgcctgagaagaggataagcagactgtccacagtctggttctctatgcctt

SEQ ID NO: 210378 - DNA, 406 bp, Homo sapiens
tgtcctgagatgtaacctctctggcctggagataaagtcaactaactgcatggatggattattttatatattcattcacatgcagattctccacaccctcagaaggcaacctgacatctttattgagaaaattaagaccattttgcattaaccaccacatctttttctaacaccaaatcatttctgtctctctccactcccccaccaccttctgtttcctcttttcatcactcctgaccctcctccttgtcaaagcccctctccctgtgtcttcatcctgggcttccttctccatcttatgtttctcttgtttcttctcctggcactcatcctcctcccctttctcattcttgccacttattttctcctgcctatataacttggtaagccttctctcgtttcctta

SEQ ID NO: 210379 - DNA, 591 bp, Homo sapiens
ctttaggcacagctggatccaagggcacaaatgatgtcatcaggctccagttattctccatctcccagctcagctttttctgtctgtaagcctgattttcaggaaggctctttcctagtgatggagatgaccaccatcagctccaggcttctatcctgctaacccagtaacccagtgggaagagatttacttattccaataattccaagtggagagtgtcattgacccgtttggggtctcatctctacttctaggggaatgaaacactctgagtggccaggcctgtgtcatgtgctaattcctagagccagggaaataaggtctgaggattcaggatggggtgaaaggtggttgcttaaaggaaaatgaaatacaattagcagaataaggggaaacgagtggtctgctctgctcgggcaaaacaagagatgcccattactgtgagggacccttgaagtctggactcttaaatgggtttttgctgatttcctgggtgcatgctaggatgatggggcttgatgcagtagggaagagacgatgtaaaaataataaacaatatataccttcctagagtgtgaatgcattcgaaga

SEQ ID NO: 210380 - DNA, 1100 bp, Homo sapiens
gagagcactttatgcttttcctcgcccttgcagagtctgggtggtctcagtgggggctcaggacagtcagctcaagacagccaagtcaggtattattatgatcatttttatcatcatcatctgtataagacaaatgacacagccagttagtgagagggccaggactggaagccagggtatcggttttcccagctcccctgtcagaggccagatctggagtagtgggaagaggaggcagggggcaggtcttgccccttgccaggcctctgccccttgccaggcctctgccccctgtatctctgcttctgcctcagctgtcctgggtgaggtgggaggcacctagcatttagcaggtgattctcccaccctgccctggctctatggctcatagccagtggcttggagaggcagggccagatctcaggagtggagggcaacctcttccctggcttctaaaagaatccagagcccagtggggctcatgtcccattccaggttccagcatgccttgcctctgcttgctcgggctgcctacgcactagctacatacacctctagcttcatgtttcatgttggagtgtggggagaaaactgggttcttagcattagagagggaagtggcaggtggcagatacaagcttagctctgacctgggtgcacctcagctctgtgtccttttttttccctgacctgaagctgaccccagcagaagtcccccagccaacccctccacccaacaaccccccaccctcccatcctgcccccagccatagtgggagctgggaggattgcagcatctagtgccttccaaggctgttcctggagcgctgcttgtaaacccaagccaagctttgtcccacgtagggagaatggaaggtgactgcaatgtcccttgtcctttggctccatctccccattctgtggttctttgggggttcctgcttccctcaaactgaacactctcctgtccaacacctgatggcttaattattgcctggaattgcccggcctccgatgctggaatcaaagattgccttccgaagtatttttgttaagatggcaataaaaagaaatcaatctcactctttgaacacacccag

SEQ ID NO: 210381 - DNA, 485 bp, Homo sapiens
tgcaggccctgcgggtggacagggtgaacggaggcacaaggagggtaagtctgacaggggctggggctgggcctggagccagaaccccagccagtcctgccaccgtatcctagggcactttccgcagacagcaggccaaagcaaggttgcccagattaaaggggaaggggccctgcctctcccaccaagggcctcctggagaccccaacacagatccccagcccacagacaccaaacccagggcctttgagaagtgagaaatgtgaaaaacgcacagaacagctgcagcttagcgcttctaacacgccagactcacacaggcacacacagcgtccctgcagaggccagaaagctctgtgctgggaagtcccccgatcgggggaggccccacagcaagctcccctctctgcccatccaccaacgggcggaaggtcctaattaggaccatatgggaagggccagcgggaggggcagagagggaaaat

SEQ ID NO: 210382 - DNA, 357 bp, Homo sapiens
atcgagctcggtactcgtgactggcgattatacagatgaagaagcacacaggcaaggcctggaagggtcctgacctcaggcgcttacccttgatttgtaaccacccagctggctcaccttgcctgctgcagagacagaggagatttgcaatagagaaagtaattcatgcacagccggctgttgttactcaaatcctattattactcaaatcggtctcctcgagcactgggggatcagagtttttaaggttcatttggtgggtcgggtggtgggggcagtaagtcgggagtgctgattggtcaggtcagagatgaaattatagaaattagacgctgtccgctttcgctgagtcagttc

SEQ ID NO: 210383 - DNA, 835 bp, Homo sapiens
gtgtgagtgggatctgcctgggctctgggtgagtaattggaccacagaggtggactgttgaaatatttgctgtggagaagccacatctctcacagtgttggggcagtgtctgtaaggaggtagcccaggtccaggctacagctctccatgcatttgggattgttggctttctgctaagatagcagggccctctctttgctgaatgctgtactgaaacagtggcctaattctcttcagagatctctaccgcctctttatctaccacacattgagggagaacggggtcgtgtgtctgcctggcaggcgggcacccactctggctctgtgaagattcaatggacttgtgttcagtctcacttctcgcctcagtggctgcatagtcccaggccagtcacttgagccctctgactctgtttccccacctggaatctgtaggcccatctcttggtgttgctgtgaagaggtacatagagctcttggcagcatggccacagtcggtaagatgggtaatgctgtgcttctcgaatcttctagcactagtgttgctgaagtggctgcatcctgctcgcgggtgtgaggaggagagtttctttagaggcatagacctagcaaaatgtcccacttccctggaggtcaaagaggcggcaggaggagagcagaagttgtgagtcataaaggcactgctttcaagaggcagaattgccatcctcagggtgggggtggggttatggcaggaactacccattttgcaggcttgtaggtgaccacggaggtaccttgccatggtcaccctccatgctggctctcacccacatcacagcaggttagcattaga

SEQ ID NO: 210384 - DNA, 544 bp, Homo sapiens
tgtaagtgggtcccccgcctgcctgagactggcatagttccaggtaccagcagccccagagcaaaagttctcagcccagcagggttggctttctgtgtgccagtggcatctgaacttcctgtccgtctcacatctgggtaccctcaagatggatgtgcgggcatcagccaacagccaggtcttcccctccctactgcataggtggtacattctcctcagtttctcctccctaaagaaggctcaggctggccgggagcgatggctcacgcctataatcccagcactttgggaggccgaggcaggtggatcatgaggtcaggagatcgaaaccatcctggctaacacggtgaaaccctgtctctactacaaatacaaaaaaaaaaaaaaaaaaaaaaattagccaggcgtggtggcgggcgcctatagtcccagctactcgggaggctgaggcaggtgaatggcgtgaacctgggaggcggagcttgcagtgagccgagctcacaccactgcactccagcctgggcgacagagcaagactctgtct

SEQ ID NO: 210385 - DNA, 104 bp, Homo sapiens
gcagacctggccagatgaccagtgccctccccggggcatttcacccataaatgtgatgaggaaagcccataaatggtggtgaattttgctgagtggggttaaga

SEQ ID NO: 210386 - DNA, 390 bp, Homo sapiens
tggcaaagctaggactggcgtggcttcccatatcacattataattttgcatattttggtgaagaacttggcggtaattattttaataaatcatagatgttatcctgatgtataaagtggaaggacaactctgaagatatatggtcaagttttaatgtgaagtattggataatctattaaaagttgaattgtaaattcgtttcttatgcaatatttgtttatctggaatggatattgcagcatactctaatctccttatgcacacatacatacgaatacacaaaatccattacaaaaaaaagagtttgtgttgggaggccgaggcgggcggatccacgaggtcaggagatagagaccatcctggctaacacggtgaaaccccgtctctact

SEQ ID NO: 210387 - DNA, 523 bp, Homo sapiens
catagaagtcgtggaaagtcctctgaactgctcttggcaatcatggaaagcaaaggtctccttgcaagagcagacccctccatgtgattctgaaggaaactgtgtgagggtctctgccagccactgctccccacctcggccaccgggtggtttattatgtcacacttctcaaggcaccgtatgtgggataagcacttgcactgggtttgcttagcacactctttactttgtccttgaaaaacaggcttctctggggtgaagacaaagtggtctcctgtccccgaacttacctgacactgcagggtttggaacaaatatcccacgacagggctggacctggtgtagccaccacattctgtaagttccaggggtctttaaacataagaaagtgacgaagggtgtggtagttcctgcactttcaggatagacaaggttcccacagatctgaatggtttaacacaggggtctgcaagccccgagccacagaccggtactggtcgggctgcacagcaggaagtgagcg

SEQ ID NO: 210388 - DNA, 595 bp, Homo sapiens
  misc_feature (13)..(13): n is a, c, g, or t
tcacatggcatgnaagttgctgagctgaaggaaaagattgatcgtcgttttggtaaaaagctggaagatggttttacattcttgaagtctggtgatgctgttattgttgatatggttcctggcaagcctatgtgtgttgagagcttcttagactatccacctttgggtcgctttgctgttcgtgatatgagatagatagttgcggtgggtgttattaaagcagtggataagaaggctgctggagctggcaaggttatcaagtttgcccagaaagcttagaaggctaaatgaatattatccctaatacctgccaccccactcttaatcagtggtggaagaacggtctcagaactgtttgtttcaattggccatttaagtttagtagtaaaagactggttaatgataacaatgcattgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaa

SEQ ID NO: 210389 - DNA, 212 bp, Homo sapiens
ttcattcatcccatgtgaatttattgacaaaaacctgtttcctgccttcaacattttcatttcagtttttacattttcaatcagagccaatgaggtttatcaccttatccactcaataaggttagtttttagaaagcctttgaattacaacatgacaagttcagcccattataaagaggaaagaggaaagaggaaaatcttttttttttttt

SEQ ID NO: 210390 - DNA, 1008 bp, Homo sapiens
cactgcggtggctcatgtctgcttaatcttacttcactcagtgaaacggggccaaaaagaattatctaggtgttttctgtcagaacggacgctaaatcacagctctggttctagtctactcatacacgtcataagctaattgtaatgacaatttcagagaaatgtgatcatggagaaactttctgggaatgataccaaggcattctatttattgcttttgataaagcaaatcagagagattcttccataacagttctggcaacgtgaaacaggttcattaatgctgaattgaaacctttggattagaagtcccaaggtaaaaagccaaaaattctacacagcatcagaggtgacagcctggcctctggaatcagatggatttgggtttgaagctcgtctctgctagttccctggctgtgtgagcttggaaaggaggggtgacgcttccttccccaaggaagtctgaagacaaggcagtggacacccatcaacaggggaaagagaaaatgaatgaatgggagctctgtaaaccacatcagcaacctcgaaaatgtccaactgcaaagacccatgtctacaaattgctgtcagccagaggaatggctgtaacttccttggtgccgagagatgggatttcactatgttggccagactggtctcgaactcctgacctcgtgatccgcccgccttggcctcctgaagtgctggaactataggcgtgagccaccgtgcccggtcaagataatttcttataggacaacaggacaggatcacccaggaaaagatggactccctgctcagttcctacttacagtatctgagtcacttaactaaatgcaatcggcccagctgcaggcaccactgctcgggccactataagaaccagcccctgagcttccggacaggaaacagcatctgcatttccagactgtagcagctcatcatgccaggctccacaggcaagaatcaagcagatggaagctacagaggaaacaaacagggttccct

SEQ ID NO: 210391 - DNA, 583 bp, Homo sapiens
aatcaacctggggaacaaaacggggaattatttcccaaaaaaaaaaaaaaaaaagaagaaaagaaaaagaaacaataggatttgatcactaattttttgtgagggatgtttgaagctcatcgacttgtggaattgtgaggttgttagtagaaatgggcaatttgggaagacagtctgggacttttttgtttgttctgggaaaaggtgatgattttggtcttggagaggtcttgggctctgctgatgaaggtgtccaacaggcagttggaaatgtagaataaagccaaggagagcatccaaagacatattagagatacgggaattatctacatagagggtgaccattaaagatgagaatgaatgggatccccaagggcgagagcagaagtgcccaggagaggagggctggtaccttggtacttacaggaagaagtaaacctagcacaagtgacaggtggaggactaataagaacacattgtttcagaggccaagggaagaaagttttagacggagggaatggttggcaatgccaacagcaagggagtgtgtggacactgagaagaggcaggcagatttggcaat

SEQ ID NO: 210392 - DNA, 488 bp, Homo sapiens
aatcaacctggggaacaaaacggggaattatttcccaaaaaaaaaaaaaaaaaagaagaaaagaaaaagaaacaataggatttgatcactaattttttgtgagggatgtttgaagctcatcgacttgtggaattgtgaggttgttagtagaaatgggcaatttgggaagacagtctgggacttttttgtttgttctgggaaaaggtgatgattttggtcttggagaggtcttgggctctgctgatgaaggtgtccaacaggcagttggaaatgtagaataaagccaaggagagcatccaaagacatattagagatacgggaattatctacatagagggtgaccattaaagatgagaatgaatgggatccccaagggcgagagcagaagtgcccaggagaggagggctggtaccttggtacttacaggaagaagtaaacctagcacaggtccagggcagaggaccaacgtcgacgcggccgcgaattta

SEQ ID NO: 210393 - DNA, 827 bp, Homo sapiens
cagcctcctgagtagctaggatcacaggcatgtaccaccaccacacccgctaatttttgcatgtttcctagagacaggatctcttccctgtgttgtgcagggtgatctcaaattcctggcctcaagcagtccctccaccttagcctcccaaagtattgggattactggcatgagccactgcacccggccttcttagactttcttaatgatgatctggttgccagtgggcggctgcaggaaaggtcctgggtcaggaggcaggagccctgactcatcacatataatttactgtgtgatcttaggtgagttgctagacctctttgggcctcagtttcctcacctgcaaaatgagggaaatgaaaagtggatcactcagcacctccctctctacattaccacgtcagttccatcacaggaggttgacagtaacccacataggcacgagcactcttgagcatgcatatgtgggatgtgggcagggggtgtgtttgataccctccaggtagaaaggatcacagagtgctgtacgagagagagacagctgttgcatacctgactgaacataggtcttccgaaggcctgtttaaattcagcctctgctagggtgagggggctgccttttttttagactcctttccttgtctggagatcacggtttaatgacacagcttatgcagagcctggcaaacagtgggtgctgagttgattctgaatatgctctggagctgtgaattgcagttcctggattctgagccacttttcaaccatataggatcaggtaaaccaagggacactgaagtgccataccattaaaacatttcttaaag

SEQ ID NO: 210394 - DNA, 684 bp, Homo sapiens
gacacacagacaagaggtgaaaactggcagaatgcctgcatcaactgcactgctcctttcgtacttttcagaaggcatgctttacaacagcaagtgcttctgtttacccactgagagaagtacacaagctgctgacagtaacggcaatcgagttttatggttatatttctgctaaatataatcttagtacatttttaaatcatccagtggccaaaaatagtgtttattatttattctagtaaattggaaattaaacgagaaaacaaaatttcttaaaccttttttaataagttttccaaacatatagaagatgcatctttagaaacaggcaactaatattctccctttctcttttttaattctaacagtgtggatagggtagatctctaaaattaactttcttgatagagctgtcttgcttgcaaaccagtctgaataccagttttcttcaaattaaaaaaaaaaaagcaatgttttttcctagatgttttcagctacccttacatgtgttcaacatttccttgaaatttaaaaatgttgaataaaatgtataccaatgctaatgattaaatgcaccttataataagttatctgtagtaaaaaatccttttagaaataccgtggcaaaccttccatggaaggtttttcatcctgtagcatggttctaatacagttcttagtaac

SEQ ID NO: 210395 - DNA, 270 bp, Homo sapiens
attgacacttaagcatattaaagaaaatcaaatagaattaagggttcattcgatagaaagaggtgagaaatatcaaatataatagatcaaatgataattagaaacatatattaaaaactaaatcttgggctgtttgataaaaatgcacaatagtggttaatataatttaagtgcttcttaaaagaaattaatccaaataagctttctatatgcatgtgaaaagaaaaaaataaaggcctaacaattactaatacaaagatgcatagcaca

SEQ ID NO: 210396 - DNA, 356 bp, Homo sapiens
cacatctgctcggcaattcatgtgctctcaagccaaggatttagaatccatgtttgtcatgatcacagaaactcgagagagggggtaatgtttaacccaagccttttcttttaccaataggtatcacttcttccccgcaaaatgaacatgaagaccatgactcggttacaaatatttcaggttacatcaaaatgcataaatgtatccaaaattccacgatctaaagtttctaataatttggaaaaaaaattctaaaataccctaaattattcctgacatcaaattgctcagagtccggcagagaagaaaaacaaaaaaacaattatgagagatgctagaaagcatgacaagagagt

SEQ ID NO: 210397 - DNA, 212 bp, Homo sapiens
aaaataaacattgtcttgaatttagtgtaagtcaaaatatgaagatcactttaaagataaatacatgtttttgattgtacaaaacagctttcttctaccaaaatgggcaagcccaaagtgtcttagaatatcagaactgggagaaacagtcaagatatttgtttggatgagggttagacctataattactttgttattctaaactgtctctt

SEQ ID NO: 210398 - DNA, 147 bp, Homo sapiens
ccacctatgtttactcagatttaatgggattttatctgggttttcaaagggctcccagatttaatctgggttttcagagggctccctagataattcttagatgcatccagattgagaagcatgaatccagagcaaaactgaaatgag

SEQ ID NO: 210399 - DNA, 1504 bp, Homo sapiens
  misc_feature (1)..(1): n is a, c, g, or t
  misc_feature (262)..(262): n is a, c, g, or t
  misc_feature (336)..(336): n is a, c, g, or t
  misc_feature (612)..(612): n is a, c, g, or t
  misc_feature (1504)..(1504): n is a, c, g, or t
ncaatatcctgccctttcctctttaaatattgaagccctcaaaatcatcttcagagaaaggcatagacctgtttcccggttgtgtgtccttaactctggcaaataaacctccaaaaatgaatgggacttgccctggtcattttccttgattgacaattggcacatccaaaagaaaaatgacagccccctgctaaaagagctaaagataaaaatggaacaaagatttatacttcaaatgtgaacataaagtaatattaggctnagcagaacttaaggcagtaagttttatggttaaaaagtcaatatgtggtcggccccatgtgtgcaagttgctanggtggaagtcaaaggggaaacaacaattcacaggaaagagtacaaaggcatcacaaaaaaataaaactgatttcataaacacggtgattctggttcttcaaagacatttccaagaaaagttgctaaggaaggtgaatctaaagccacatctaagaactttgagaaaagtgtcacaaaaccaggggaaagggtgcgaagcagttgaagaataagcaacaatgggacaaagcaccaaggaacaaattccagccagcaaataaattcaacaagaagagnaaactccagccagatggcaaaagtggtgaatcagcagccaagaaacccaaatgggatgacttcaaaaagaaaaagaaagaactgaagcaaagcaggcaactcagtgataaaagtaactatgacactgttgtgtgggcaaagcagatttggaagactttaagaagaaaagactgacaaagaaaaaagagtaaagttaatgaatgacttgcagaagttgattcaagggaaaattaaaactattgcatttattagctggacatgttggcacattcctgtaatcccagctactcaggaggctgaggcatgagactccttgagcctgggaggcagaggttgcagtgagctgagatggtgccactgcattccagcctaggggacagagcaagactctgtctcaaacaaacaaacaattgcatttgcaaatgattcaactcatgtgatccagtgttacattcagtgtggtaatgaagaacagtcaaaacaggcttttgaagaattgggagataatttggttgaattaagtaaagccaaatactccagaaatattttaaagaaatgtctcacgttgtgaacatgtaccctagaacttaaagtataataaaaaaaaaaaaaaaaggaaagtatcttgcacaagctcacgtagctggtaagttacatagttgggatctgaattcagttgtggcttcatgcctgagcttttaactactactactaaactgagaaggcacttgcttgagtaaattatgtcatcctcttaatgaagcattatgcagctgttaaagatgatagatgtaaaggttatgaggcaacatgaaaatataactcatttattcaataaatgtttgtttctaaatatattcatttgctgaatgaataaaatgttaagccaaan

SEQ ID NO: 210400 - DNA, 209 bp, Homo sapiens
aacatggggtcggagcggtgtctgctgcctgggagaccctgcctgtgatttggcagtggctggcaggagttggcgaggcggtgggtgcctccctgccctgatgacaggccctgctgtgacggctctgagtgagggcttctcatgtgtcaatcttctagactcccgagaagccacccgccctagctgcgttctgtgccaggggcctgagg

SEQ ID NO: 210401 - DNA, 512 bp, Homo sapiens
gaaaaatacaagacactgcctctacctctgcatctgtcctttgctttttgcttggaaactatcacatcaaatcacactgagatcaggagatgagatgaaggatcagctgaggaacagtcatcccaacagtagtgcctggtaagacggtgaggctattcccactcccagcatcctctgttctcttctggaccaacccagttattcaatccctgagctttctcatgtggttctggtaaatccactttttgcttagttcctactgagctctcactggcaaactatcagtagaagaagcctggcttctttctctgctagtgttggcgtctccctgctttcttcctttcaaatgatggtattagatctgtctttctctactacgagctgcaatgcccctgttacagaaaaaaaagatttgaggagacagcttgaagcaccatggttgttttcttagaagttctctgtaaaatttttcatggtatatgatcttaaaaattaaaaacaaaatttactga

SEQ ID NO: 210402 - DNA, 375 bp, Homo sapiens
gagtatgttttaaaaaagggaattaaatcttcttgattttagtagataaatggtatattttgttatacgtactttatatataaaataagagtattggctgggcgtggtggctcacacctgtaatcccagcactttgggaggctgaggtgggtggatcacaaggtcagtagatcaagatcatcctggccaacatggtgaaaccccgtctctactaaaaatacaaaaattagccgagtgtggcagtgagcacttgtagtcccagctacttgggaggctgaggcaggagaatcgcttgaacctgggaggcagaggttgaagtgagccgagatcccgccactgcactccagcctgggtgacagagcaggactccgtctc

SEQ ID NO: 210403 - DNA, 443 bp, Homo sapiens
ctgcctcaaaaaaaaaaaaaaaaaaagactaagtatatcaggcagtgattttgtcttattttgaattgtacttaccagtatttactttataaaaaaatttgcagttatataggataggtacagttattttggaaataagaggaattgtttctttatataaaaagcgtggaacaagtgtagatttgaattgaatcttcaatgggtggatgctgactggctgtgcttatttaatataccttccaaatcagactattagcagcctaggcaacataccaagaccccatctctaaaaaaaattagcctggcatggtggtacatgcctgtagtcctagctactcaagagacggaggtgggaagattgcttgagcagagaggtcaaggctgaagtgagccgtgattgcgttgctgtgcaatccagcctgggagacagagggagatcctgt

SEQ ID NO: 210404 - DNA, 602 bp, Homo sapiens
ttttgaagtggcaattttttaacagcacagcagcctaaggcaacaaggccagttagggctaaaaagaggctgataaaaaaatgtaaaggaaaacattggtaacaagatgcccatagggggctttgaaaacctccaacagagttctagggatctagaaggccatggacatgtacagggctgtatgcatgcccagaaacattggagaaggccctaatctctcccttctggctaatcttgagctctacacaagtagtaaggaaaggccaaggcagagttttaaactgagggagtgttgaagctgtgtcacaatacatgagcaccttagcaaagaatgggagaactattgattcaaggcatttgataaaatcactgtgcaatcattaactgagcactagactgaaaatagacttcaatggctttataagacaaagaatacaggcttataataattagtcaaagaaagtcactaaacaaacaccaacaaaaaacctggtgggaggggctcaaatttccagagtagccacattatgtttttaaaatgtctagttttataaaatacaaaacacgcaaaaaagcaagaaagtatggcccatatacaggaa

SEQ ID NO: 210405 - DNA, 211 bp, Homo sapiens
cctcatatactcctttagtctctccatcagcttcttctccttagccttgacaaaggctcaagttgtcctcatacaaaaattaccttcctttaaatcgtaccacatcttgagctttatcacatcttcccatcaccacaatttttttgcaatactggtctgcacaccatccatgcatctctgctgcatacaatgccacacctcccatttgtcc

SEQ ID NO: 210406 - DNA, 555 bp, Homo sapiens
tgaggttaaatagattatcaaagggactgtagataacaaaggtcccaaagggcagggaatggcttttaaaataagagaatagtatttatgaagcctaattgatgcaggtatctgtgatttgacctctacacactttcagctctccatataaggacatcctctctattatctttatcccatacattaggaatgacatcagcttttggcttcaactttactcacatactttgatggttatctgggtcttttgatgtcttattttctccacatttgctccactttccaagacaatcatatgcttcgacttattttagtttctcccagcttttctctaccccagcctctccctaagaccctatagcgtctaaggaagggctggattgaaaggatcatttgagctcaggagttcaaggtggcagtgagctgtgattgcatcactgtactacaacctgggccacaagtgaggcactgtgacttaacgaaacatcagaatgcaaggatacacatttataaagtctttgacctcatgtctgatggttctccctaagaccctat

SEQ ID NO: 210407 - DNA, 297 bp, Homo sapiens
taacatatgactttattcacctatttgcctgctttgtttaatgtctaaaagacaagtggcacataacaggccttccataaatatttgttgattgaatgaattgtctttagacagtcaattttccaacatacatgaccaagaaaaggaaaaaaataatcatcaaaccaaaggaacttcttgcaataatctcatcatattctgtatcttccccctatcaaatactggtagtacagcaatggcctcagagatttggctattccaattcccagatagaaaacagaagtccggcgaaggtta

SEQ ID NO: 210408 - DNA, 150 bp, Homo sapiens
ccaattataactcttctaatttcagtgaaagaataaaccggtcaattactttcgacttccttagtttatatttcctaatgctatctagtatcagtaaacatgaaaaaaatcatgttttttaaattatatcattatagtgacagttgatag

SEQ ID NO: 210409 - DNA, 177 bp, Homo sapiens
cttagcatgaatcaaactgtgctattggttattgtattcttcactgccatgtaatctcaagggaaaattgccagttctacttaggagtgtcctggatgacacagcaaaaattattaattgtattaaatctcaacacctgaatatatgtgtttataatttatgtgtgacaaaatggga

SEQ ID NO: 210410 - DNA, 388 bp, Homo sapiens
tttcaaactcctggcttcaagtgaccttcctgccttggcctcccagtgttgtatattattgagagcagaatattttttcagtttctttcctagaataatttcttacacaatgcaaatattcacctaaaataatttttccttcttcatgtcttatcccattcaaatggatatatcaacacagagaatgagtaagaagacagggtgggagggaggtaatgaaaaagagaaaaaaattactaaaagtggcacagacagcatttcaagttcttaggaaaaagaaaataagcaaaattcccttatcatcttaagagggctttactacagttctttttttttttttttttttttttttttttggggaaaaggttttgggctgggaccccggggg

SEQ ID NO: 210411 - DNA, 358 bp, Homo sapiens
acagaatagggagcccagaaagaaatccatccatttacggtcaatcaatttttgacaaagatgccaagaaaatacaatagggaaacaagcatcttttcaatacgtgatgctagaaaaactgacagtccacatgctgaagaatggtttttgatcctccactcatatcatatttaaaaatccacttaaaattgtttaaggtcttaaagataagacctgaaactataaaactactagaagaaaacatagggaaatgttccattatattctgggataatactcaagatgatcaaaacacaggcaacaaaagcaaaaacagacaaatgagattacatcgagctaaaaaatcttctgcacagca

SEQ ID NO: 210412 - DNA, 387 bp, Homo sapiens
cttattttattcagaaaaataataaaatgttagaatgacatttactgtaactttaaaatcagtctcaattttttcattttatttttctcttttaggctatatagatggaacagctatatatctgatatatagataagaatatgtaattagtgacacaactattttctttttatgttgtaatgctgtatcacatgatatatgacagacctggattaattcctttaatatagaaagacacttacaaattcattagataaataatagaaaaatgggcaaatattttaccaggtggtttataaacatatagatggctaatgagtaaatgaaaaaaatgcttcatttcatttgtaatttacaaaatgaaaataaaaatgacaaagaaaatga

SEQ ID NO: 210413 - DNA, 353 bp, Homo sapiens
ctgagtgttacttccaagccccaatccatccccgaggtatcctagtgtctcacctcccagctgacccctctgctcttcaatccatccccgcagtatcctagtgtctcatctcccagctgatccctctgctcttcaatccatccccgcggtatcctagtgtctcactgcccagctgactcctctgctcttcaatccatccccgcggtatcctagtgtctcactgcccagctgactgctctgctcttcaatccatccccgcggtatcctagtgtctcaccgtccaggtgactcctctgctcttcaatccatccccatggtatcgtagtgtctcgcctcccagctgattcctgtgc

SEQ ID NO: 210414 - DNA, 464 bp, Homo sapiens
ttcgctagattaagaaaaaaaagattcaaataaactaaaatcagaaataaaagacagggctgggtgtggtggctcacacccgtaatcccagcactttcggaggctgaggcgggcagatcacctgaggtcaggagttctagacagctggaccaatatggtgaaaccccatctctactaaaaatacaaaattagccgggcatggtggtggctcatgcctgtaatcccagctattcgggacgtcgaggcgggagaatcgcttgaacccgggaagcggaggttgcagtgagccgagatcgcaccactgctctcaggcctgggcgacacagtgagattccgtctcaaaacaaacaaacaataaaggtgggggggacatcatattatataaccaatgccatggaaataaaaaatattattaaaactttgaacatggccaggcacagtggctcacacctgaaatcccagca

SEQ ID NO: 210415 - DNA, 458 bp, Homo sapiens
ctaaggtatggctgcgttgggagctcggctcagccatccctagtgaaatacagtggaaagcggcagctggaatcagatccacaaggaatagcctgagttctccagaccaaagttatattttttaggtttgcctagctgtttaaaccaagtcacaggcagggctatggtagtcattcctaggtatcatcccagtgggacttgtgtacctgggatccgatggtgggactgctggctctggagggctagctggtcagaacttctgatgtctgctttgggcatcaagtgggaacatttcctgtatctcacatgggctggcagatgcttccatttaccactctgtatttttgctgaaataattatacctgacgtcacatacgaggcttccttgcctagaacagtggttagagcaggagcctgtgtagttgcctgcctgggcttagagactggttttactccct

SEQ ID NO: 210416 - DNA, 344 bp, Homo sapiens
tggggagggggagagtggttccaatttactatactactcaacaaaggaacactgctaatagcaagagatgcttaccttgaacactgtttcagataacatgagaggatttcgttaaataaccagattagagacctaagggactcgtcgtatgtttacgaagaatgctaaggatcaaggttttatttattctattcacacaaacagacttcaaacctgtaagatatcatctaataagtggacaagggggaagggaattactatgaaactatggttaagtgcctagaatgccctatatgtaaattttgttgaagtatatctaagtaactgcaacatactccccaaag

SEQ ID NO: 210417 - DNA, 247 bp, Homo sapiens
aaaaaaaaaaaaaaaaaaaaaaggttcatacatagagaactggctaaatacaagatgaaaaattcattgaggaagactactcagatgtgaaaaagaaggtgctgttggtaacaacttctggggggggcccggtgtgaggttttctttattctttttttcttcttttattatttcttttttatttttgtcttctcttatctttgctttctttaattatactttttcccttccttttctttcctctttc

SEQ ID NO: 210418 - DNA, 1020 bp, Homo sapiens
ggctggaaaggtccctgaaaaagtctgagcaaaagcttgttcctcactgtcattgcagcaggcaggacagcagacggtcacagcagcagcacaagggatggcgctggccagaagtttcaggagatttggtatctaggcctggatctgccaaaaaatcgctgggggaccttgagcctgtcactctgctcaaggttgaactacatgatctagatctcttctggctctaaaattctaaatatctaagtctcctgtggacacaggttaagttattaaccttctgccaaaggcacccctctcatcccaaccctggggccttcagaaaatgaggctgtgccagcccttccctcaccacccctgtcctgccaccataatcttcacagctcacaaggcacctcttccccactgccatccccataatcgccaggcctggctgtggactggttctctcctgagtctagagctgcctggctgcctgcagcctcctgtccaggatcagatctgcaatgcgactgctgctccatggccttcttgtagaccttgcactttccggcacctcctggcctcaggtccaaagtctccaacagctctgataccactaccttcctaccccctatcccgggctgcagtttccatctgcctcccattcctctcctaccctctccctccactccagtaaaggtaaccttataattttcctgacctccttttctgcgtttctctcctcatcatactctaagaagtttttcctaattttaagaaaaggaaggcatctatgtaagttagggtatggacccgaataatcttgctcttactatccccaaaaacaaaaagaaagtacaatctgtcaactcagctgctctatcactttaagagagtaagcatcccgaaggcaatgaccatcaacctcaaatatacatctatctgtccatcagagtgcataaacaatgctcatattcatgcaatggaatactactcagcaagaaaaaagaaacaactaaagatacacacaatggggatgga

SEQ ID NO: 210419 - DNA, 326 bp, Homo sapiens
cccttagggtaaaaggtgagaacatggctttaacttgacaggaaatcttaatgtcttagctattacctagttgtatatgaggaacacaaactgattttcaacaaggcagactggtgagttctgaaaaggaatttgaagatttttgcttggtaaatcacatctcagctggaagcatggctctccttattgaaaggaaaagaaagaatagagacaggaaacggagcccacatgagattgctccggccccaccagtgctgccagtgcttctcctgggcttcctttctcccagttctttttctccctgccttcctctctggcttccttgt

SEQ ID NO: 210420 - DNA, 370 bp, Homo sapiens
gttttgttttttcttgagacagagtcttgctctgttgcccaggctgaagtgtggtggtgagatctcggttcactgtaacctccacctcccaggttcaagtgattctcctgactcagccttgtgagtggctgggattataggcgcccaccaccatgcctggctaattttcatatttttcgtagagacagggtttcaccatattgaccaggctagactggtctcaaactcctggcctcaggtgatccgcctgccttgcctcccaaagtgctgggattacaggcgtgagccactgggcctggcctccagttatcgtgtttttgatacattttagaatgttgcagttttggcaagcactgaacagtcagcatgt

SEQ ID NO: 210421 - DNA, 225 bp, Homo sapiens
ggtgaacagacaggatttggcttcttaagttgcttgggagaagccactaaacatttctctgccttagttttcccacttgtaaaaagagggtactcaccccaaccttgtcaagttggtgtatcccttaaggagagtcatatataaaatcaaaaagacaagtcaggccaggcgcagcggctcacacctgtaatcccagcactttggcaggctgaggcaggtggatca

SEQ ID NO: 210422 - DNA, 206 bp, Homo sapiens
ctcagatatccatatggtttgtcctatacttttttcaggtttctgtccaaatgtcatcccatccaagaggccttccctgactactctatgtaaaatatacacccctccatcaatctctgttcctttatactttgctttttctttatagcagatgtcaccatctgactcattttttatatataaaaatgtttaactgtctttccttg

SEQ ID NO: 210423 - DNA, 490 bp, Homo sapiens
aaggtaaatgtttcagcaacagagagactgctgtaccacagacagaaaacaggtgtagcacgtgattattattaagaagaaacatgaataaactcctttaactaaaagagaaagacaaaatctcagacaagacacattctaagaacatgtttgagagactcccagaatctctaaccaagacgattgttcagactatgccaggacaaagctacattataaagattgtgacaggtagccttttttaatgtccaaatttcaatcaaggattacaatgtatacaaaataaggcaatatggttccataaaaatataaaattttaaaaaagaaactataaaaaagatgtatacacaccgattttaaaaattgaaaataaattgaataatactcagtgagtgaaacaggaagacagagaactatagaaaatcagaaaaatgaagataagaacataaatatttagaatatcaaaaaaacaaattgtggaggtaataaa

SEQ ID NO: 210424 - DNA, 461 bp, Homo sapiens
agagttaagagagcaaatcaagacatgaaaatgatccccccgtggaatatgcccctgctattgagagaataaactactgatctacgcaacagcatggatgaatctcagagacattttgctaactgagagaagtcagacacagaagacatagtcaatgattccatgtgtatgaaatttctagaaaaggcaaaactatagagacagaatggctgatcaatgttgtggctgatcacatcgaggcacagaatgatcaatggttgcctggagctgcgggtgggaacaggagtgacctcaaaggagcaaggggaacttttgggggtggatgggaatattgggaaactggactgtgatggttgctaagtgcgtcagttcacggaaacctatcacactgtaccctcacaatgagtgacgtttatggtttgtaagttagacctcaataaagctgtttgtaatcattttaa

SEQ ID NO: 210425 - DNA, 500 bp, Homo sapiens
agctttgtaagtcctgctgccatgtaatcctgtggcagatgtatttggtgatagaagtatggaaaatgtgagtgcttgcattttctctgacctggatgcatctgtgctaggaagtggtgttttaagtaaccaaggttgtgttaaggccttgacttaacgttattaggggatttctacatttatactgccaagcacatgggtgtttagctgttggttatgggagccacaggtgtgctggtggatggatcagtcggtgcttctctgtcactgctactgcgtaagtagtgcagaggttttgttctgattatgtatcattatatctttgtagtccatatttaaaatactgggccttgagtagaaggaactatttagaaatgtcatagctcaaaaagcaaatgcaaaacagtctttgttttagaaggatggtttatccctgttactcctgtaagtctcggtattctaaattttcatgttttcattgtagtgtcttggcggctaga

SEQ ID NO: 210426 - DNA, 405 bp, Homo sapiens
tagaggatccctaccttatggctgtagcatctgcatcattcacaatagctaagatatggaaacaattgaaatgcccatcaatggataaacagatgaaataaatatggcatatacacacaatggaatactactcagcctcaagcagaaaattatgtcatattcaacaacatggatgaacctagaggacattatgctaagtgaaataagcataagccaggcatacaaaggcaaacaccacatgatatatggaatctaaaaaagttgaactcatacacgtagagagtaccagaggctggagggagtgggttagatagagaaaggaggtgccagttaaagggtacaaggttgtggttagacaggagtagtaagttctggtgatctattgcatagcatggtgactacaat

SEQ ID NO: 210427 - DNA, 462 bp, Homo sapiens
ggcccagcttacacccattcaggcccacagcttctccatgtaccagaggcgatattcatctttattaaaattttatcaatcttttaacacagatgaaactttggatttgcttttgcttctcaggaatagagcattcattctcagttcaggcttctacagcttaaaacttgtttctgacataacttgatcagtttataaagtcccagagctttaaattacaatgcaatctgagatattcccacagcaataacagcgattacatttgttcacagcacttacctttatatttcattaagcttccaaatactgaataaaggtaagacaaaccaagaaaagagacttctattaaccctgacatcagcaaattgtctcaaattatagtgtaccttctatttgtattctagacatattgaatggtttttgtgagatacatattgtacctcacctgaggttaggagaaaa

SEQ ID NO: 210428 - DNA, 461 bp, Homo sapiens
tggctccgcagtgaaccactacataatgtatcagggccatcttcctcaatttccctcataaaaataatacctgcttgctgtaaactacaccaacgagtcacctatgtcacagcccatttcccatttctcttgccccaattccaatcctcagaggaaggtagggtaaacacataattcaccatccaaagcagttcaccaaacactgaaagagggtactattaataattataccagaacaacaggtgtaaaccagatatttcccaaacaaaccgagacatatggtcacccttctcagaggtagccacagggaacatatccttgttgttccagatctttttttatttttaaggcacacacaagcatacccaaccaggtcagcagtagctgtgatataacaatgggatcatcctatagatgctgtctcttacttttttatttaatatatcatcatctgtttacat

SEQ ID NO: 210429 - DNA, 334 bp, Homo sapiens
aaccaaaagggaaaaaaaggggtgtgtagagagaagagacaatttctaatagaatattaagagtgtaaatgagggagtatatgaaaactgacaaaaatcaagagatttttatattccatttttaagtttgacttttttttttttttttttgagacaaagtctcactctgtcacccaggctggagtgcagtggcacaatccaggttaattgaaccctttgcctctggggttaaggcgatcctcttgaataagcctcttgagaggctggaattaggggcccgtccccccacaccaagttaattttttttggtttttaaggaaaaaacgggtttttc

SEQ ID NO: 210430 - DNA, 444 bp, Homo sapiens
aaagaagggcaggcaggcctatataaactgtaatttattaagtgattcctccataattattaaatcgttaatcagcagcttggctgtgggtgcggggaaactgttctcaggacagaagggtgggagatgggattcaacccttcttaagaagggctgtgggggggtgcccactgggatttccaaagtcagccccagagttgccagcctgcagcatggcaccaaggagctggggtttgggtgtgtaaaagagatcagccccccaaagtttccagcatgatgaagccaggccacacaccattcacagccattgctgaaggaggggaaaggaaacatggggtcagcagatcagggtcatctaacatggtgctgacctgggggaaggggctatccctcccttcagggtcccaggccactcaagagaggccccatgggcctagacacttc

SEQ ID NO: 210431 - DNA, 201 bp, Homo sapiens
ctacctggggatttgcaagacagggaaacttggaaagaggggctggagatagagttaaatccagggaagactaaggaatatggtggagaataagttcctaatgcatagccttccacttgggagaatgagctaggccttcctggagacatcaacaggacaataccacattcagatgtcagcgtttgatgataccacgaaggt

SEQ ID NO: 210432 - DNA, 430 bp, Homo sapiens
ttcgttttatattcttctgcaaagccatgtcaaacaaaaagttggatggagatttggcaattccttggttattttgaaaaatggatatattgatcaaattgaatgggtaccaaattttctaattatgcaaataattgctaagtcttcaatgtagcttgcttaagaagtactgcccagagaaggggaaatgaagagtttctttctcacttgggtatacaatgagaatttgtagagagctgtaagcacctcagccgagaaatgatgcagaaggagaaaacgtgggctgggtgcggtggctcatgcctgtaatcccagcactttgggaggccgaggcgggcagatcatgaggtcaggagatcgagatcatcctggctaacacagtgaaaccccgtctctactaaaaaatacaaaaaattagccgggcatggtg

SEQ ID NO: 210433 - DNA, 458 bp, Homo sapiens
caggaaactccttagtgatattttatgtttgaacgttctttatctttgaccctgacgtatacccaccaaaatcattgtatcaggattccatcgcatgcatttcaatggattattataaggaggacattacaagaagagcattgtaaggaggacagacgtgtgttcactgacctaacaaaacaacatgggattcaagcctcagctttgtcacttatcccgagacctgtgacttagggccaatcatgggaccctctggtgactcagtttccttgaatgtgaagtggtatgatgcctgcagtacttatctcatagaattattataagacaaaaccagagaagcacatgtgaatgcatttagcaacatgtaaaatggtttgccttgggaaacattaaccacagtggccatgctgcattgcctcacttctcatcctgtagcatcacaaaagggaagttactta

SEQ ID NO: 210434 - DNA, 830 bp, Homo sapiens
ctactctctccacttcccatcctttactccctggattttaaagctagtttaagatttctgtttctatctgcaaatacttctgtatctaatctttaattttgaaaacagaaatttctgattgcagttgctattaaagccagtcagttctcagccaggtgtgccaattaaaaatgactgttagcaggagctaaaggtccacccttctaagagatctccaggtattccttaatggtttgaatcaatgccgtcggtagtagaggcaaaaagaaggcttctcttgccttttatgcaaggctacttccatttctcatctttgttctgctacaggtttttaatctggactctagaataaagtgtgcaaagacttatatttcggcttggcacacttttcttgccagccagctgggattcagtctacatatcctgccaaatattgagataactacagcataggctcttaatttgcctgactggttttgtagccaataaatttttttaatttgcttaaagctgtaatgagtatttgtgtaagttagagggatggtattgtcaggagattttgaacttggatttagaactgaaggtgattttttagaaagggaaatgttttattactgaaagtttaaagtaggacaggaacttgtgatctgagatgagattgtcattggataaagtacagatgatatgaggattattattattttttaagtcctgaaaggatagtatcagcaagagttacctgcctttatttattgaatgtatttgttgtgtagaatatatttaaatcataccgaaaatcaggctgggcaacagaacgagactctgtctca

SEQ ID NO: 210435 - DNA, 2027 bp, Homo sapiens
  misc_feature (1641)..(1641): n is a, c, g, or t
gtttgggtggtgaacagggatacagcaggcctcagtgaccaggcagagcccagtgaggtcaggcatggacaacgcacgcacattgggatgggaaggcctgctgttaactgggagagagaggaggaggaggtatggggatgactcccaaggaagggctttgcctaccttgatgggtttgctgggctgcgcctcagaaactggaggtcagtgccattcccatcagtgttcctactgccaggaaagtcttgcagtggctggctggccttcctgttcgactttctttccttgctcatcaaaacactttctctcccagcatcaactctacctgctccttctgcttaccacgcattccagtgactctgcccggttccaccggaagcggagttattttggaaggctggatggtgtacggtagggtggagggagccagaacgggaagccttggatggtggaaactcctctatcaccagggaacttggctgcagccccaagccctggcctcccaccagagcggggccgtccactttctccttctttttttagtactatcctctctgacccgcccagggctgggatgttgcagtgtgtttttccaagagacccggcaaacagcaacttgacaggttcaacggttcccattgacagcctgaatggactcctctgaaaactacgaaactggacacaaaaacagcccataaaaatcctgcctcccgcaggcgtctggacgctgccttttcccaaatgaccctccagcagcacggatgctgcatgggtggctaagcagcattttttgagtgattttcccaaaactggggtgttccaagtggtgtgggagtattattttttcccttgcagtaagagactaactcaccagataatttgagaaaacgggagactacatgagtcatgttactcccaaagctaatcacttgccactgtaccccaaagcctccatgaaccatgaggtgccccgggcctgcctgttatgaggtctggaactcactttaatataccgcagggaaggcagtgtgatgtttgtgtgtgccggtgagtttaagcttgaactcgatgagtgctctgcaaactttatagcacaaaggccactctctcaaggcagctcctacacgtccttctgccattgtgaccttgacctacaatccacacttcgctaatcagcatatcaaatgccaaaagcattttattagtgaaactggtaacttgttaattagaatgataaatagaatgctgaggaaaaagtaaacatcaattctctcatccaaaataaagtaatcacataatctagtctcggggacagctgaaaaattttatagtaaaaacagtgccggggagccaggcgcaatggctcacacctgttatcccagcactttgggaggccaaggtgggaggatcactcgagtccaggagttggagtccagcctgggcaacatagtgagaccctcccccatctcaataaaaaatacagaaattagctgggtgtgggggcatgtgccagtagccccagctacttgggaggctgagatgggaggattgcttgagtccaggaggttgaggctgcagtgaacaaagactgtgccactgcactccagcctgggcaacagagggagcccttgtctcaaaaanttaaattaaaaaaatttttaaagtgcagtgtacatataaaatggaatattttaatcatctcccaggttctcattggaaaggcagggttaaaaggaaatggaccaggccaggtgcggtggctcacgcctgtaatcccaacactttgggaggctgagtcaggcggatcacctgaggtcaggagtttgagaccagcctggccaacatggtgaaaccctgtctctaccaaaaataaaaaaattagccaggcatggtagcatgtgcctgtaatcccaggtacttgagaggctgaggcagggagaattgcttgaacccaggaggtggaggctgcagtgagccaagattgcgccactgtactccagcctgggtgacagagcgagactctatct

SEQ ID NO: 210436 - DNA, 496 bp, Homo sapiens
acataatcgtggagaaaacaagggttgttttaaagcaaagatcctttgttataattgaaaccctgccatgaacccaagtgttgctgtaaagccaaagtctacctagtaagacaaatatacagtgtgtatttgcttaaatacatctaaagaaattgcagaacttactgtatatttatataaataaaatggcaaaaacaagctgaatataatatgtcattataatcttgataggaaaaaatgattgatgctttcacgtgttctttttttgctggttatcagttcttttttataaattgcttttgaaaacacacttgagatacataattgaggaaagcaactctaaacataaaagtagaaattaatgtataatttcttaattaatttatgaaacgaatatcatttgagccaattctgggatttttgcattatagagaatacaggccaaatttccccaggaattttctaaccactcttgtttagagaatgctaagaggtt

SEQ ID NO: 210437 - DNA, 164 bp, Homo sapiens
actctttcttcctctttgccatcttcagtaccacataaaataatctgggaggaacttctaatgaatcagactccataaggaacaaaggaaaaggtgccaacaaccccttttgggggtcttcggtcttcctgtggaatttaaagaatcgtaggcagattcttctc

SEQ ID NO: 210438 - DNA, 424 bp, Homo sapiens
taggaaactatcagaatgcctgtgtatgagactctcttcaagagtggtccaagagaggagagaatcctacttggagaaagaaggtggtagcattggacaggcagcagaggagccctcagcagcaagaaaggagctaagagaccctgtatctgtccctcacccttcagagctggtgccccaaactcaaagccatcatcacattggatggagcccctgcctcaggtttagtcacttgatcctatttgaggagaagcaaagatatctgtgactcatgaagagcatgaaggtggtggagggacttgataattaggaaatcaaaatgggcaagaataatgtgtgcctacaaatgggacatgaatttgaaggaaatttaagttaaatttgctgccacacatgatgatcaggttcagtaataattgtattt

SEQ ID NO: 210439 - DNA, 522 bp, Homo sapiens
cattttcgtaatgatgtatcaagtggcacttaccatccacccctttaacacccaaaccattctaatccatgtatacagaccatcatctgttttgttattgtgttctataatgcagctttgcgagttatgcagttttggtcctcatgatatttttctgattggtttttaatgtattttgttctaacgagccaacattgttatacatgtaatttgtttatttgctagattgtactctttcccaaagatgggctatgaactagcatctactttcattttacctatttacctgtaaacattgaaaaaactgaatcaaatgcagtgatatcggacctagttttattgttatgccttataatgaatttaacttcacagttttctaaatgagagcatttcccaaagtgctggtattataggcgtgaaccaccgtgcccagcctcccccttgtcttttctaacatttatggggcacttattatgtgccagatatgctttaaattctttacatacatcattacgaaaatgc

SEQ ID NO: 210440 - DNA, 544 bp, Homo sapiens
gtatgtgtgtttatatataattttatatgtatatgtgtgtatgtatatatacacgtatatgtgtaaatatacgtatatatacacgtatacacatacatatacgtgtatacgtgtatatatacatatatacatatatgcatacatatatatatacgggcaaagacttaatatactatccacaggctattcagattgttcaagaggctctcagttgaagaagcaaacagacaaacaaaacggtttcatacacaggcaggcatttggctgagtaggtcggcaggatatggaaacttgctttgaggtgtttttggattctcacctagaattctactacttaatggctgtgtggcttctttgcaggctatatactgaattcataaaggatgttatgagagtaaattcaaagaattctgatgttttgaaatttgttgtgacttggttaactatggtgaaatgttacattcgtgttacattatggcttttgtttatacgggtctgattatgggataacttaataaagttgtaaaaaactctatgtttttca

SEQ ID NO: 210441 - DNA, 519 bp, Homo sapiens
ggtaaagggggaggggtgggaatttaagctcattttcttccccaagtatccaaaggtctcctggatggagaagagcactggagtaaaaaccccagtacaaaccttactggggacagtgggcaaccttgtcgggttagtaaaaacaaatggtgtgggccctggaaaatgagggctggaggctgtgaataaagcagtggatgtgtttgttcagtacaccaacgggaagaagtacccagatgggaggagtactaggggcaggagaaatgccagacagactctagtgccagggcaagaaggaagatcattttgtttgcagaacagggagggcacagggatggtgctaacttgttcttgtgatggctctgagctcctacctaacaatgagaaagcttgctccttcttcccttcctggatgacccaggagccctgggctgggatgcagtgacctcatttccagccccttcccttctggtgatgaacctccctatcttcactcagaaaacagacttggattagagg

SEQ ID NO: 210442 - DNA, 355 bp, Homo sapiens
cgccaaatgtgaaagctgcagttcgctaatggttcctattaagctttggagaaagagtagtggtgtggtgggtgtcacatacctggagctttagagccttctgagaagataattcggtaaaaatacatcattttttgattggtgttgaaggaagttgtttttcgttgcacagattaaatttaaattgttcatgagagctaaagagcttgaaagcatttctttgttttctaatctttaaaagtagagaagagtgagctggctatataatatagaactttctcggctttactttaccaaagcagtctgatttaaaaacttaaagccaacatatttcacatttggcgagtttaagatt

SEQ ID NO: 210443 - DNA, 413 bp, Homo sapiens
tattattccagtttttgttatctaactatattcattgctgtgttttatttctcttactctctcataatctatttttgtagcatcaaaatacagttgttccttaacacaggggttaggggatgccaaccaccattcctcaaccttcatgtagtcaaaaattcatgtacaacttttgactttcttaattactaatagcctactgtctagaagcctcactgataagtaatcaattaacacgttttgtatgttttttgtgttttctttttttaacttttgcatggtgtaggagtatgggggagtctcgtaaaaaccagaaaacctgctagacaaattctaaaacagccgtaacactgatattttgtgttatatgtgttatacactatattcttaccataaagtaagctagagaaaaa

SEQ ID NO: 210444 - DNA, 313 bp, Homo sapiens
agagaggcaaggtgatgacctttggagttagtgtcaaatttcttcaaacacagtgattaacctcctccatgggaggaacagatatgggtgatgccacccaagttttttggggggtgtgagtggcactgagagcacagacagtgaaagtgggactcagccttgctgctccaagtgtagtccatggtcagcaggatccaaacccctgaaagcaggttagaaaggcagaatctcaggttccaccctagctgtactgaatcaaaatttgcattttaataagaaactctggtaattcattgcacatttaaagtttgag

SEQ ID NO: 210445 - DNA, 512 bp, Homo sapiens
taaaaccttaattcaaaggagaaatagataatttcaagaggtatttttatgaggtaatagtaaaatatattttattaacagtacctatagttatgtaaaataggtagtgccaattaactgacactaaactagcttcttggcctggcgcagtggctcacgcctgtaatccaaacactttgggaggccgatgcgggtgtatcgcttgggctcaggaattcaaggccagcctgggcaacatattaaaaccccctttctataaaatatacaaaaattagccaggcatggtgtgtgcctgtagtcccagatactcaggaggctgaggcacgagaatcatgtgaacccaggaggtggagtttgcagtgagccgagatcacgccactgcactccagcctgggcaacagagcaaaactctgtctcaaataattaataaataaactagcttccttttcaaaaaaagaaataaattaggtcctaagtcctaaaagcccatcctactttaaaattgtttattc

SEQ ID NO: 210446 - DNA, 469 bp, Homo sapiens
catctatgcaaaatggattatatggttgaacatcttaactattcttgcaacagacccctataatccatttcaccctatccttttctctcatttgccaagcaagccccaagcatatactcaagttgtagtcgatgttaacctgctagagaaatgacaagtggtcatgatagtgccatttcaatttcagtctccaacctcagctgagtcttcaatctgacaatacttttcttatccttggccagctcactctttcattatctggagtaactattccaggacttcatcactcccttcaaactctacttcatcacagcccaacttactgaagagattatctttcctgctcatcaaaaaaaaaagttaatccatgcagtacactttccctcagctttccaattcccacttataaacttctctacatcagcctaggcaacacagcgagaccccatttctacaagtaaataaataa

SEQ ID NO: 210447 - DNA, 389 bp, Homo sapiens
ttgaaagtgcattgttttcctataaaaatgcaaatcgtatttaagattttcatgtgaattgtgagagtctaaatagtttctgcggcataaatgcatggtttaatggtgcctgggttgtaacagaaaagtgtttgagcaaaaatcataagggaaaaatgattcatattttatgtctgtctacattagacctgctcagggaatagaatttgggaaacacataataaataagaaacctgcatgcttgattgaacatttgctttcttcactatcaggacacgggggcatatattttaaggcttttaaaggcatttgggagagattttatataggccataaaatgcattacccctcaaaaataaaaatcactgaagaatatagttggctcacag

SEQ ID NO: 210448 - DNA, 188 bp, Homo sapiens
cattaagtgttctatatacaaagccctacatggtccctagagcatagcaggcattcagtgaatgaaatgaatgaatgaaaagctagagtcacattttagtgacctaactgtatattttcagagtaatgtagtgcttaaaaaaggacaatgataacacgtttctacaaagagatgcatgacagataaca

SEQ ID NO: 210449 - DNA, 413 bp, Homo sapiens
aagaaaagaccaaattgctattagagagattgaaagctctagagggcagcatgttgacttcagttaagttttacctggttgggtggattccattgtcatcggtgtcttctggctctcagggcctttctggaacctgaagctgttggcaacatctgtgctgtccaccctgctctgagtctgctgcagatgtgttgaaaaggtgactctctccactgggaaaatgaaaaactttatgaccggcaacatcatttttacagccaagtgaactcctttgataaaatattcctcttttctgagcttatttccttcctgtgtgtaaagaggggtttgggcagattgtaagctttctctcagctctttgcatctatgttatcacacttcctcactatacagaaataaatatccttattgcc

SEQ ID NO: 210450 - DNA, 512 bp, Homo sapiens
agtatcatcttataaataagctatgatgccttccattagcatcataacttttgttaactgttcatctaaggactcataaatttcccacactcccagggccaagatgctgtctcactccaccctggcaacctcatccccatttcgtccccaccccccactattctaaacaaaatcagagtctcttccaagtttttactgaaaaatttgggtctctgggtctcccttgggcatgacagctcaggcctgtaatcccagcactttgggaagctgaagcaggaggatcctttaagcccagcctgggccacatagtgggacctcttctctattaaaaaaaaaaaaaattctttttaaatttaatctggcatagtggcatgcacctatagtaccagctgcttgggaagctgaggtgggaagactgcttgagcccaggaggcacaggttgcagtaagctgtgatcccaccactgtactccgtgacagagcaaggccctgtctcaaaagaaaaaaaaaaag

SEQ ID NO: 210451 - DNA, 601 bp, Homo sapiens
  misc_feature (469)..(469): n is a, c, g, or t
  misc_feature (474)..(474): n is a, c, g, or t
  misc_feature (490)..(490): n is a, c, g, or t
attaaatgcctcttctcttttgtccaactcttctgcacacactttaaggggctttccctggtgtgtgtcctcttttgtttagccacccggaaattgaaatgcttcaggcccttttcattcttacataaaaccttggctgctttttctccccaatatttggaaaagtcgaggtatcatgtgagctgccaagcgcaccggggtgggaattggaaaggatccaaggccctgttatttcttcccactccttcccagctcactgtgaacttcttgcaccaactcctaatatttgtagaagttctctgagatgttttccctttgcaccctgtcccttatacactcaaagagtcgaattccaaaattaatcaccaacatatgcagcttctaagtttatgcttttcaaacaggtgtgtgtgcgtttcctgccatgtgcaggggacatgaaagagcacgtcagcatggcacctcctgnagcanggattccaggattagncaagttggaggttttagatggctggcatgctgctgtgccctgcactatgccacctctgttgcagcatagtggacagccccatgcatgccttcccgagggctcatggctctc

SEQ ID NO: 210452 - DNA, 320 bp, Homo sapiens
tgaactcctgacctcatgtgatctgcccagctcagcctcccaaagtgctgcgattacaggcttgagccaccacacccgtcctaaaatacttttttaaaatactgaattcacatccttcatagatagtggaggttccccctcatctcctgtgagaatttgtttcacaactgagttttcatctggtacatttttctgtaaggtctatattgctcactgtggtagccatctcaaaaatggcccccagtgataatgacctcctgatatttacccccttgtgtagtcccctgaaaaactatcaagattgggctatgtggcctggc

SEQ ID NO: 210453 - DNA, 187 bp, Homo sapiens
tggcttagaataatgagaatagttgtggagagggagccaaatgcccaaatttttggtcagtgtgtgctcagggcattgttagtgacaggaatgaaggagagaggtggtatagctgaatggtacaagttttgaaagaagtgttttcataataatttggaagaataatggtctagaggaactttgggga

SEQ ID NO: 210454 - DNA, 478 bp, Homo sapiens
tcctgctataagccaacttctttcccacaagacagtacaggacacagcctacaggaggaaatagaagtcctgatctttctctttcagtatcctgtgctgtcagaggtcactttagctaggcttaaaaaccagaaggaaaagaatttcaggatggcaaagggatgggcatggtagtggtaagacgatgaggtgtgaggggcagaggaataagaaatttaatggtttttattcagactttattatttgggcatgagccattggtgattaactcaatctccagcccctttgccctccctgaaggttggggaggcaggaagtccatccctctgatcatgccttggtctccattccccaaaccccatcctgaagctatctagggcccccaataccgagtcatttcattagagaaggacattcatcactccagaaattccaagggtcttagaagctcttgtgttagaaactggggactaagacc

SEQ ID NO: 210455 - DNA, 392 bp, Homo sapiens
gttgttttgcttcaagtcacagtttccaaaaatctattgacaatgttaagtgagagctttctctactttcatatgcctgaacttttatgaccacactcctactgcccccttaaagttagttagaggtggacatcttgcaaaagggtactccttgtagatagacatatgagcccaatagaagggtcagaatctgcccattatcactattgagaaagtaaattacaataacccaagggtggactattttgtcctcttcatgggtgcaatttggcaaatgatgttttagagaaatcaagtataaattaatatcaactgttttcatctttattttctagggtgatttgattattgtactgagtaaaacaaataggcactggggataagtggtatgt

SEQ ID NO: 210456 - DNA, 410 bp, Homo sapiens
cagaaaagtggtcaaattagacttaggatcggtagaagacaaagaagaagggaagttggatgaaaagaaattagttcatcagtacaaaaacacaattagatagaaaaaataagttctagtgttcaatagtatattagtgaggttatagttaacaatagcttattttatatttcaaaacagccagaagaattgtaatgttcccaagacaaagaaaagacaaatgtttgaggtgatagatatccaaatcaccctaatttgatcattacacaacgtatacaggtatcaaaatgtcacatgtaccctcaaaatacgtacaactgttatatatcaatacaacttaaaaaataaagaaaaagaaatagggaattaccctacttccttttctttactctctagcctggacaaagaat

SEQ ID NO: 210457 - DNA, 228 bp, Homo sapiens
gcacccagacagtcactgttttctagttcagtcttacctttttcccgaattctcacaggacttctttatgctacttatatttcatttgtcacaggccaccttattcagtagaatacctttggcatgactatggtttgttttcttcttctctccctccctgcaggattctgcatatcctgagggcagagactactcttatttttttatcccatgacatccacatagagt

SEQ ID NO: 210458 - DNA, 411 bp, Homo sapiens
ttgctaaccatctgctttcaggtgtattttcatatgccaaagtttaccttagtgccactctgaatgacctaacaagcatgcaaaggaattgaggaaggtgaaagagagtgacactgtattaattactagtctaagaccctgttttaaagaataacccaagaaaacataaaattagaattcaagtcccagtcccacagttttccctgggcataaaatacttaaaaataaaaatgtgaacgggcaactacacttcactagtttcctcttagtttttaagccaactcagtagcctgccttatctcattctaaaccttctgagagcagggactttgtttttcctttctgctatttccacagtagtaagaacagtacctggcatatggcaggtccatatatatggtagaaccgact

SEQ ID NO: 210459 - DNA, 612 bp, Homo sapiens
gttctgtgcaagaacagccatttgggaacatgatggatataagctttttctcaaacatggtttccttgcaattttagctttaccacataacctgcccttctccacctccccttccaaagaagacttacttttttttttcaattctgaaatcaacttcttagatctacttttccttacctttttctatcatctgcctccagaactggacagcttttatgcctccttcttacgctatcattctttgattccaaatattcccgagctttagatgtaattccaaggttgttcccacatggagtgttgaaattcctgtttcacccctgctaactcaaactaatacccccagtcatttcatctcaattcagagccctaggctgacatactgtcacgtgttctcccaaccccaatatgagctctataaaacaatgttgaaacagacactggaaaagttcccaccaggagaaaatgaagtttccttcgcaccttatttccatgatgtcttatttatttttcacaaaatcttttagtctccctctatacccaagtgaatagtgggaactcctgctgccctctgtctgccactgatctttctttctctgttgtcccttggtg

SEQ ID NO: 210460 - DNA, 475 bp, Homo sapiens
tgcccaacagtagtccattgtatggatataccacattatatttattcattcataacctgatggacattggcttgtgtcctctttggcatatatatatacacacacacattatatatatatgtatatatatatgaatgctgctaatgaacattcatgttcaagattttatgtgaacatgttttcatttctgtagggtgtatacacctaagagtggaattgcgggtcatgtggtaattccacgttttactttgagaaactgccaaacttttccaaaggactgtcactagtttccattcccactagcagtgtataggggttctgatttctccacatcctccccaatacttgtctcattttaattacagccaccctgtggatatgaaatggtgtctcactgtagtttcgatttgtatttccatgtgcttactgttcatttgtatatctttagagaaatatccaaattctttgcccattt

SEQ ID NO: 210461 - DNA, 121 bp, Homo sapiens
gaaggccaagaagggatatgatcaataaggctgatcatatgtttggagcaggctgtgcccgtgcaaaggcatctgactgagaaagtggatccgagctcagatccggcccatgcccctctaa

SEQ ID NO: 210462 - DNA, 425 bp, Homo sapiens
cccccaccccgccccccatgcaccaccctccccagggctctctccgcagaccacagtgagctgcagggcaaggcccggctgcgggcccgggacgtggtgtgtgttctcatctgtattgagtccctgtgccagcgccacacgtgcctggaggccgtctcaggcctggagagcaacagcagggtcttcacgctacaggtgcaggggctgctgcagctgcaggctggacagtacgcttctgtgtttgtggacaatggctccggggccgtcctcaccatccaggcgggctccagcttctccgggctgctcctgggcacgtgagggcgcccaggggggctggcgaggagctgccgccggatcccggggaccctcctactgatgcccgtggtcaccacaataaagagccctccaccctccccaaaaaaaac

SEQ ID NO: 210463 - DNA, 532 bp, Homo sapiens
gccgggtggacaagcggacgctggtggagctgcatggtttccaggctcctgctgcccaaggtgccttcctgcgaggctccggtctgagcctggcctcgggtcggttcacggcccccgtgtccggcatcttccagttctctgccagtctgcacgtggaccacagtgagctgcagggcaaggcccggctgcgggcccgggacgtggtgtgtgttctcatctgtattgagtccctgtgccagcgccacacgtgcctggaggccgtctcaggcctggagagcaacagcagggtcttcacgctacaggtgcaggggctgctgcagctgcaggctggacagtacgcttctgtgtttgtggacaatggctccggggccgtcctcaccatccaggcgggctccagcttctccgggctgctcctgggcacgtgagggcgcccaggggggctggcgaggagctgccgccggatcccggggaccctcctactgatgcccgtggtcaccacaataaagagccctccaccctccccaaaaaaaac

SEQ ID NO: 210464 - DNA, 312 bp, Homo sapiens
cctcttgccctgtggggctgtgttcaggtgcctggaggccgtctcaggcctggagagcaacagcagggtcttcacgctacaggtgcaggggctgctgcagctgcaggctggacagtacgcttctgtgtttgtggacaatggctccggggccgtcctcaccatccaggcgggctccagcttctccgggctgctcctgggcacgtgagggcgcccaggggggctggcgaggagctgccgccggatcccggggaccctcctactgatgcccgtggtcaccacaataaagagccctccaccctccccaaaaaaaac

SEQ ID NO: 210465 - DNA, 664 bp, Homo sapiens
cctttaagaagttaggtggtaagattggaaatcatttatccaaagtatggaactctgagaattaattagaaacgtgaattccttttttatttttttataaaagcattacaatatttaaattaaatgcctgtttataactataaagcatagcagcattttagaaaataagaaaaaggtccttaaatttttcccctcacgaggatctgtgactttttgtattccattatgttgtttttatgcattaatgcactaattttaaagatagtttaagctgggcatggtggctcatgcctgtaaccgcaacactttgggaagctgagacgagaggattacttgaggcctggggtttgagaccagcgtgaacaagatagcgagaccttgtctttacaaaaaaaagaaaaaaaaaaaaaagaaaacatggtagtgcaagcctatagtcccatgaatatatgtcctatgaatatatgaggtattattagtacctcgtatattaataataatcacctcaggaagtgtcagaggtgattcaaactccagcctcccaaatatgctgggaggctgaggcaggaggatcacttgagcccaggaggtcaaggctgcaatgagccgtgatcgtgccactgcactccagccctgggcaacaaagcaagaccctgcctcttaa

SEQ ID NO: 210466 - DNA, 304 bp, Homo sapiens
ccaggcatcctttatgtatgtgtactggaaatgcccatcactattgaaggtggcctttccagctgctacatctcccagctaagtcaaaaaataaatttaccaggactttgcctaaccaatctaggtaatgaagtcaacatccctccttccttttcctacccacactgcctcacagaatttattcaggtgccctgactcaggccttcatctcccagaaggatagaggtcagatactctgaggggacacatgggaggtacctgagcaggcaattatgaatcacatttctaaataacaatccatgca

SEQ ID NO: 210467 - DNA, 465 bp, Homo sapiens
agaacccacaaatatggagggcttactgtacttgtttcttctgcctgtaatgcttctctccagatatactcatgtcttcctcctggccttcaaatttttgctcaaatgtttcctattcaataaggccttttgaaagccattttactttaaatttttcatagcatttatcttctaaatattataaaaacaggccatacggccaggcacagtggctcatgcctgtaatcccagcactttgggaggccaaggcgggtggatcacgaggtcaggagattgagaccatcctggctaacatggtgaaaccccatctctactaaaaatacaaaaaattagccgggtgtggtggcgggcgcctgtagtcccagccactctggaggctgaggcaggagaatgatgtgaacctgggaggcggagcttgcagtgagctgagatcgtgcctctgcactccagcctgggtgacaatat

SEQ ID NO: 210468 - DNA, 498 bp, Homo sapiens
agaaggcctggtagcttctacttttaactcttgggatccagttgtcatataaaaagcttaaggtagaatacagaataatgagagagcacatagagagagtactggatgataacacaccagatatagtgagaggccagatggagaactaggccttcttggatattccagctccagccaaactcccagttcagtgcagctctatgagtgactccagtgacatcacaaagagcagtggacctgcctggtcaacccacagaatcatgagaaataataaattattgttttaagtcaaaaattttgggggttttgttacacagtagtagacaactggtccctttcaacctaaatgactcgatctttttttttttttgagatggagtctcactctgtcacccaggctggagtccagtggcgcgatctaggctcactgcaacctctgcctccccagtttaagcaagtctcctgcctcagcttcccaagtagctaagattataggca

SEQ ID NO: 210469 - DNA, 605 bp, Homo sapiens
aaaccttatgaatgtaatgtttgtgggaaagcctttagccatcgtaaatcccttactctgcatcagagaattcatacaggagagaaaccttatgagtgtaaggaatgtagcaaagccttcagccaggttgcccatcttactctacataagagaattcatactggagaaaggccctatgagtgtaaagaatgtggaaaagccttcaggcagagtgtacatcttgctcatcatcagcgaattcataccggagagtcatcagttattctctcctctgccctcccataccaccaagtcctatagattcaatctcgtaaatgcttctagcatccatctgcttttttccagcacatgtcccatcatcatagtccaagacgcaaccatctcatctggatttctgcagtagcataactgttgccccttttgcttctatcaactacatgtttaacactgtaggcagcctaaccttttaaaaataaaaatacataatttatgttattttcccatttaaaacacttgatttgaaaaatatattaactaatccatttcaaggatttagcacacactggcatatagttattgctaaataaatgctagccattaaggta

SEQ ID NO: 210470 - DNA, 589 bp, Homo sapiens
cccaagaacaaagccaacatgatgaggatggcaggacagaaagacggggagaggctaatccttattgaagtcagtcattggctgagctatccatggatactacctccagacttcctttgatgccttactgcctaaactacattcaggtgggtttactcataccctagccaaagcatctcagtgatacatatatatgctcatctatttctaaatctccaacaagggtaaggaagccttttaggtcagtggttctcaaagtgtggcccctggaccagcagtattgacatcacctggaaacttactagaaatgcatattcttgggccccatccagttcttgtcaatctgaaagggaatgggtgcagcagcaatcgtgctttcacaagcactccaggtcattgtgatgcatgctacagtttgccaacctctgctttatatactactctgttgtcatactgatatcagaactgaccactgggagtgagagcaccactcattattccatccaacttacctttttctatcattgcttcatttgattctgctatccctaaaacaaacaaacagaaaaacaagaaaaaggacaaggaa

SEQ ID NO: 210471 - DNA, 533 bp, Homo sapiens
tagttctctatttacaaaatcataatagtttttagtatgaattagcctatgggttaacatgcgtgtgtgtttgtaaataaataaggtcattcaatatatgttctgcagcttgcttttccactgaatatatgcacattcttagtgatatacatttaaattgtttctagtattttgctgttacaaataaggaaaaattattttaaaaaatatatcatgtacatgagctattttataagatttctagacatgaaattgctaaaataaagaatataaacatttcaaattttgatggatattcctagataaacttcttacaagtcttctctaatttatactcccataagcagagcatgaaaatgcctgtttctatatgtccttttcaaacctggatatcattcatatctttttaaaggcatgagtgaaaacctccttaatgtaattgcttctcttaggaagtttatggtttgctgagagtatctctgtggactgaggtttctcacccatcttgtttttaaatgaacagagttacaatg

SEQ ID NO: 210472 - DNA, 518 bp, Homo sapiens
gtgtgtccccaccagcagggcctgagtatttgtctcccatcccctgctagcacgaccctcttctttctggtagaggagacagtaagacctgtggcatccccaggccctctatgagtcaggagagagggcatggagctgttttcctgctctgcttgtggggctgggtttctgaggcccatgaccttggcttcatcaatattttctctagcctgtcaagaaaagttgaacttcagtgaaatatatctcagaaatttgccacaaggagagggctagggaaaacctaactaaaagatgttagaaaagagaggccaagtgtatcccaggttctgtgtccagtttcttttagtccttcatgaaggtgactgagctgttttagaaataacatagttcagccaggtgcggtgcctcacacctgtaatcccagcactttgggaggccgaggcaggcagatcacttgaggtcaggagttcaagaccagcctggcaacatgatgaaacaccatctctactaaaaataca

SEQ ID NO: 210473 - DNA, 431 bp, Homo sapiens
atcttggagatcttttcacatcaatgaattagtgtgccttcttgatgacttacatcaatgctgccaaggatatatgtctgtcacctccagttttttagaagcaaagggagaatatggtcttaattttttttgccacttctcagttcgtttgttgattactaataggaatagacacaaagaggtaatgccacctgctgctcctttaaagcaagaagttgggaagaagagagctattcattctgtgctgtgccttctgcctaattcaatttggcttagatttgtgttgccttttttttcttgtaaataggcccctgattttcataataatgttttgtttctcagggatgccttcgaacaaacactggttatctgcttggtttttctgttactgtaaatttggattttaataaaaataaaattttcctgtcttt

SEQ ID NO: 210474 - DNA, 410 bp, Homo sapiens
aagggtttttttgtttgtttgtttgtttgtttaatagatgaggtctcactatattgccgaggctggtctggaacttctgggctcaagtgatcctcctgcctcaacctcccaaaatgcttggatttacaagtgtgagccactgcacttggccttcaaaattattataaaaaggaatgaagcccagtttagttgcagaaaattgaccactttttcatttttgtttctagaaacattcatattgtagaacatattgtcaatcacccagattctctattttttattcggataaaagaggattgctgcttatttcacattattttctgacattattttttcatttattccttctatggctttattcaattggatagatatagaaatacaagaatctccaagtcaaatatcaaggc

SEQ ID NO: 210475 - DNA, 551 bp, Homo sapiens
tcacttcataaaagatggtgcataaaataccaaaaaagcaatgatataatctcagaataatggacagaccatcacaaaacagtctgattgttacaccctttccacttttggcacacacacacacattttgattttttttgtttatgacagcttagtaacctttcctctatggtggagaatttggggagcattttttcatatttatcttaattgaagtagtcttagagctagctagttctcaagaaaatcttgattctacctttagacacatcttcatcccatctttgtctggagatagggtgccattatttgactaaagtgtttatgttaatgttcttaatttcatagtgtgtcaaccttgtccgttcttggtaatcaaagttttatggtatactcctagggtgaaattggcattctacattcttgacagaatataatcttatactctgtcctgttacttacagaatttcacttgaacatgtattacagatgtagggattaatattcttaaattggcagtttttaataatgacaaaatggaatacacaatc

SEQ ID NO: 210476 - DNA, 333 bp, Homo sapiens
caactcagcttagatcaacagactttcctgaaattggctttcgcacctcaagagtagatacttccatctcaagaaggatctctgagccatacgtccagctcaagaagcatctctgagccttaggattcctgggactttgtgagcagggagagcagagacttccagaaagaagacattagcttgcaccttctctagcccttctttgccaagttactgggacctttcccttgcaggttgtgacccacttagccctagagtccaccttgatacagtgagacacccagtggaagcctcagccctcctggtaggtgaagcctggaggttcagatgccc

SEQ ID NO: 210477 - DNA, 411 bp, Homo sapiens
aacatccaaaggaaaatagctataatttttctgtgttttttttcttttttgccagggaggaaatgttttcctgaagccctcctacctcactctttgtcttatttatctgagtcataggagaaccagcctttaaacaaattaagaagttttgtttttgaaagaagcaggaaggaggtataaaatgaatagtgggtaggcagccaacaatgtctgcacataatatttttttcctttcagaaatgttatcaattggttttccaagttttctgggttttttttttttcatctttataatgtccttttctctgctgagacttgccatttgtttttttgttattaccatttttaatagaccttgaacatatttataatgctgattaaaattcttgtcagctaatttcaatatatggg

SEQ ID NO: 210478 - DNA, 350 bp, Homo sapiens
atacagaaaactatcttcatgaccttgcagtaaggaaggagttcttaagcaagtcataaaatatactaacaataagggaaaagattgttgttttgagcattaaagttgaaaatatttatttattaaggcaccattaaaaggcaagctacaaatgtcaatcaaaaccacaatgagattcctccttacaccaacgaggatgtctagaatcaaaaagaaaaacaataacaagtgttggtgaggatgtggattaatcaggactgttatatactgctggtaggaatttaaaatggaagaatggctgtggaaaacattttgagttttgctttgtggcaagccacaaagtagaaaaa

SEQ ID NO: 210479 - DNA, 592 bp, Homo sapiens
aggacccatcacctttcccacatcccagatcctaaaagtactgggagggtctcatcaggcctcagggacctttgtgggaaatgcatgggaggctgtggagaagaggaaggaagacaagggactttaaaacctgggctgcaagaccccaaacaagcctcctcccctctctggggcccttcaacttcacctgcaaaatggcaataatgaaacaaccttccaagagctgtatgtcatgagaattcagtaagacagcacactgaaagcatgcagcacatgtatgcctttagcaaatgttacccttgtccccctgtaccttctccatggatgccccttgctgtctcctgtgccaaacatcacctcctcagcgaagccttcccacacttacctaggcaattctgctgagttcccacagcaaaatattcagatttttataaaagctttctgtatttttttattattatttttttaaagagatggggactcactctgctgcccaggctggagcgaatgatgcagtcatagctcactgtagcctcaaactcctgggctcaagcaatcctcccacctcagcctcctaagtagctgggactac

SEQ ID NO: 210480 - DNA, 590 bp, Homo sapiens
aattgtaattagaaaaagcaacattatttccagctgtcatcagaattttctactagaccaggtgtgctttggatctcttaagggatattataaataatgtagaataataatgctgtgccattcagacttctcttttatgctcatcacccccaaataggctccttggcgtcaccgttgtttacggcgtgctgacagtggccacacccaggtgaaagcttctggagttacactgtgtacttctgtgtgactctgagctaggtggggccatctgcaagtgagataagctgtgtgttacctggttagacgaaagcctgtgacttcctcaggggagtcgcccggtacacaaaacattgagcaaagaagtccccgtttgcagtggtccagttagagatgtcttgctccttgctatgtttgccttttgaggaactgatctagttcatggctatccagaaaataattggattttttggttgtactttagtaaatctgccagtatctttaatttcctagaaaaatgtaagtcataatatattctgtcatttttctccagtgtaggcaacgttatcgatacccatgtgacttatgcatgg

SEQ ID NO: 210481 - DNA, 493 bp, Homo sapiens
aaggatgaagttggacccttaaccttgccctgcatgtaaaaattaactcaaaatggattaaagatctgaaatgacaaaactcctagaagaatatgtaagggaagagcttcttagatttgattatgatttatttgatatgataccaaaaactcagacaaaaataacagcaatagagagtgggagtgtatcagactaaaaaactgcccagcaaaggaacaatcaccagagtgaaaaggtaccctatacaatgggagaaaatatttgcaagccatatatccgattaggaattaacatccatcatatataaagaactcatactactcaacaacaggaaaaagaaaagtatttaaaaatgtgcaaaatagtgtatctccacagaagttatacagatggccaacagtaatatgaaaagatgtgcaacatccctaatcattatggaaatgcaaatcacaaccataatagtaaatgaattatcttacaaccatttggtcac

SEQ ID NO: 210482 - DNA, 223 bp, Homo sapiens
aaatgtttgtacactaatacacaaatttacaaaagatattatacaggccatgtaaaacacccatggcaggttgaatttggatttggggccccacatttgcaatctcttctttaacagatttgctagaatattgtggttcaagtgcatataactaacatgttacatggagaactacttctgagattagtaggcacttctaaaaaataatgggggggggggtgct

SEQ ID NO: 210483 - DNA, 154 bp, Homo sapiens
cgtattgcaagggtgtgtgtgtgtgtgtatctgcctctgtgtttagggagactgtctggagcccagagtggcagccacatgtccccagcacttgggacccgggagaaaattttggggtatctttcctgagtggctctgggacggtggtttaggg

SEQ ID NO: 210484 - DNA, 320 bp, Homo sapiens
aggggttacacacgtgagccaccacacccagctgacaaggttttttctgcacttagaattatttaattaggacagaggctggaaagtggaattaccaaggcagaggcctgggatcttttgcaggcatttgatttcaatacctatggccaattggtttctgaagatggaatttagcacatgagaaggccacaagccgggcacgggcacgcccgcctagactgccatgttaagtataccactcacagtgaggtatctttttaatgtgcccatgtcctgttacctttggtagactttattcttctctggctgttgggtgtcca

SEQ ID NO: 210485 - DNA, 590 bp, Homo sapiens
taaaaggggccagtatgaagttcctctgagttcctgctctcttggagcacggctcctatcacacaataatgtgttattttgttgaattttggcatccttctagcttgtttggtcagaagccaaaaaattagagtgtgtcggtccaccagtttctcagcagagaagctctcttctcacccagcgagtgtgctgtacccttggcctctggccaagaagggaaatccattttacataaagaatgcacaaagctcaagtgctcagagactttttacctactaaaataactttatggacaaatgccagtctgctagacacattcagcaagaacatttggcatgcaaaacaaggtaaagtactctgtggaggtagcaagttttttagaaacaaggaaatggctgtgcgtgccctcgtggcatgtcacgtggcttggcactgccggctgattggctgcggccgagtaaatacagccgccatgtaaggagcggaacgtcgcccttcactggctccttaaaatggcggcctgaacccacaccaggagaagcaagccgagtcccattctcagtttcccctctgaagttttttgttttttg

SEQ ID NO: 210486 - DNA, 470 bp, Homo sapiens
gtcacatcataccacatgccactgccacgccaagaagtggatttagtgttgtaaaaaagtatactatataattctgcagtattggaaagatagaaacccaataaaaatatttctgttaacagtaaggcgtgattttaaataacctgatgtcataattaataaaatgtaaaatgactaacttccccgaagtgacaattgcataaacacaggaagaaaaatgtgagtaaagcagaataactgtttaatttgtgtgcgctcattttgacaatatctattcagatgaagtctgcctagttttgcttccgctgcatggattcacaagcttcctttcagctctgtagttatacttttgaaaacataaaaggctttgttcattctttgaggagggaaatggggaccattatcatagaaaatgtgattttttttttggcgtgacttgagatataactgaatcatccccaaaaagactg

SEQ ID NO: 210487 - DNA, 151 bp, Homo sapiens
gaggttaccaacttcacaaataatgggtttccatagaggatgtcatcttgaaaaacacaaacatagtttcatgtgtttcattgggcttcacattgcagccttttcatctatctacatatcttggagaccctttcctgctgattcctgtagg

SEQ ID NO: 210488 - DNA, 494 bp, Homo sapiens
agaagacaatcaaaatgaaacaaagcggggatggtaaggacagctaaaaaaaatcctaaggctgctgacacacccagataactggtagctatagttatgcctgctaagattggggtgtttggggcttggctttcgttagctcccttggtcttattttcccaaaaaagaaacctccaggttatgggcaccttatttagtctaatcatctggcaggatttgcagggtaattgcccagaactagaatattgatccagatttttacattactcatcccttttgctgcttctgagctgcagccagagattgctggttggttcacaggaataagcagtgttagtttaaaatgtgggcaaaaacttaaaaacaacgaatgagtctaaaatctaatgacaaatatataagtcttgaaacataatttctctccagttctcatttttgttaaaaataaatcatgataggactgagttgtttgcaaaataaactttagtcttgta

SEQ ID NO: 210489 - DNA, 398 bp, Homo sapiens
aaccaaacttggcttgaaggtttctcaattgaatgtgaaacctgtgtatatgaagggctgactttttgtatatgcaggttctgcaaggctgacagaattttaaaaattcatatttttaaaaatatgaatttatgttgctattatttttacccataatcctcactatgtgagttctatgggacacatgggtgtggggagccgtgtggaactaatcccctatgtataccaagggacaacagtaacttaattccactgagatgtagaaatgttactccacttcctctttccctttttttgtgctattgttgttatacataccaaatatttatattctacaaacccaagaatacattgttacaattattactttatgtaattttgtgtctattaaagatgga

SEQ ID NO: 210490 - DNA, 555 bp, Homo sapiens
acacagtggagaaagaatgctttttaggcttcagccagtttttcttatcacaaagccctcacctacttcttgtttcatatagaattcttccagttacccagtcacttaaaccagaaacctgtgagctatcctacactttctcccttatatagttggttattcagtcctttaataaaataatctttaggctgtgtacagtggctcacacctgtaatcccagcactttgggaggccgaggtgggtggatcacttgagcccagaagtttgagaccagcctaccaaactagcaagaccccgactcttaaaaagaaattagctgggcagggtggcacatacctgtatagtcctagctacttgggaggctgagatgggagcatctacttgaacctgggagtttgaggctgtgttactggtggagggtgtccaggttcttggcatcttgaacaaagaactggacaaaacacacagacaaagcaaggaagggatgaagtcagagatttattgaaaatgaaagtacactccacagtgtggtggcgggccctagcgtaggggctc

SEQ ID NO: 210491 - DNA, 213 bp, Homo sapiens
ttaagatattttgctattgacttctagaatttctatgtgcttctcttttatagtttccatttctctcctgaaattctctgttcactcatttagaccatttcaattaagtttttgaacatattttcctaactactttgcaatccttttctgctaattacaacatctaggttatcttaggttctatttctgttgaccacttcttcacaaattgag

SEQ ID NO: 210492 - DNA, 468 bp, Homo sapiens
ggagctctaccagctccttcccaacccccgacattctcaatgcaacgtccctaaggtgggagtcaacatggttggctcaaggagcagagtaacaggaagagagtggcaggtgatgacctcagaaaggttacaagcacccagatcatgtagggccctgcagaactggtaaccacttggcttttatgctgagtgagacgtgaaataattggagggctttgagcagatgcgcgatgaagtctggtttcaattataacagcattcctccagctactatttgagaatagactgtgaggggcaatgacaaaagagggagacaggagattagtttaataatcccagcagccaagttcggtggcttacacctgtaatcccagcactttgggaggcgaggcgagacagaaggatcttttcagcccaggagttcaagaccagcctgggcaacatggtgaaaacctgtctctacaccct

SEQ ID NO: 210493 - DNA, 213 bp, Homo sapiens
accatggggctgtgggggaggaggccctgtgcagggagacctgaggtgcccaagagaagcctggcggggtctccacactcctagaggtgttcccaggctgggctcctggaggacctggacgcccaaacttctctgcccagcacagatgtgtccactggcaccccatcccctgccttgctccctaaagccaggcacgctgggcggtgctgctgc

SEQ ID NO: 210494 - DNA, 751 bp, Homo sapiens
catcttttattgaattgtctaattgatttgtaggacttagaaatattaagttaaactatatgacctaccatttctgtacatcaaaaatggttaaatatcataatttcatattgtttatcctaatatatatgatgagtcctttgtcagttatatgtattgcaagtattttctcctgctgtggtttgcctttctactctcttaacggtgtctttaatgaacagaagttctaaactttatgtagtataagttatctctttttctttatggcatttatctgtccatgaaatgaatggagatgaggacaacatctgaagttgttttatgtagaaagtgcaggaactgggcctctcccctgctgctctgatagatcaaattgtggttaaatcaagcagacagatcacagaagacccaaccataggtggaatagaatgtgcttacagtaggttgcggttgccaccccaggatgtcttccttttagaggaagtctccaaggacaattctgaaagacaaaagtcatgatgttcttccctccctcatcctcctgtgatctgaggtcttccctcctcgggtgctgggttgttgctcttcctgcgcctccacgtattctgggtatctcattccagtagcactaacttcatgttttcccaataattccttagtcacacctgctcgccggaacggcagggcgctataaacctgcggcaaacctgaaccggcgcctcagccgcagggggagcacacggccgcgccc

SEQ ID NO: 210495 - DNA, 448 bp, Homo sapiens
cacacatatatatgtatatatacactttataatacatatataaagttataagtagagcaaattgaacatcctaaatatgctttttaaattattggtgtcactgattagctttgaaagctgcaacatttaaatttcttatatcttgttcttagttaagataatgaagcctgggaatctttattagtaatatcaccatgatattattttagttctatttcctttaccttattgcataggttgatcacagaatagcagtatccacccgattcttttgcatttattggagaaaataggactgacaagtttcttctgtagctttagatattttttatgaaaaagtataagattggctctggggcaaaatctgctatctaaaaccacctatttactaacatctgggttagtactaaagccatctatgctgctaacatttacctgtgcttgcctt

SEQ ID NO: 210496 - DNA, 534 bp, Homo sapiens
ctgtcagaatattaatgcatgtccaagcacttgaactaacttatcattaaggtcctagaactgcctagctctgtagaatgtttctgtaggattcatgaaaacttttgtggaagtcttaatggtgtttaccacatttaaaaatctagattaggtcatcttttcccccctgttaaatccaactgaaattctgaatccagttaggaagttgcagctagcaggggctttcagttgtgctatgtatttggcaagaaagttcaagaatcggcttgtttttttctaagacatgttataaattcattctaaatataaatgacatttgcagctcatagatgctgttttacccaaacattttttaatttaattaagcatgcttaatatgatatatcaatgtattccttattaagaaaacaagggaatgcggctgggcccagtggctcatgcctgtgatccagcactttgggaggccgaggcgggcagatgacctggggtcaggagttcgagaccagcctggccaacatggcaaaaaaaaaagaa

SEQ ID NO: 210497 - DNA, 421 bp, Homo sapiens
gtcactggtaatactttggtggctacgaaaccttttcaaaaatgccttactttgccagatctgagtaggagggagatgggggagactaaggaatcttttgcatgagccctactgttgccacgtgcattggaattgccctcattttcttctcgtggcatccagagacttgtcacttaagaggtttcaaagtgacatttgaagctgttcaggatgagcagctaataatagtagaaagagtcctaggcttagagtcccaagacctgcattggaaccctggctggcaacttcctagctgtgtgtccttgagcaaggcacttaaccttcctgatcactcatcttttagatgcagaatgaaattaacactctccctgaaaacccaactgagagacaagtttatttgtgttaaaacaacaacaacttg

SEQ ID NO: 210498 - DNA, 625 bp, Homo sapiens
gtactcgttttgaaacaaaaccccaagctgctgatctgactttaaccaaattaccaacacatcaataggtaacttggtacccatgctttcagaagctcatccgtggcactggacatcactcactgaatcaaaatgagaaatatatcaatatcataatccagtttttgaaatctagtgagtcttaagattaaggctaatacattcaacaaccacacctcataagccaggagttcaaatcatgtttatacacagttaaactgtatacagaatagaagacatataattaaccactaaagctggcagtctccaaacaagaggtgaatgtgttacctccgagtttatgattcattattatcacaactgacagctagctttccactgacccacactttctcatgagctgcatagccgaaggcaagagaacactgtcactcctttacttcaagaaatcggtttacttgtggtattcttgtggtaattcctcctcaaacttatataaatattactatatatgtgtgtatatatatatatacacacacgtacacatgttacatacttctgtttcattcctgtgtgatatgaaataaacaaatatacagattccttgcagtattggaacaatgat

SEQ ID NO: 210499 - DNA, 191 bp, Homo sapiens
atccttttcagcatttcttcatagaaaagtaattatctggctacttatcattaactaaatataaaattattttcaaataaatatccttgaccacacagaattttgttagtgtagcattatatgtaaatttagctctataattctgaattttcagtttattttaaaattttgagatattattaataaactcg

SEQ ID NO: 210500 - DNA, 181 bp, Homo sapiens
cacttcagcttgtgttggggaaatgcacaatgcatactgtacacaccccacacggcgctgtcacctagaaagtcactgaacacaccacacagacaatatagtcaccatgcagcatcacactgcaacaggacacaaagacacacagcaactacacagctcacagactcacgcaacgcagaca

SEQ ID NO: 210501 - DNA, 506 bp, Homo sapiens
aaggattggggtaccggattctttattacaccaaattacatcatcccttttttttattgctatcatttatttcatgataattgcctttcattaagacaaactcttcctgttaataaacattatttcccagaatactcaaagttttactctttggtctggcactgactattttttgttctttggtttgaaccaatatagaaaacggaaaggtggcccatcacagggcaagaaagtaatgatgtttctaaatatgtcttattctaagtcagatatagacactcttggctatgctgttcaaagtggcaattagtatttgatatattcttaatgatctgctaattcttgtaaagtttctattttatgatccactaattcttgtaaaatttctaatgtatgcagattattaaatgctgctaataattttccttgtagaaattacaacatatgaagatatttactatatttattacttgtaatccaactatttaaaaatatctttaaagtga

SEQ ID NO: 210502 - DNA, 244 bp, Homo sapiens
caaattagtcccttccactatatatccattcttatttcccaactcaagctgtcctttctagcttgaattaacgcagatgctccctgagatccctaactgtggtctcccctctgcaccaatttatatttcatactatcactgattagttttcttttaaaattagtaatttaaaaaccccactgatgttgttttctactcaatttcgttggttccatattttacacaaaataaagttcaaattcct

SEQ ID NO: 210503 - DNA, 637 bp, Homo sapiens
gaaatatttttcctctgtttattatttttgaaatatttttcctctatcatttttgcaaaccatatatcgccaggtttacatacgggtccaaggcaccttctctcatcattccagagaaaaatgaagtatctcccaacagaaagtatatagcttcactataattcatctgtgtgcgagacagggaaggggcatattataatgggaaggaacagattttgacgcacctgatccatatttgaattccagctcagccagtagcctgctgcatactcctgacttctctaaacctcggctttcacatctgtgaaacagggcccacactatcttagaaagatatagtaaagattacaaacaaggccgggcgcggtggctcacgcctgtaatcccagcactttgggaggccgaggcgggcggatcacaaggtcaggagaacaagatcatcctggctaacatggtgaaaccccgtctctactaaaaatacaaaaaattagccagatgtggtggtgggcacctgtagtcccagctactcaggaggctgaggcagcagaatggcgtgaaccccaagaggcggagcttgcagtgagctgagatcgtgccactgcactccagcctgggtgacagatcaagactccgtctc

SEQ ID NO: 210504 - DNA, 202 bp, Homo sapiens
ctccattcatgcaacaagcttgatccatagcaccaaccaccaccaagagctctgtgagtgagtcttgccttccccacttgtattagtccattctcgaattgctgtaatgaaatacctgatggtcgtcccatcagcggattttatacattgacctttgttggttataaaaacagagtcaacgagtgtacacaatgacgctggt

SEQ ID NO: 210505 - DNA, 409 bp, Homo sapiens
gcacctttatttactctgcctgaaaccttgagacaaatagaaatccatcattattatgctgctgggctaagattttctgttataaacactttccttttttggcatttaaggtgaaatccacattagagcttttctttgttctttctacctaattttctgtagttttcatctgttattgggagcatcctcactagcaaatgctcagaatgcatttatcagacagtatattagctttaattagttcttctaagtttggtcagctacacattatcacttcattaaatgaaggttgtgaaacactgatagaaagtttatttacaaaataatatagggaaacatacatttagtttgaaaaaatgagttttttccccctgagatacacaacaggaacatattaggccatactgag

SEQ ID NO: 210506 - DNA, 133 bp, Homo sapiens
acagagcttcccaaggaagttacatgacctcgccttgggatattcagaaatgctagtcaagttctggcagcctgaactcttcctcctccaagctgaaatccgagagatacccttcctcctcttggccatactg

SEQ ID NO: 210507 - DNA, 476 bp, Homo sapiens
tgtaatattaacaatgtcccatatctaataaaaaattactagacattcaaagaaacagtaaagtatgatcattagttacaaaataattagttaatagaatagatcccaaatggcagagatgtgaaaataccagataaaaattttaaaacatcaattataagtctactcaaagatttactgtaaaataaacataatgagtaaacaaataattctttagagagatactactgaagaaaataccagaaaaattaaatatgagtagacactatacaaaataagaaatgttgaaaatttgaaaacattaatttaaaaagtaaataatatattacacagtctgtttgaatttgggtaaagaaaaaatgtttgtattttggtagaaaaacaattatgttaaatatcaagaaataattatttctagtttatttgaatttgtaaattttggctttggcacatttcctttgcatcaagcatttagc

SEQ ID NO: 210508 - DNA, 490 bp, Homo sapiens
ggaaatgtatttggacatccaagggagagaaggagagggcatccaaaaacaaaaggaggaaagaaggaaaccaggaaggtagggcaaggttaggcagtgtggagggcaaagagctgggtcaacattttaaaacaaggaaggctgctgcatgattctaaattacgtgtggggcgacgctcactgtggcttgctcccaaagggaagtctgtcatgctcccagatcttcatgtatgtgggtctcttgggggtggagcagcaatggactgatttcacttctgggccatgtgaagtgaagagagagagagggttactggatttgcacctcgagaacatagggtccctcagggactcatagcaatctttgcaggagtgaagggggctttggaatggggattcaagccattctgatagatcttaagtgcccccagttgacatctggctcatgcttgttaagtgcagagcatctaataaactcagagaaaactgttga

SEQ ID NO: 210509 - DNA, 563 bp, Homo sapiens
atgcattgtgtgcactgacctgttcctgggcatgagcctgaattcgctcttgcccctttgttgggaagcagaaacgtgtggggtttcgcagttactttctttagtcccctttaatctctagctaatgctgagcttctgcagagccagaagggtcttagggcctactctggaagagcctcactcccattctccttattccctggagctcttctggatttctagcctgtgtctgtcttgttataatcacagttttcatgttgtgatccagtctttatccttgctccttagagctatctactgagccccttctgtgtgtattacgcatgtggtagacatgaagacagagtaatgccgtatcttaagaaatgtcacagtcttaggtggggacagagtttaattatgcagtgctcagtgaaaggtggatctgagtacctgatggcagcatggagtcacaaaggaagcattctaggctagtcttagaggctggtgctctgagaatacgtcatgcggtgggaagagggttatgcccatatgagatgtgaaaagtgggtgggagagggcgt

SEQ ID NO: 210510 - DNA, 210 bp, Homo sapiens
ctggccccccgccccgccccccattaccccactcactggctccctggatgctctgtggctgggatgttagcgcccccatcatgccccatcacccacaccgggctatttcccccaccagcctgaaagcccccaggagtggcggccactgacttttttcctgtagcctcagactcaaaggaggcacttaataaatgcacacagaaggactga

SEQ ID NO: 210511 - DNA, 688 bp, Homo sapiens
aaaaaatatatacttcattaagaaacatggcctttttagctctcttctgagttgaaaagcataactaatattttgtgtgtgcttaatttatataaaattatgaacactacatttacctgtaattagagcacttattataaatagttagagctattgaggccatagccagtatctttttcaactttgcaaaatgaggtgaatagtcactaaatatttactgaatggatattagtgaattcaccttgtccattatgtgcctttgaagagagagagcaagcaagcaagagagcgcacacactttagttcatcactttaatgttttttattatttatttttattttttatttattttaagttccagtatacatgtgccaaatgtgcaggtttttacgtagggatacatgtgccatggtggtcttctgtacctattaacccatcatctaggttccctccccttgcctctcacccctcaacaggccccagtgtgtgttgttcctctccctgtgtccgtgtgttttcattgttcagctcccacttatgagtgacaacaggcagtgtttggttttctgttcctgtgttagtttgctgaggatgatggcttccagcttcattcatatccctgcaaaggacatgatctcatttctttttatggctgtatagcattccatggtgtatatgtaccacatt

SEQ ID NO: 210512 - DNA, 577 bp, Homo sapiens
atgcatctgaatgcatttccaaagatgattctgcattcaaagaaataccagatttaaagaccataatcataaagggcacaacaccgaataattctttatatattcaaaataattcactgtctgattttcaaaacattccagtacaggacagtttaggaagttcaaataatcctttgtacttaactagctcgttggaaaatatgactgttgataatttaaatgctagtaaagaaactgaagttggaaatgtttctttagttgaacaaagtgccaagaatcacacttttaaaaatgataatttgcagttttctcagtgtgaaagtccatccctaactgaactgtttcaggaacacaaagaaaacaatataagccagtgctttactttatctgacctttgtaaccagtcatctgccagtttcacagatctaagtttgggatcctttcccctgtcacaattagcaaatcgctgtcagtcttcacccggaatatcagaattaacaggatctctgtcgtcattggcatttcataaagcttctcccacaagagaccttgagaatttgtcactttctgaattgat

SEQ ID NO: 210513 - DNA, 345 bp, Homo sapiens
gactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactgatgggagaagactggccatcttctcccatcaggatatgtctcaaaaagtttaaattatagaaaaaaatctgtaaatcccaaagaacactacaactcagcattaatcctaaaactgttggggttatctcttttactagtgggaaacatgcagtttactgtgcaactagccaaaggcctgctaatg

SEQ ID NO: 210514 - DNA, 408 bp, Homo sapiens
cttctccacctgccagaatgcatcagagaagactgtcaccaaattattcccccattcaaccattagtgttgccacatctataagcataatgcattaaatttacaccatgctcacaaatactttccattcccccacttctcagcattgtagtgatcaccgtttttgtccccttcctctgcctcccccatcctaaaccctgccagtactgctcctggtgagaaagtggcaaggagacactaagaaccccttcctaacataccaatgtcccacagcacgtatggagaaggatgaccggggcacccattagtcaatgatatatactaagctagtgaaagtaaacagtggttatctctgatggtaagtttatgggcaattccaaatttcttttaatgcctctctgcatttgcc

SEQ ID NO: 210515 - DNA, 164 bp, Homo sapiens
gctgctagggaaagacaccaaatgtataaacactgacaaaacatgctaacatcaagagagggcaagcactcagattggtgcacacaggaaaacacagggcgaaaatgtggcataatttctcaatttttaacctaagtcttaccaatcaactcacaagaatagct

SEQ ID NO: 210516 - DNA, 425 bp, Homo sapiens
catcttttaaatttttctttgattctttctgcctcatgtctttatagacatttaatttcaatcattgagttttggatttttctatccattttaccttctcctttttctacctgttgttgttaaactggaaaacaaaataactattgattagcatctctgtcagagaaagagtagtcacagataaagaggagaggtgaaatttttgtttcttgtttatttgttcaaattatatttctattataaagtttaaactgttggctgcattaaaccatgatttgggtatgtagcaatatttttcataaaatattattttcttggtggtgccctcacttgagtgatgattatattgtttccttctgaattctgtagaaacacaaaatgagtcaataatcagagccttctatgtatcttcttttgttgctact

SEQ ID NO: 210517 - DNA, 460 bp, Homo sapiens
acaaatgaaactaaagctcagaagagtactgtgacttagcaaaagcaactgcagcagagccaggataagaaccaggtttttaaattctaaatctgccgttcttgtatttacaaaattgtctttaaaatatacttcctcggtgaatagtgcagatccactgattcctatgatactttatcaataatataaatagtttaaataatttgaagttctggagagatgaagcatcaaaaagtactcttgtagggaaaccagttcattattttggttttctataaatcttctgaaaaatatcactagaggttaaaaatcattactaacaatagacagtcatctctttatttctactttttcttccctgtatttagagactgtctttttagaataaccagagtaacatctagaatttgtagtgtgatggaaataccagtcaaaatcaataaaatataattctcacata

SEQ ID NO: 210518 - DNA, 362 bp, Homo sapiens
tgatgcatgaggtgatctagaggatcccgactgcatctgtgcctcccaaagtgctgggattacaagtgtgagccatcatgccggccaatagtgtattttcatagcggttacattatattagatattataagtaatcaagagatgatttaaagtatacaggaggatgtgtataggttaaatgcaaatactgaaccaatttattttacatcaaggacttgaggatccttggattttggtgtctatgggagggaggtcatggagccaatcccctgagaatactgagggacagtttttttttgttgtttgtttttgtttttgagacggagtctcgctctgtcacccaggctggagtgcagtggcgc

SEQ ID NO: 210519 - DNA, 525 bp, Homo sapiens
ggagcatcattgctttgggccaatgtaacaaactgctcctggtttactccaggggattcttgctgccttttcggtgtatgttaaaaatgctgctgctgattgaaataatttagcatctgtttcactgaacagtgatctctgaagttgcccatgtgtgaacacataatttcctctctttgtggacaattctgatggtctctgttgcatctcttgtgtacttaaaaatgggatccacaggccgggcacggtggctcacgcctgtaatcccagcactttggaaggctgaggcgggcggatcacctgaggtcgagagttcaagaccagcctgaccaacatggagaaaccctgtctctactaaaaatacaaaattagctgggcgtggtggcgcatcctgagatcctagctcctcaggaggctaaggcaggagactcatttgaacccgcgaggcagaggttgtggtgagctgatatcgcaccactgcactccaacctgggcaacaagagcaaaactccgtctcaaaaaaaa

SEQ ID NO: 210520 - DNA, 318 bp, Homo sapiens
agcccaaaacaaatgtgtgggattggttaagcccggagatctttaaaaattaacatcatttggccaggcatggtggctcacacctgtaatcccagcactttgggaggccaaggtgggcagatcacttggggtcaggagtttgagaccagccgggccaaaatacaacaaattagccaggtgtggtgatgggtgcctgtaatcccagctactcgggaggctgaggcaagagaatcacttgaacccaggaggcggaggctgcagtgagctgagatcgtgccactgcactgcagcctgggtgacagagtgagactctgtctc

SEQ ID NO: 210521 - DNA, 347 bp, Homo sapiens
gagaaagcacaaggggatgattttgcttacaaactgctgttccaagagaaaccgatggcacagaattaccaaatctgacttgattgtagtagaagaggaactcattcactgaacaaatatttgctgagtgcctaccaagtgcatggcattgtgttagctgccagagatagacggtctttgtccctaaagagcacacagattagtgggtaagagtgcaagcatcatatcaccaaactccttgaatagcagggtgagcaatttatatgtgttaaggtcagagggcaaaggtggctcactgaatatttttgagcccagaagttgtattatcagagatacgaattaaaaaa

SEQ ID NO: 210522 - DNA, 564 bp, Homo sapiens
tctcagtagaaggaacattgcaagtagaaagagccagcagtaaggatgcacgtagcagtctagaagtagaggtgagaccagcttggagatgaaatgaggagatgtcttctgttctgtgctggagaagtactggtaagtgtggtgtggttgggattcacaggcctcagccatcctcactttggtacaagttattttggtacagaactactagaatgtcccaaaggctgtagtacaggaacatttctgaaaggacaaaagctgccatgaatattgagaaattgtatggtgccaggtacagcctggatctgagcaagactgctggatggtgtgtggatagatagtgaaggcccagatttgggaacagattggatctcagatatccagagcagcactgtagaatctagttgcatataataatgttttaaaaagggtatcttaggctgggcacggtagctcccgcttgtaggcccaggcctttgggaggccaaggtgggcagatcacttaagcccaggagttcaagaccagcctgggctgcatggcgaaaccccatctctataaaaaat

SEQ ID NO: 210523 - DNA, 303 bp, Homo sapiens
gtggggaagctgaactgacaggagatcagtgtggtgaggggtaaagattaacgggaaatatagcccaaatcaagcctgcagggtaggctggaccagtctatacagggttaggcaaaaattaaaaagtgggatttacccccaaatggttgaaaagtattggaggaggcacaggagacaacgtgtatgaccacaagttgcaagactataaatttaaacacaaatacaaagagctagtgcttttaagtacaaataataaagaacatttgggatcattgggaagtgatgtggctggagtatgaaatg

SEQ ID NO: 210524 - DNA, 238 bp, Homo sapiens
ccaacctaggattttatatcagcaaagttattcttcaaaagtgaagaagaaataaagactttctcagaaaagcaaaattatagaaatagaggacagattaggggttgccagctgtaagtgctggagagggaagcaggtatgtttataaaagggcaacatgggccaggcgcggtggctcatgcctgtaatcccagcactttgagaggctgaggcaggtgggtcatgaggtcaggagttc

SEQ ID NO: 210525 - DNA, 384 bp, Homo sapiens
taggaacattggtgttgcaacattgtgcccacagtctgggtggcctggaaagacacatgagccttgaaaggaactacaaaatcagcttcagtcccaacaaattttttttaacaccactttatcctcctctagagatgtattattgcttctgaaataaatgaaagcagcacccttttctgttttctgagtacaaatgattagtttgaatcctcatagtttgagcataaaagtaattcttttcatgtaaattgtatttatgtgaaataactactttattgtattttatcataaataaactataatggacctggtttttacagttgctttgtaaaagtacacaccaaatatatttgagatattactaacagtgcaacaagtttttaa

SEQ ID NO: 210526 - DNA, 305 bp, Homo sapiens
tcagtaaacccaacccatattcaagggggaaggattacacaggtgagaatatcaggacttggggattagtggggatcatatttagggctgcctaccacgttgaagatctttgatgttacatcttcaaattgttacctttcttctttcaggtcctgttgcacaagtagggatagtgtttcattcgtgtagtagggagtttctgtacagtgttaccaagattggtatttcataatggaagtaactttatagttgtgagttttggtgctggagagcattattcagaggttaggtagttctgttacttg

SEQ ID NO: 210527 - DNA, 111 bp, Homo sapiens
cagcttttctacttcaaagaagataatactttcttgaaggtcagcagtaatcctaattcaggtgtatgtacattacagctttcttatcttctttttctcttttctcttcag

SEQ ID NO: 210528 - DNA, 1951 bp, Homo sapiens
gacccacgcgtccgcggacgcgtgggttcctcttgaagtgactttctgcttccaatcaaagctcaagaattccacctaaaaatgtttttctgctcaaaagctcttttttattacttccatgttttgagccttgttccagaaagctgaggtttctccaggtctgaccactaatcagtgagacattggtgcctctttcttcagtgcttctagcaggcctactgataagctccctagatgagatacactgcataaaaaaatgatgcccaaaggacagctttaagtgcctgctagatatctgttctttcagaagtctctctccacctatctctccagtaaagatggacttaaaactaaaagactgtgaattttggtatagtctccatggccaggtcccagggctgctggactgggacatgaggaatgagttatttctgccttgtaccacagaccagtgctctttagctgagcaaatccttgccaaatacagagtcggagtaatgaagcccccagaaatgcctcagaagaggagacccagtcctgatggagatggtcctccctgtgaacccaatctgtggatgtgggtggaccccaatatcctgtgcccccttggcagccaggaggccccaaagcccagtggaaaagaggatctgacaaacatttctcctttccctcagcccccacaaaaagacgaagggtctaactgctcagaggacaaagtggtagagtctctgccatcttcctccagtgagcagtctcctttacagaagcagggtatccattcccccagtgactttgagctcacagaagaggaggctgaggaaccagacgacaactccctccagtcccctgaaatgaaatgttaccagagccagaaactatggcaaatcaacaaccaagagaagtcctggcaaaggccccctctcaattgtagccaccttattgccctagcattaagaaacaacccccactgtggcctcagtgtgcaggagatctacaatttcacccgacagcatttcccctttttctggacagctccggatggctggaagagcaccattcattacaacctctgcttcctggacagctttgagaaggtgccagacagccttaaggatgaagataatgcaagacctcgctcttgcctttggaagctcactaaggaggggcaccgccgcttttgggaggagactcgtgtcttagcctttgctcaaagggagagaatccaagagtgcatgagtcagccagagttgttgacctctctctttgatctttgaaatgccattgctcccttttggaacactgccttccttactgtgcctacttatcccctgacattcattaatctctaaacttacccagcctggttggtgccaagtctgtctttagctactgttacaataatggtgttaagtaaagttagaggtgggtacaggggagacagaacttaaatccaggtggagagtcatggaaagtcgcacgaggagagtggctgttgttccaaattttgagcaaaggaaaagaaatcctagaaacaatggcatagaaactaaggaaagaagggtgtgttttgtgaaagaaaggaattttgtttatagagagtattttcacacatgaaagtgaacagtggaatataaagcataaaaggcaggatggagccgagccatggagaacctcgagtgccatgtgaagagaatttgacttgtgatgaagaatcaagtttccccttctaccattcatcagctacatctcctttttaagtaacccattttatccttcagaacctcacttttctatttctggccctggacttctaagccttgtttctttgtcatccaattccaatattgacaaataattctaaacagctacttttagtttgtatgtttaacgtcctgtgaaatattcctgtattaaccccaagccttttgatgataaagctttattttctatt

SEQ ID NO: 210529 - DNA, 534 bp, Homo sapiens
acaaatctgagcaagtgggagccctcctgaagatcttctccttgcttagaataaaggtagagatctcaagcctgggccctgcttccccccaccctgctttggattccagtgacactggcctctgccatggctggggaccctcctctcccttccctcctacccatctcctactctttgcccctcaccacccagtgaagatctgctcgtcctctagagctcagcaaagtgccactttctcgaggagaaactcttccttgccttcttaattagatcaggagaaacctgatcacaagccatgctaatctttttctccatagttcctacctcttcttgtgatcatccatttgtataactgattagtgtttgtctcctcactgttgtgtaaggtccataaacacagggatatcaactggttttgtaccacttgtcctttgtacctggcatagggtttaccatgctgtagatgatcaaaaaatctacagtgagtgagtgagtgaatgaatgaatgaataaaaagactttgtaagaagccaa

SEQ ID NO: 210530 - DNA, 605 bp, Homo sapiens
tcactctttatgagagttttctttcctggtaccctaaagctactcaaagtatggtccctggggcagtagcattggcatcatcagggagctagttagaaatgcaaaatctcagatcccaccccaatctactgaaccagaatctgtattttaacaagatctccagatgactggtatgcatatgaaaatttaagaaatccctgttgtaaatcaccttttgctcaagggtcagggattaggagacactttgtcaagtcatggttccccaccctggcttcagtggaatgacttggggaactgtgaaaaatactgatgcctgggttccacctccagagattctaattggtctgaaaggtcaggtccaggaatcaggagttttagaagttccccaagtgattctaataggcagccaaggctgagaagcactgttgtacatgattcttataatttgccctagcttcttagaacacaaggtatatataagttgatgtggccagatgcagtggcttatgcctgtaatcccagcactttgggaggccaaggtaagggcatcactcgagcccaggagtttgagccagcctgggcaacatagtgagaccttgtctcta

SEQ ID NO: 210531 - DNA, 374 bp, Homo sapiens
ccaggggttttgtgttgttcagagtggtaaaggttcaaacctaggttctattttttaagtaattattaataaataaaatgatagcttaaatacgttttagaaaataatactgcttcaggacctcttaatgtaagtgaagctattagtgccagtcagatgagtgaacatgcttatgactcacataaacactgcaagcccccatgggggctttaattagtttttataattagtcatttactgttactttatacatagaatggataactgattacagacagtaagcagaagaagcaactgatgttgtgacgattatcatttgcagtcatctggtcaaaattcttacagacttttcatggtgtagataatgttttatt

SEQ ID NO: 210532 - DNA, 335 bp, Homo sapiens
cagtctaccacattttcaagattcttgacaatcaagtatcattctacttatcaagcttaatcactactattgtccagcacagaattctcagtctgataagacctatcccttttcccaatctcacttcaaatccattgcataaattcccttctacctgttgctttttgtttatttaactcccctaacagtaatgtcctttcttttctctccttccttcacagggtatttaataagcacttaataatttgccagacatccttacaggcccttaggagtaaaatgataaataagacaagggtccaccccatctctgatgagacccactttgtcatact

SEQ ID NO: 210533 - DNA, 434 bp, Homo sapiens
tggcataatatttttgaagtgtggataaaaaaacacaactgtccactactaattcttatctgtgagaactacacgtcaagaatgaagtttgaataaatgatcagcccagtgagaataagcaaagcctatttattcagagtttgctatatagcaaaggagtcagaagctcatttggatttggcagaaattcaaagccaagcagaggaggaaagctttataggaggaaaaaaagatggtttctgacatctcttgagtggaggcagctgggatggggaaggtggaggtaggataactagagcagggcatcctatttggttagttaggaaggtatatttggatttctccaattgttcctaagttagaagtgaggggagaaattaggaaacctgttagttgctgttaaagttttgactgttcagatttgtgtgccacag

SEQ ID NO: 210534 - DNA, 386 bp, Homo sapiens
ccccccactcacctctgtctagctaattccttagtccttcaggaaatctcccctgaacaccgtgaatgccagactgagttagcgccccccccaaccaacttaggtccctgtttgctactttatcatcagagacagtagagcttgatggccaagtgggacctctggcactaatacctatccactgggtattcatcctggctctgccacttgctacttataaaaccgtagacaatcaccaggcttcagtcttatctatgaatcaatctatgagacatgtagctaacagaggttggggagaactgaaggagtaaaacacaccaagagcttacagcagtcactggcacttagtaagtacccaataaatattagctacaattcatgatcca

SEQ ID NO: 210535 - DNA, 238 bp, Homo sapiens
ttatgactgcattattataaagatgaatataatcgtgcccggattcattattatatattcattattctatttacgttttccttctgatttaaattgaacttaaaatattttcaggggcctctgaaagcatcatgggcctgcagcactgtggctgctgggcctcctgactaggtcatcctgattctgcttctctgtactctttatatttttgataatgaatagacattacttatgacat

SEQ ID NO: 210536 - DNA, 362 bp, Homo sapiens
acccatccttctggatagtggagctttccagctagcttaaggtttgtccttttaaacatcacatgtggccgggcatgctggctcacacctgtaatcccagcactttaggaggccaaggcgggcagattacttgagtttgagaccaccctgggcaacacggcaaaaccttatctttacataaaaatacaaaaattagcaggcatggaggcagacgcctgtagtcccagctacttgggaggttgaggtgtgaggaccacctgagcctgggggagtggaggttgcagtgagccatgattgctccattgcactccagcatgggtgacagagtgagaccttatctcaaaataaaataaaataaacat

SEQ ID NO: 210537 - DNA, 383 bp, Homo sapiens
gaaagtttctaagacatgagctttgagccactaaaggataaggttttaaaatataaggtatgagataaatcaggaggaaacgtgaaacatgtctgcactgggaattctaccaggattttcttttgttggcatatcaacttgatggaactcatgatgcacgaggtcttcaacttccctcctccactcctagactgcactggtcaggccctggctcctgtcaaccatgctcagttccactgctttctttcaggcccttatcagactctcactggggctgttccaaaggcttcttcacaaatggcattgcagatcctctctcctcctgccaccacaatgacctttccactacaacaatagacccgtctgtagctccctattgccaa

SEQ ID NO: 210538 - DNA, 440 bp, Homo sapiens
aagcacagacaacaaaagcaaaaataaataagtgggactacatcaaactaaaatgtttctacatagcaaagaaaacatcaacagagtaataaggcaacatacagaatggtagaaaatattgcaaaccttatatttgataaagggttaatatccaaaatatgtgaagaattcaaatcaatagcaagaaaataaacagtttacttaaaaaatgggcaacagactttaatggacatttctcctaaaacatatacaaatgactgacagatatataaaaatattctcaacatcaccaatcatcagagaaatgaaaattaaaactataatgaaatgttacctcacacctgttagaatggttattatattaaagaaagaaaggaaaataacaaaccttggcaaggaagtgaaaaattggaactcttgtacactcttggtggaaaagt

SEQ ID NO: 210539 - DNA, 259 bp, Homo sapiens
agtgcacaggacacatctgaaggaaattaaaagtgctgttccagatgaatacatcaaaggtaagcaagcaaaacaaccttatgctgatgggagaagatgcgtgcgtcccatcagggattgaataaaaaacaatctcaggcacgctaggaaataggacaaaacaacaaaaaaccaagacaaagacttgaagttatttacgcatggacattaaaataattgtgattaatatgcttaataaaatagatgagaagacggataa

SEQ ID NO: 210540 - DNA, 452 bp, Homo sapiens
ggaagatgtgaaaaaagaaagggcagcttctatagtcacaagataaacatagccatattaattaaaaataaagcatcattacatatgcctttttgtagctcatattaaaatttaatttacaacttgtttgttctataataaattgtcaatatagcaaaaatgctaagtcaacaatctagttatatattcaatgtataaatatggttaacttctccgttgagaaaaacttagaaacttctttattaaaatgaaaccagtcggacattgcttttctactttatttaatttaaaggaaaaatataaacttaatgtattcttttaaggaggatttcctaaaatattgggcatagttatgtgaactctatacatttagtctgctgttattgttcttgtttataccacagagaaaggtatatgtacattatggtggaccagtaatttcaataatgaaa

SEQ ID NO: 210541 - DNA, 566 bp, Homo sapiens
ggcctcccagaagtgctggattacaggcgtgagccactgctcccggcaaatttttttccttcacatctctgctgaatgcttgtaaaattgcagcgcagatatttgtgtacgagtgtagtatttatattgaggcagaatattgcagtgtcgcccaggctgcagtgcagtggtgcaatgttggatcaccgcaaccttcgcctccgtggagtacgagcgattctcctgcctcagcctcccaagtagctgtgataacaggcgcccacacatcacgccagtctgtttagtatattcagtatagacggggttccactaatgttggccatgctggtcttgaactcctggcctcaagtgatccacccaccttggcctttgaaagtgctgagattacaggcatgagccaccacgcctggttaatctttatctttttttttttttttttttgagacagagtccactctgtcacccaggctggagtgtagtggtgtgatctcagctcactacagcctctgcctcccgggttcaacggattcttctgcctcagcctcctgagtagctgggactacagt

SEQ ID NO: 210542 - DNA, 1524 bp, Homo sapiens
ccggttccaaaattgtgatgctatactagggacctaccattaaatgtattttcaggatgaattctcaatgtgcagagcagagctgattgtatcaataagccaaaataatgtacaccttactgcttcaaagtagtacaggtttttccccttctccaggaaattgtgttttggaattctgtttattataggtaaggaatataatctatatcttagtaatagtaagaggaagtggttcttttttttggaggtgctcaggagatcagcatctagcacaaggtgaggacctgcccttgctctaggatgttttggcactaggcactagagctaggatgctgttgtttgacgtgcaccctctgcttgcagtcccagcccagttctgacttcttcagcatactaagagttagtaatacattcttagaactagagggcatttttagagatcatccagtctttccgtaatttaaagaatatgtatgataatatctaacctgagtcttgtaccatggagggtttgtatactttcattttcccagttaattcttagagtaaccttctaagaaataagaattgttgtaacattttacagatggggagttaaaacttagagagactgaggttacatgacctagtgcccgatcgattcaaacccgcaaacttgcgttcttgatcataacgctgcaattcctccctgtgcagagagaatatagtgacatgctgaaggcctatacaactacttggtattagttttgggactggaattcatcatttctgacttcgctaattatgatgtgcatagacgaccatgactcttgtttgattggtaggttgaggactagccacaaagaaagatggggagaagaagaaacaattcatgttggtagagaggagaaaaggatttaggttgatggaattacatagcctcagaaagagataggcatcttttgtgacgagactgtgaaagaagagaacgatatcagttcatgcagtattctcacacggttttgggagtacctgctgagaacccttctgagcactggggatacagtggcaaatgaaacaaaggctgatgatctctatctctatctctatctgtgtctctatctctatctctatctctatctctatctgtgtctctatctctatctctatctctatctctatctgtgtctctatctctatctctatctctatctgtgtctctatctctatctctatctctatctctatctgtgtctctatctctatctctatctctatctgtgtctctatctctatctctatctctatctctatctgtgtctctatctctatctctatctctatctgtgtctctatctctatctctatctctatctctatctgtgtctctatctctatctctatctctatctctatctctatctgtgtctctatctctatctctatctctatctgtgtctctatctctatctctatctgtgtctctatctctatctctatctctatctgtgtctctatctctatctctatctgtgtctctatctc

SEQ ID NO: 210543 - DNA, 497 bp, Homo sapiens
attttcctgggaggagagactagtgactgtcattttgtcatgtgatcattcgttgccataagtgatggggaaaggggaggtagctggaagattaaagatgggtcttcagaatactgtaactgaaggcagaaatcagaggctgttcagggcctctctccaatgggattgattgacttggaatcatcagattttagacctgatgaggggagtcttaaagatcatctgagtgaactactctgatcatctcagttatagcccagacagctgacttgcccaaggtcacagagctaacaggcaattaattagaagtgtttttttcccattctgtctctcaacttaagtgaaatatactaatgtactaacgtgacaaccatcttaagattttattccatgattttgaaatacaatgaaattttggcttttatctctattttttgctctcttttgtacttttaacaaaagtactgttattcattttttagctcccttgtctccaa

SEQ ID NO: 210544 - DNA, 362 bp, Homo sapiens
cccatctcgtgaccggcgattatccaacagctgaggctagggcagaacaaagtcaaggcagggaaagtcaaattatctcccttctggagctaggacaccttctgcccttgtatataagaatttcaggatatggccttcggattccaggacttgcaccagcagccactctcccatcaccctccccccatccctctcccaccaaggttctcaggccttcagactcacactgagaattacaccatggactcccgattctcaggtctttggacttacactaagtaatgctaccagcttggtaggttctccagcctgcagacagtctatcgtgggacttctcagcctccataatcgcgtcagccaat

SEQ ID NO: 210545 - DNA, 518 bp, Homo sapiens
ttctttatatgttggacagatttcaaaagtgatagtacctttgtttgtggtttcattgaatatttatgaagctaatgtcagatgtaggcaacattcatagcataacaggaaacttccataagtttgtgtattatgttagtctatgagaatgtgcaaatgtattggaaaattaatttagaatagcacatatttatgaaacttaagatgaatgttttatcaaatttgctctgatttgtgggtttagccctgtcttttattataggcttagtaagatatacaagaaaataaccatcatgctgtgaaaaagtgaccccaatcaggtactgactgcacagattcatgtaccctatccatcttcttgggccccttctccactggcttcttccttcctatctcccctcccccagggaaaaactggtttcatatttgtaaaagcaattttaatacttaatcatctctgagagtaacctgaactttaattgtcaaaacttaaccaaatgaagacattttctcagcta

SEQ ID NO: 210546 - DNA, 197 bp, Homo sapiens
ggtcttggcacaagctgcagggagcagccctgcttctgcttctgggaaaggggaggctgaggcctggacaagggaaagactggccacgagaaccacttgtgagggagtcttctgttctgaattcatgtagagtgtgcttccttttctagatatttctcttgagcagtattcctgttgctgcctgccagccttctcgt

SEQ ID NO: 210547 - DNA, 684 bp, Homo sapiens
gctttgttgcccagactaaagtgccatggaatgatgacagctcactgtggcctcaatctcccaggctcaagtgatcttcccacctcagactcctgagtaactgggactataggcaagccccccacgtctcattaatgtctgatttttagtagcgatgtgttgctatgtttccaaggctggtcttgaattcctgacctcaagctatcctccctccttggcctcccaaagagtgctgggattacaggcttgagtcttttaatcaccaagataaagatactaaattttgggattttctttcccccagtgctcagaaatgatggattcctggcctttcctctgcccatactctgagcactccagaaagccccaggcctttagtatccatgagtcatcatgggaataaattcacatttacctttgtacattctaaaactctttccccacatcttttggaactcatgatgaatcttcaacaaaattgttctgacttttctctgcaaccctacagtggtgactgttctaaccttattgtggcttctaaatcaactctcccagtttctaaaaactaggctttccatcttattttggattctgctccatttactatctttttcttactgcagttattactaaggttcgagtgtaacagcttctaataacctgggctttcagactgacctccca

SEQ ID NO: 210548 - DNA, 765 bp, Homo sapiens
agggcagggtcttactatgttgcccagactggtcttgaactcctggcctaatgtgatcttcctgccttggccctccacaatgctgggattataggaataagtcactgcacctggcctcttatgattttcttaataacattttctctagcttactttaatacagtatacaatatataatatacataacatagaaagatgtgttcattgactgtttacattattgataaggcttcagtcaacaggaggctattagtatagttttgggggagttaaaagttatacgcaaattttcaactgcccctaatccttggattcctgaccccgtgtttttcaaggatcaactgtatttctatttaccaaatagttcaataattgcttaaagtcagaaatttgtcctctggaattctgtaatatgacttggtgagtttttcaaggccaggatctaaacatctaatcctatgattcagttttaaaagttaatacacttcctaaaacatattcagctcagaaaactgtatctggcaataaaaacctgatattgcttggctgtgtccccacccaaatctcatcttgaattgtaattctcacaattcccacgtgtcattggaggaacgcagtgggagctaattgaatcatgggggtaggtctttcccatgctgttctcatgagactgaataaatctcatgagagttgatggttttaaaactgggagttttcctgtacaagctttctctctttgcctgctgccatccatgtaagatgtga

SEQ ID NO: 210549 - DNA, 755 bp, Homo sapiens
atggaggggggaagactggaatttttgatcatctacttattgaaaatggcgctttctttcattctttctgattctttcttccttcctttctttaaaagatcaaacgaggacaataccaaactaataaattggatgggggtggtcagaaaggaaaggggatactgtaggtgatgcatataatggatatgtattcatgcattagcaaaagaatgatcattttgaacataaaatgcaatttgattgccatggaatgtgtaaatgagaacaccaaaagctgaggtacaaatatatgtccagaccacccacaggtatgatgcaggtgtgtgtaaagcgagcccagtataagctcttccctctaatccagatgcgaggaggctccatcttctaagggaaaccttcctgctaattagattttaactatgatctttcagaagtaaacttttattatttttagctaagaaagttagaatcaggaaatatgatttttctatcatgaagggaatttaaattgagcgtgatatctattgcttataattttaaattaggcttaatattaagtttttaaaaagtgctaaaccaccccttttaaaaacgtttacatctgattcacagaactaaactaaaatgtatttgttacagctaaaatgtttcggactattagtctgtaatattatatgtggatatgaagctaaatattttacgttaaaacgggggcagggggtagaggggagaacaacactacaaagagcttacgc

SEQ ID NO: 210550 - DNA, 320 bp, Homo sapiens
aaggtaaaagattgaaggaattttggataagagaaaatttcccataaaaatgtttacttttatcctttttttcttttttaacaccatagtattcctgacatattgactattcaatttagaaagattggcagttggactcagataattcagtacttggctctggacagttgttaagaaccctgctgaaaatggtttatatgcagaaggtttcagcaactcagatcaactctgctgatctcaggatctatgctaggatgaaaaaaagtccctggcatgaatttgtttttcttgtcactagtattttccagttgaatgagttt

SEQ ID NO: 210551 - DNA, 587 bp, Homo sapiens
ggaaatttgtattcacattcagttagtcattccaccagaatgacttcatcacacaatattttgtgacaagaacctgaacagcctgttttacagtattcttttcatcttttattatatgcaccaaaatttttttttaaattttcttgaacctctaaatctacgttaaaaatttacctgatacactttctaaatggacaaatgccgaaggtagctgtgtatacaaatgtgactagaaggaaaaagatgatatagaaataaaataactccttgagttgatcattctgattggcatttatagagtagaaatgttttgtaattacagaggaaaaaagatggcctttccttcaacagttatgagccgtcagaattttcaaaaatactgcattttgacaatgtagtttctagtttgacaatgatatatttatcttcacaaccaggaaaatgtagataagaatttggtttataaatatttaaattcttattaaaatgtctaataaaattgttttccccatcacttgattctttctgtaagttattttatattgtaaaatgtaaccaaataaaaataagtaaataaacagtagcag

SEQ ID NO: 210552 - DNA, 211 bp, Homo sapiens
ggacatggtagtgcgtcctgtagtctcagctactcaggtggctgagacaggagaatcgcttgaacctgggaggcataggttgtagtgagccgataaatataaaaagtattaaagtactaacagaagaaaatttccactgatcaccctttagctttaaataatgcagaagcatatgcccagtttacttgtaattaaaaatcatgcatcattc

SEQ ID NO: 210553 - DNA, 484 bp, Homo sapiens
atttacaagccatactgcactaatatatagtcataacaaaatacacactgaagtaggaatgtggatacttcccgcaccccaaaaactgtcttgaaaaacaactagagggctgggcgcggtggctcacacctgtaatcccagtactttggaaagccaaggcaggtgcattgcctgagatcaagagttcaagaccaacctgggcaacagggtgaaatcccgtctctactaaaatacaaaaaattagctgggcatggtggtaggcacctgtaatcccagctactagggaggctgaggcatgagaactgcttgaacccaggaggtggatgttgcagtgagctgatatcgcaacactgcactccagcctgggcgacagagccagactctgtctcaaaaaaacaaaaaacagagcaaggcaggtcttcatttgctagaacgcaaggtctgcaatcaaacatccttaaaaagcaacttgcaaaccaggcgc

SEQ ID NO: 210554 - DNA, 428 bp, Homo sapiens
gacagcgctgagatgataaatactgggctcagatccagcttgggccactcactcccaagattcatacacaaacagaccagcttgatcagggcccagcagggaggtgaggcttaaacctcctcgctggaggaggagccaataagaagactggcagcttggatagtgagtgtgtgtgtgtgtgtgtgtgtgtgtgtgtgtgtgtttgtgtgtatgtcagagtgacctatcccaggtggatgctgggagtggtggcaggaagtggggtgtgatcagagagacaggaaaatgctcagagaaatgtgtgatagctcagataggtctcaaaccacaaggccctgtctacacatccagcacgattccttctggaacacagggagttaaagatgaaacaactctagaaactgaaaccaattatccatggcaattta

SEQ ID NO: 210555 - DNA, 502 bp, Homo sapiens
aaaaagaacctggtaaaataccaaccattgagaattaaattattattgaaacaactgacatttttaaagaaagcatatgttaacagaaaaaaaagatcttcagaaattctataactcagagatattcactgttaacatcatgatttaacaattttcttaccactgaaataatagaaaaaaatgcccagtggcataattgattaattcagttgttccttaagcctctttccaataaaaaccaataaaactatgatgaaagaaagcaataaaggcctgacatggtggctaatgcttgtgatctcagcactttgggagattgaggtgggaggttcacttgaggccaggagtttgagatcatcctgggcaactaatgagaatctgtctctacaaaatattttttaaaatagccaggcctggtggtgtgcacccatagtcctagctacttgggaggctgaggcaggaggatcacttgagcccaggagttcaaggctgcagtgagcta

SEQ ID NO: 210556 - DNA, 302 bp, Homo sapiens
cctatttagaatccattcagacttcaaatacaactcactctccaagtgttgctttgtctacccagctagaaataacactttgaatgcctacagcatcacagctatatacctcttgtgacaaatctccttttctagcttgtattgaccttctttcctatgatagggaaacttttttgttatctacattatctctgcatccccagggtgactaggaattcttggcccataacaagcactcaaattagtgttaggcaaccaaatggatacatcagtcatcgatcaaacacccttggttcctacat

SEQ ID NO: 210557 - DNA, 1037 bp, Homo sapiens
gagagaatgagtgcaaagccggggaaatgccaaatgcttgtaaaaccatcagatcttgtgagaactcactatcacaagaacaacatgggggtaagcacccccatgattcaattaccaattacctctcactgggtccctcccctaacacgtggggattatgtgaactacaattcaagaaagatctctaggcattcagagtacctgcttgcttggtcaagcagcctgaatcaccccacccctcctgcgtagagatcttagtgctgggagactctgcttcatccccacgaaaatctccaggcactagaagcaccacttaccaggatcagcagcctgagccatcccacccttcctgtgcagaaactctgatgcaatggaggacctctccactccaggctcaggcagatcaccaggcattcagagcacctgttcacctggttcagcagccctagccatgccccctttttggacatagatcttggtgcagtggggctttctctgctcaatgcccaggcagatctgtcagcatctggagtacttgttcacctggatcagcaacctgagacacaccaccattcctggacatagatcacgtggcagagaggacctctctggtccacacccagacagatctccaggcatctggagcatcagctaacctggatcagcagcctgagccaacccacccctcctatgcagagatcttaatgcaaggagaccctctctgccccaggctcaggcatatctccagacacctggagtacctatttccctagattagaagtgtaggccatcccctgaatctggagtggggaggttgcaatgaccagcaacttatttaaaaatgtgttgtttttttctccaatatttggattatttccatatatctttgtgttattgatttctgatttaattccatcatgttaagagattataatttgtatgattgaatacattcagtcttaaaatttatggtatatattggtgcttgttttatgtacaagatatgatacatttcagtaaatgtttcacatgcactt

SEQ ID NO: 210558 - DNA, 867 bp, Homo sapiens
  misc_feature (31)..(31): n is a, c, g, or t
  misc_feature (282)..(282): n is a, c, g, or t
  misc_feature (289)..(289): n is a, c, g, or t
  misc_feature (308)..(308): n is a, c, g, or t
  misc_feature (342)..(342): n is a, c, g, or t
aaaagaaaaaaaagaaaaataaagtattttnaacaaagttcatatacaggcacagtctcagtgaactggcgtcagggcctcgtacagtctctgtgcagccagctccaccatttctcggagggattcatcgtcttcacttccctcttcacattctacagtccgtgtctccaagttaaggttggcagttttcccgtccactgtgacgctaagaatagagtcatcctttacacttacacagtcttctccaaatatgtactggagcatgatctccaacctcttgcngtaaacntgcatttctaattttttanaaaccttctgtactgcaccttttcttattttggnatttgactgaacttccaatatcacagttgtcactgtatctgcatacatatcattagaagggtttgccagccattctaataccaccatgcctggttcttgtattacagtaatatttttgaacactttcagagcaggtttttcttgaatttctaattcttccacatcacctgtgaatttctgcagctggtaacagagcaaattaaagggaccagtatatggaatggcttgggtttgcttcaccgtgctcatggccaggtcagtataattggacaggtcgcaaggagaaagtatgttataattaaagtttcttttaacaagtattcctgagacccgctggccttgttctggttttttgtctgctaaaaatcccataaccttggctagtttttctcctctgaagtttaaggtcactgcttctgtattccgaggattatgaacctctatgtgaacttcatcgttatcttcatattctcgaatcagtgctgctttcaatctggccatttcattctgttctccatggactaa

SEQ ID NO: 210559 - DNA, 873 bp, Homo sapiens
gtacgtccaagctcggctcatccatcccaaattgcggccccgtggtaatccttggggcctaagttttgcgcccagcctgcggggagaagtcccatgggcagaggccggacggttctggaagcgggctgagggccgtttgggtatgaatcccggaattccgggtactggagtgtggtctacaaggggagtgggctccaggactccacgttatatgggggaagagcgcgtctggaagatcgcgttggggggagtagggcagggggtaggggcgcgtgtcccctaaaactcgggcgcaggggaacgagcccagttgccctggtctgaggacggtactgttccaagctgtgctgaggagtttgtgtacgtttgatccttatttgccgttttggagatcctaagtcgtcagatatgggccattttataaggttcaccctaatgccctttcgaaaaattttgaaagtgggaaatgagagtagaaagccaaagatagatgcctctgaagaacaaccgaagaagagcccacaacatagactaagagaaatgtgcacctatcatgtgtcaaggtgcttttcattccaccctcataacaacttttcaagggaggttcaattatcgcaattttacggatgaaaaaaaagggagactaagagaggatgacttgtccaaagccaggaaggtttggagaggcaaaagtgagttttgaacctaaggccctgggtatgccgcctacacaggcccccacacctggtttaatgctcactgttgctgtcgcgaaattcttatttattttttaacaagcggccccatattttattttttgttctgggtactatcaaggaagtagctgggcctgttttctggctctaaaacccg

SEQ ID NO: 210560 - DNA, 298 bp, Homo sapiens
tgggtctttcatcaatgtatgaagatgctaatttcaagtttcagctaaaattgagagcatagataacagaaattttctgaaccatgacttttatttttctaagagtcctttttctaggtttttaacttctgttcagcatttagtagacacaaacattgatagatgattgaagatgttatcagtgcaaaagaaaattaagtcaatatatctgtcgaaggttacccagacacatcaaagattaaaacattcaaaaagggatttttcccctaaggaattcaaatgtgttaaaaggacatcc

SEQ ID NO: 210561 - DNA, 124 bp, Homo sapiens
aatataaattatatgtcaagtactatacaaatattagaactatcaactattaatacatcatacaatatgcagacctttgatgttcaaattggataaggccaggctctttggaaacccctaaata

SEQ ID NO: 210562 - DNA, 954 bp, Homo sapiens
aacgatggtcctcagctcaacgagtgtctcagctacttgggaggctgaggcaggaggatcgcctgagcctgggagttcaaggctacagtgcgcagttattgtgctactgcgctccagcctgcatgacagagcaagaccttgactcaaaaaaacaaagttatgtgacggctagtaaagttaatgtcatcttatgctgtgctaatatggggtgggtgggggactctgctgctttgattaaaccacacctgaagtattgtggttagttctgggtgccacttttatgagggccagtactaactagaatttatccagaaaagtatgatgaagttaggatgggaaatggacttgaaaccatgtgatctaaggtatgattgaaaggatagagatctcttagcctggtaaaaaagattcattgatggctatcttcaatatataaatgccatatgaggatagcagcaggcttattctcttaggtcagaatcagtactgagtgggtagagtggtaggaggaagattttgagtcattaaaaacggtctcagttgcaccaaaatagtgtaagccttattatgaatatcatagaaaagtaggtctcaggctttttgtttttgctttctaaaccacacctatttgttaaggtgtcaagaattgggcagatcacatatttaaatcactttagaatgggagcataaatgtgtgcttttatattcattccgtaaatatttactgagcacctgtcatatgccaggtgctatactagctgttgatggagcatacattcaggctgaagaagtacattttgggggtgggtgtgtccatgtccaggttctctagctatatcagtgtaaggggttcttatgtgaacagcaataacatagaatatattaaagcttaggtgttggaaagtttcaaccagaaatacataaaaatatattattatacagtgtactagtgat

SEQ ID NO: 210563 - DNA, 521 bp, Homo sapiens
aacgatggtcctcagctcaacgagtgtctcagctacttgggaggctgaggcaggaggatcgcctgagcctgggagttcaaggctacagtgcgcagttattgtgctactgcgctccagcctgcatgacagagcaagaccttgactcaaaaaaacaaagttatgtgacggctagtaaagttaatgtcatcttatgctgtgctaatatggggtgggtgggggactctgctgctttgattaaaccacacctgaagtattgtggttagttctgggtgccacttttatgagggccagtactaactagaatttatccagaaaagtatgatgaagttaggatgggaaatggacttgaaaccatgtgatctaaggtatgattgaaaggatagagatctcttagcctggtaaaaaagattcattgatggctatcttcaatatataaatgccatatgaggatagcagcaggcttattctcttaggtcagaatcagtactgagtgacctcgcctgcccggaccctctggtcgc

SEQ ID NO: 210564 - DNA, 762 bp, Homo sapiens
  misc_feature (466)..(466): n is a, c, g, or t
aacgatggtcctcagctcaacgagtgtctcagctacttgggaggctgaggcaggaggatcgcctgagcctgggagttcaaggctacagtgcgcagttattgtgctactgcgctccagcctgcatgacagagcaagaccttgactcaaaaaaacaaagttatgtgacggctagtaaagttaatgtcatcttatgctgtgctaatatggggtgggtgggggactctgctgctttgattaaaccacacctgaagtattgtggttagttctgggtgccacttttatgagggccagtactaactagaatttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatatnctggggcttggagaccgtcatggtgtattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgccgtgatcagcgagagcctttaatgagtgtcttaaagacttttctacatgatcctcttgtggaatggagtacccgtggggc

SEQ ID NO: 210565 - DNA, 835 bp, Homo sapiens
gctgtgtcagcacactgggagttttacagtgtacggattggcagacagcctggcttctttccagggcattaacagttatgcacttgtgtgtctttagagccatggtcactgcgtccctctctctgcctcaggcctctgtgttcctgcaggccagtgccttgcgtttgtcctgccaagcctggttgctcagctctccctggctctcaggagtcaaagcgcatctggttctgcttgtctggtttacctgtgttaaaagcaagactctgcatgcttattctcacatcagtcagaagacgccagcctgttgtttttcagagcgaggttctcagtgtgagccatgtgggcggtcctttttggtttgaaggtgaccaccctcgctttcagcggaccggggcagggatcagggatcaacagcctggggcagggatcagggatcagggggcagggatcatcacgcaggaagctgtgtgaaagaggtgtgggaagctgcttccctggacttgctctcggttacttcagctgcctgtctgctgcgttttcccaagcgtgcttctcagtggttgctgttaatgttctaagggccaccatgtaacatttatttgaaaacagaaacaaaactgtatgtggacactgattgcctgttcctaaggacctgctccttagagccaagccgggaatgtccgcatgatcggccctgggccgacattggacgggcccggactagcggcaacacgcgctgccccgggacacacaactccaccatagccacacgcctacaacgccgtctatcagagacatacaccccgcttcgcagctccaatagcgccccttttcg

SEQ ID NO: 210566 - DNA, 172 bp, Homo sapiens
aattcggagtaatgctcattgttagtattcagtaaattaagggatagtttaaatacatgcaataagcctggaaaggggaaaataattggttcctagaaagctgtgaaagactccaaaaacataggtttttgaggaaacttcttacttctttagtgaatattgtggcatacat

SEQ ID NO: 210567 - DNA, 480 bp, Homo sapiens
aaacaacaaggaaagtcagaattgtttggaaaacactttatcagttctaatcccttcacattctctattccactctcctgcctcagagcttttcctctacagttttaatcgcctacagtgctttttcttctccttacaaactttcttcatcgccaattatcctgggtgtcttttacgtctttctttcctggacttctactactgacactcccctacggcatcacactattaactgacacttcaatatgctttatattttttactgctaagattttaagctctgtgaggcagaacttaaactatagatatataagaaaattccaagcacataatagctactcaataaataatcatcagttgattagtcaactatataaaactatacttgaattgaatgaacaagggtaagaaagccttcatgttacttaatttaaatgaagctgaatataattagaattaatcagattggcaatagacacc

SEQ ID NO: 210568 - DNA, 486 bp, Homo sapiens
atgcccggccaacgcatattttctttggcccacattttaggtgtttattaataagtgttggtcgacgcccaaaggagaaatctcagaggtcatggttgttatactatttttaaaggtctcccacaggatgcttaaggaacctatagcagtggattctgcctttagtgaaagtggaatacagctcatcatccttgtctcaataataaccccatttcctcattggtgaaatgggaacaataataataaaagtggatttcgtctcaaagtacatccgacggtccggtcttccactgtttttgatgactcaccttctgttgatcccttgcctacttcaccggtacattaggagatttaattaaagtgtgtagaggatctaagctcttcagagaaacacacagcattattatggcagataacacttctgatcttccataatctcttgaaggtaatgaaaccagcaatatagaaagctgagggtttaatata

SEQ ID NO: 210569 - DNA, 383 bp, Homo sapiens
cggcacgagggtgcctgcattttccccgaattgtttaaccctcatgcttcagaattaggctgaggcttgcggggtgggtcatgttgacctgggtgaacagagatccctttaagaagaacttctccatgttccagaggcgcgttcttactgcagatggcgacactgaggcccagagagacatcatgaccagcctcaggtcccacatgcagcctgctgctctgtagcctaaatcagatcactgtcccagctttcaggtcaaggctctggttgtgacacctgggcctggactgcgggtgaaaagttttgatgcaaaaacacagaccgtccattgtcctatgggctaagtggactcccttctgctaaccagagatgcttgtgctggc

SEQ ID NO: 210570 - DNA, 533 bp, Homo sapiens
ttccctcatcaacactggttaagttcagatgctcatatttttcatggaatattatgttgcttccttgcatcccacaggtctagggttgttgagttgcttccctatcttgaaaaaaaacatttttttgagacagggtcttgctctgttacccaggctggagtgcagtcatgcagtcatagctcactgcaactttgaactcctgagctcaaatgatcctcctgcctcggcttcccaagtagctaggacaacaggtgtgggccaccatgtcctgctgattaaaaaattttttttggtagagatggggagtctcactatgttgcccagcctggtcttgaacgcctggcctcaagtgatcctcccacctcagcctccgaaagtgctgttacaggtgcaagccgccactcttggccctgccatcttaatatatgctatttaatttaattaattaatttatttattttgagacggagtttccctcttgttgcccaggctggagtgcaatggcgccatcttggctcaccgcaacatccgcc

SEQ ID NO: 210571 - DNA, 471 bp, Homo sapiens
agtggattaaggagtaaatgagccagaagagacggtcactggccccctctgccagaacgtggtgagataggaagcaacagagagagctccagggagaagtccagggtggggcttaatgaaaaggaaggaagcatgcttgtaagttgcaggaaaagagccttccaaaggggagaggtttatagaaggaatggggggactgatttttttttttttttagtgggggaaacaaagaagggtcgtctggccatacttctgcattttgaacttaatctttaaaaaataaggccgggtgcggtggtttacgcctgtaatcccagaactttgggaggccgagacgggcagatcacgaggtcaggcgatcgagaccatcctggctaacacagtgaaacccggtctctactaaaaatacaaaaaattagccgggcgtggtggcgggcgcctgtagtcccagctactccggaggctgaggca

SEQ ID NO: 210572 - DNA, 459 bp, Homo sapiens
gctagagaccacagcttgcttgcctttatattcttggtgactagcaccgcgctggcacagaaaacacactcaggcatttgatggcaaatgaatccgcatatctaaagataaaccagcatatctttgtcttctacaacctaacccacagcaagtgactctaggcagctcaggtaaaacaccaggagtgacttgcagagatgctctgtttatccctcatggaggcccgctaagagatctgtccattacccagccccccagagttttttcatgacagccactgactctcaggacatgggaggcacctgggatcacagccacagaatggggcactgggcctgtgatgggttcaaaaggaacatcccaggacaccactctagacctcttatttatatactttttaatcaatacaagatgcagaagagttatacaactattaaaagagccatttctggggcaggc

SEQ ID NO: 210573 - DNA, 318 bp, Homo sapiens
  misc_feature (177)..(177): n is a, c, g, or t
  misc_feature (200)..(200): n is a, c, g, or t
  misc_feature (229)..(229): n is a, c, g, or t
  misc_feature (243)..(243): n is a, c, g, or t
  misc_feature (255)..(256): n is a, c, g, or t
  misc_feature (265)..(265): n is a, c, g, or t
  misc_feature (277)..(277): n is a, c, g, or t
ccatatcccctgctcttccagttctgaatggcattagtccagttgggtcaatgaggagcagtttggtgaagtggttaaaggtcggggaaagtgtgcttatattttgaaatttaaggtttgtacaagctgcttgtgaaattctgtctctactaaaaatacaaaaattagctgggcgangtggcaggcgcctgtaatcccanctacttgggaggctgaggtgggagaatcncttgaaaccaggangtggaggttgcnntgagatganattgcaccaccncactcccgctgggcatcaaagcaagactccatctcaaataa

SEQ ID NO: 210574 - DNA, 447 bp, Homo sapiens
aaataaataaataaataaataaataaataaataaaatgttatcaaatagtgtggcatatcacagagaagtcttttgtgaaaggaagagtcagctgatgtgacaaacttcattgttgtcttattttaagaaatggctgctggcatagtggattgtgcctgtaatcctagcactttgggagactgaggcaagaggatcacttgagactaggagttcaagatcagtctgagcaacataacattatcccatctttacaaaaacagatttttgttttaattagctggcatcatggtgcacctatagttctagctactctggaggctgaggcaggaggattgcttgagaaggaagcagtctttctggaggattgctccagaaggtcaaggctgcagtgagctatgattgtgccaccgcactccagcctgggtgacagaaggaggctctatttc

SEQ ID NO: 210575 - DNA, 286 bp, Homo sapiens
catgtcatatggccagagcaggagcaagagcgagaagggggaggtgccacacacttttaaacaacaaggtctcaggagaactcactcactgtcatgaggacagcaccaagaggatggtgctaaaccattcaggagaaatccacccccataatctagtcacctcccaccaggccccacctccaacattggagattacaattcaacatgagatttgggcagagacacagacccaaaccacatcagagggtatgcaagataaagttgaagaaatctcctagaaatcagg

SEQ ID NO: 210576 - DNA, 588 bp, Homo sapiens
tagttgttgcctttaccgtatttattattattattctcatgtaaaagtagatgtctctcctggtgtaattacctggctacttctctctcccacacttgactggaaactcatctttctaatccagtgtagtatctccagctcctgcccccgaggtcaggactcaggaaaagtttgtcacgtgaaggagggagggatgctgtatggcttactcctcacagggaggctgtcagtcagggtcatcattcctgttttgcagatgtagaattcaggttcagaggtgtgaggtgacctactcaaggtcactcatcctgcaaatggcagacacaggtggtggaccaggcctgtctgccttcagatcctgagtctttggcatcactgttcatcatcctgtccactccaaggctgttgttaggaggctctgggctcatttctcttccaatcaatgagaggtctgttgggcagcctgttgctttcttgaaagaagtgtaatgaaaaccagattttttttcaacatgatatctcgttccccacagagactgtcagttctcatatgttccaataaaactgctaaagaaacagccacttaaa

SEQ ID NO: 210577 - DNA, 849 bp, Homo sapiens
cagatggtgaagatacaaggtcatcataggagaaaagaagatagctccactgacatgtataatcccatgtggttctaaccagaatgtataatcatctgttagaggtactgtggtaaatgacagggacttttcacaaaaacaattggctaatagcatgctaaatttgttctccatctcaaatcttgaggagaagaattttcggagtgaagacatcagtaagaagacctgacaaaccaggaatgatttcatttctcctgagaactggggaaaccgacctataagagttaacttttctttgaaagctctgcacagttcaggcatcaattttgatgatgtatctgcctgtaaaagattgtcattattttcaacacatctgtatctcagattggactcctctaaaagcatttggaattggaatttcctaggaatatcttctactaattcttaaaactggaaagccatgcccatgtcatcggttctggggtgaccctaacatttcatctagcagtgattgtcttctaaaacccacctgtcaggctgctatgacccatagttaatgctttctcttcaccaggacattgacaaaagaatggaattggtgaaaaagaaaaaagtgataagaggctaattttatgaaccatattttttgctgtaatcttttgtttaaattttagcatgctttgctttgtgtatactgaatttttgcagcaaaagaattacggaaaagcacagatactctatatgaccagagatgttcttgggaattacaatgtagcaagagataatttctaaaataaaaaccgagcggccagctcaatttcattcttccatttcattgaatttatgtta

SEQ ID NO: 210578 - DNA, 306 bp, Homo sapiens
tatcaagtatttcatatatcatgcacatacatttttaacaaaaagcaggtctcttggtggggtgggaaggggtaaataataaatacaaataaacatgttaataaattattttagaggaactgttttgtatgtttttaaggtgtcacaaaatattttttgatttccatatgcttaaacaagaggtaacttactaagcaacatgttacttgaattatgtacttcaagtgaatgaaatgactacagctagaaagtaaatagtcctactatagtatttgcatgtccataaagaataaacaaaagataact

SEQ ID NO: 210579 - DNA, 617 bp, Homo sapiens
gttggcaaagcgaagggcagtttgactccttaattataaagttggatgtcatttgagaaactctgggaattggaagtagaacaaattcatactttccctataacttttaatttcttgtcatacattcagaaaacaagagatgtaaaattcataaaactgcttgtataaattcagaaaacgggattataaaagcaaagacaaattgtcttacgattctttgttctacttgagagattcaagtgttggagtaataaaaaataccagggactttcttttttttaataggttaatgccacctaatgtgggcttctcagaatgtgatggcaaacttccaaatatgatgtgggagccaaaagagaccaactggttttacaaaatattaagaacacaaaatttcccaactcatatatttgaatattcctaaaaaataataagtcaaaattgtgttggtgggctgggcacagtggctcacaactgtaataccagcactgtgggaggctgaggtgggaggattgcttaaggccaggagttcaagactagcctgggcaacttggtaagacctgatctctacaaaataaaaattttaaatttaaaaaattaaaaaaaaaaaattagcc

SEQ ID NO: 210580 - DNA, 311 bp, Homo sapiens
cacacaatggaatgctactcagcagtaaaaaggagcagatttactgaatcagtttacacagaacaacatgaatgagttttaatgcattatcctacatgaaagaagccataactcagggctacatatcatgtgatttttatatacaggcatgaaatgtgacatttagaggcaaactatagggacagaaaacaaattagtggttcctaagatctgaagtaggagagtgaccacaaaggaacacacggggggactttttgagccgagggaaacgttctatgtcttgactgtggtgatggttacatgactgaatg

SEQ ID NO: 210581 - DNA, 475 bp, Homo sapiens
  misc_feature (311)..(311): n is a, c, g, or t
agatgaccggtccccctaatggaatccctcttgggctcaagtgatcctcctgcctcagcctttagagtagctgagactacaggtatgcaccatggcacttagctagaagatgatggattctatacatgagccttaaactatttccagattttgtttctatgtgagaatgaaataatcttcatttttgttacagctactgttactttgagcttactggtatatacatacagctgaacctaacactaactgatacataagcttgtgcttccctgatttcttccacccacacacacacacacagagacacactntcctttttttttttttttgggcgcaaaattttgcgctctaaaaaaaggttttaataaaagggggcccttaaagtttttacttatttccccattttaaccggggcactgactctaaaattcctcgggaaggattccttaaagggtttcctcttttaaaccaattg

SEQ ID NO: 210582 - DNA, 717 bp, Homo sapiens
  misc_feature (660)..(660): n is a, c, g, or t
  misc_feature (700)..(700): n is a, c, g, or t
cacgcatgtgccgctcccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctacccaacgcatgtgccgctcccaacgcatgtgccgctcccaacgcatgtgccgctccctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacaaaagaaagaatttttaagaaaatggattaaaatctggcacagaataatgggaaaggtcaatatgggcattntttttgaccaaaaattataattaaaatggatggacctccnctggggggcatttcaat

SEQ ID NO: 210583 - DNA, 407 bp, Homo sapiens
taaaataaaataaataaataaattattttgtagggatggggtctctctttctcagtctggtcctgaactcctgtgcccaagcaaccctcctttgttggcctcctgaagtgctggaattataagtgtgagccactgcgcccagcctgtttatttatttatgtatttttttaaaaaaatatgtagatgggttctcactgtgttgcccaggcaggtctcaaactcctggcttcaagcagtcctcctgccttggcctcgcaaagtgttaggattacaggtgtgagccaccatgcccaccccttctttttcttttcaggctccttgcttccattctgctgacttctaatggttgtctgctgcttgtaacaacacaaagtttaatggattaaagtgacgaatatttattatcc

SEQ ID NO: 210584 - DNA, 293 bp, Homo sapiens
gcctgggggagcaataaccattcatggtgttgtttgcctggtcgccccaagggcagatacttcccaaatcccttaaagtcgcagatccatttgtctgcttatgcagaaccccggggtgtgaaatggataaaggtgcaggatccttgttgaatcgggtgagtggcatagaagccctcctgcttatgtggctccccacaggcacccactttgcagaatctcagcacccggttggagaaccactgttgtgatgctagaacatggatctttgggtcagccagaagtgaagacctcag

SEQ ID NO: 210585 - DNA, 108 bp, Homo sapiens
gttggtctcaccactatctgtaaccacaaaatggatcataaaaatttcaataacataagtagaatggctggattagtagtctctaaagtgaagaagtaacattgaaga

SEQ ID NO: 210586 - DNA, 689 bp, Homo sapiens
aatcctaactcttatgaaccaagggatactgacaatgctgggccccaaataactattgttttctcaaaggctttaagaccatgtgttatactgtgatttaatcaggttctttcctaggagtctgcctgagtcacttggtctgtgtgtctctccctccctgtcctaagggggcttttcatgtgtgactgtgttctgcctgcctgtctggtaagaatccagcctcctgttacttgcccaggatgctgactgtgggccctctcccgcagtggaacatttggcatcaggtaccaggaacagagtcagtatgctgaaatgtttgcatgaatgtggattttcagaaagctttcttatcagcagggcacacctgtctgttcgtgatctttgcccttctccctttattggcatcacttggacgatacctttaattgccctgctgggcttgatgttgagctgcttttctccatgtgtgtcgtgttttgtgctttcttgcggcaggagccttttgctttgtttatctgatgcttcccttttttggttttccccgggctttccagctcttggagcacccttttgtcagcagatgtacttttgtttccagtttttaaattctaattacagtgtaactcaactaaaatcatggaactggggaacataaaacaaatcattagggtaatggaggcatagaagaa

SEQ ID NO: 210587 - DNA, 476 bp, Homo sapiens
ctcttgaacatcagattccaggttctgcagcctttggactcttggacttagaccagtggtttgccgggggatctcagatcttcagccacatactgaagtctgcactgttggcttccctacttttgaggctttggaactctgactgagcaactactggcttcgttgctcctcagcttgcaggtggcctatcgtgggacttcaccttgtgatcactttctgtcacccaggctggagtacagtggcacgatcacagctcactgcaccctcaacttcccaggctcaggtgattctcctgcatcagcctcccgagtagctgggactacaggtgtggacacattgagaagtcactatctatgaactaggaagcaggatctcaccagacatcgaatctgctgatgccttcatcttggacttctctctcagcctccagaactgtgagaaataaagtcctgttgtttataagccactcagtctat

SEQ ID NO: 210588 - DNA, 387 bp, Homo sapiens
aatgtgtaatggggtgctactgaccatctactcccaactccaagttgagtgacatcacattagtaacttgaaattggtcagggtgcaaagatttacaccaaaaaagtggctacacatcagggtgtcctttccttggagagctggctattagctttatcagcatatccctggccttaccttgtgggttagggttggtgtaagtttgtaggaataaaacaccagtcacttggaagctaccagcccagctttctttaattgaatcctaaccctttccaaatagccctgccttggggcgtttttgctgtgcctaaaaaaaaagggtggtggctgagtttagtagcaggggaagatgagtcacatagtcagctagttactttttaacctcat

SEQ ID NO: 210589 - DNA, 273 bp, Homo sapiens
ccgtggagggagtgagagaggaagggggtggcaggacaccagggaggcaatgcaattgaacagaatggtcagtcttctttttactgtcttgatgcagttagtgtttagatcattagggccactcagtgaaggtgcttgaaattgatggccctggacacccctatgtaagaagtccttgggccacaaacagactgtagatctcatgaaggcaccaggagacagaagcctggttatcacaggcaggtccgacagctagggttgtggcttcttgcc

SEQ ID NO: 210590 - DNA, 422 bp, Homo sapiens
agcaaaggcccagtctctcaatgcaccctcttactgatggcacctgtcttgttatgaacaggtaacagtgcatccacactggtctggaccagctctcccttctccctgcctggtgaaccctcagggtccaactgtcactactgtctccactatgtcttcctgatgttccacccccggtcacatcctcaatacatctgtgactttctttttaaaacggcgtctcgctttgttgcccaggctggagagcagtggtgtgatcttggctcactgcaacctccacctcatgggttcaagcgattctcctgcctcagcctcccaagcggctgcgactacaggcatgtgcccccatgcccggctaatttttgtatttttagtagagagggggtttcactatgttggccaggctggtctgaaactcccaa

SEQ ID NO: 210591 - DNA, 416 bp, Homo sapiens
tgacatgtagaatctaaaatagtcaaattcacagaagcagacagtagaatgatggttttcagaagatgaggagagagggacgtagggagatgctgttccacaagtataaggttttggtatataacatgaatcagttctgcagtctgggtacaactgtgcacaccacagcagttgtgcctagagttaacaagaccgtattatacatgtaacactttgtcaagagggtggctctcatggtaagcgtttgaccgtgataaaataaaaatttcaacacgtatgtttattgcaatactatttataacagcaaagacttggaaccaacccaaatgtccatcaatgataagactggataaagaaaatgtggtatgtagacactatggaatactatgcagccataaaaaaggatgagttcatct

SEQ ID NO: 210592 - DNA, 781 bp, Homo sapiens
caaaaacacagaaagataggcaatagaagaatgagctatgatgtacccatcattttgattcagttatcatcacgtcatggccaatcttgttttagctatacttccatctgcttctcattctcttgttacttttgacctgtaaattttgaagaacagatatcccctacagtagccctgtgaggaagatgttatctctacttttgagatgagaaaattgaatgttaggataaatttcttttctaaaatcacccagcttgtaagtggcagaataagaattttaaccaggtctgttaagttcttcctctgcagtcagttgtttttccttctgtttaggtcagattataaccaaggagggtggtgtattctgacagcagctaaatgttttactggagtattaccaattcagtacctacagacacttgttaattgttttgggttagggttagcttagagttagatttttttcctttcctctgcattatttttgaccatttaaaaaatcatattgaaggccgggtgcgctggttcatgcctgtaatcccagcactttgggaggctgaggcagacagatcacctgaggtgaggagttccagaccagcctagccaacatggcgaaaccctgccttactaaaaatacaaaacaattagccgggcgtggtggcaggcgcctgtagtcccagctactccgaggctgaggcaggagaatcacttgaattcgggaaggggaggttgcagttcactccagcctgggcgacagaccgagactctgtctcaaaaaaaa

SEQ ID NO: 210593 - DNA, 509 bp, Homo sapiens
tccagtctctttctgggggaattgagcccacttctcatttcatttaattagatgaaatagaactcaaagtacaatttactgttgtttaacaatgccacaaagacatggttgggagctatttcttgatttgtgtaaaatgctgtttttgtgtgctcataatggttccaaaaattgggtgctggccaaagagagatactgttacagaagccagcaagaagacctctgttcattcacacccccggggatatcaggaattgactccagtgtgtgcaaatccagtttgcctatcttctcaagttagggttaattggataattctggagaagtacacattgaaaactagaactaagccaagcaattaaatacgtttcctgcctattacatgccttggtactgtgcaaaagagctcacagggcatctgaggaaagattactaacacacacctcaaatgactgtgtctgatttcctagaaggactcagaaagggagtgatcactgtggattggactg

SEQ ID NO: 210594 - DNA, 621 bp, Homo sapiens
actattccataactgatagttagtattattaacaatatgattagtaatataatcatattataactaatcatattactaatcatattagtcatattattactaatcatattactaatcatattagtcatattattattactaatcatattgttataaaagacaggatccactgccccaaccatcaacatcaccacccaaatagatgtcttttcttcatgcagaaattcactcaaaacctaacatggatatctagacacagccacacagttttattaaaagctttgtaagcctccaaaatacaggttctcaactccagttgcacattagaatctcctgggaaacttttttttgagacggagctttgctctttttgcccagggtggagtgcagtggcgcgatctcagctcaccacaacctccgcctcccagattcaagcgattctcctacctcagcctcccgagtagctgggattacaggcatgtgccaccactcctagctaattttttgtatttttagtagagatggggtttgtccatggtgatcaggctggtcttgaactcctgacctcaggtgatccgcccacctcagtctcccaaagtgctgggattacaggcgtgagcc

SEQ ID NO: 210595 - DNA, 400 bp, Homo sapiens
  misc_feature (248)..(250): n is a, c, g, or t
  misc_feature (253)..(253): n is a, c, g, or t
  misc_feature (261)..(261): n is a, c, g, or t
  misc_feature (267)..(267): n is a, c, g, or t
  misc_feature (297)..(297): n is a, c, g, or t
  misc_feature (319)..(319): n is a, c, g, or t
  misc_feature (334)..(334): n is a, c, g, or t
  misc_feature (361)..(361): n is a, c, g, or t
cacgcagcggcggcggcgacgcgagcggcagcagcccgggccccgcggtacgccagcgcggcacggccagcaggagcgccaggcgcgagcccgcggccactcgctgcctccggggcactgcgagaggctttgcgctccccagcgcggcgttcggactcggggccagcgcggccacggccgcgacaaaggacagcagacgccgggactcgggggctgtgcccagggaccggcccgggggatcctcccgnnnagngttccctncacgcntcccctccccgggcggccggagcgcgagcnggagcgggccccgtcatatganagcggcgacgccgangccggcgagcgcgcgttctgcctgctncgctgcgccacggccgccggcgcctggggtggcccttgc

SEQ ID NO: 210596 - DNA, 888 bp, Homo sapiens
aaacatacagatggcacagtaagtagggtctatctgtatattatacactgaaattaagtctgcttgctttctgaataaacactccaaggtcgaaaatatacctgtctgcagttgtctacagtgctagaagtttaatagatttgcagttttctagaagcaagtaaaataacagagccttgagtcattcccaaggacattttaaaataactactttttctttcagaaatcaaagggggttatcttactttgtgttccctatctaatcctcttaatcctcaaaacttgttgacaaattcttcctcggactcctgcctcactcatttacaccaaccaccctactatctataaacctagccatggccatccccttatgagcgggcgcagtgattatagactttcgctctaagattaaaaatgccctagcccacttcttaccacaaggcacacctacaccccttatccccatactagttattaccgaaaccagacgagctacctaagaacagctaaaagagcacacccgtctatgtagcaaaatagtgggaagatttataggtagaggcgacaaacctatcgagcctggtgatagctggttgtccaagatagaatcttagttcaactttaaatttgccctacagaaccttctaaatccccttgtaaatttaactgttagtccaaagaggaacagctctttggacactaggaaaaaaccttgtaaagagagtaaaaaatttaatacccatagtaggcctaaaagcagccaccaattaagaaagcgttcaagctcaacacccatcgtctaaaaaatcccaaacatacaactgagctccttacactcaattggaccaatctattaccttatagaagaactaatgttagtataagtaa

SEQ ID NO: 210597 - DNA, 372 bp, Homo sapiens
tatactgctgtgcggctatactgttaggagcatttataggtagaggcgacaaacctatcgagcctggtgatagctggttgtccaagatagaatcttagttcaactttaaatttgccctacagaaccttctaaatccccttgtaaatttaactgttagtccaaagaggaacagctctttggacactaggaaaaaaccttgtaaagagagtaaaaaatttaatacccatagtaggcctaaaagcagccaccaattaagaaagcgttcaagctcaacacccatcgtctaaaaaatcccaaacatacaactgagctccttacactcaattggaccaatctattaccttatagaagaactaatgttagtataagtaa

SEQ ID NO: 210598 - DNA, 598 bp, Homo sapiens
ctctctctttctgtctgtctctctctttctttccttctttccttcctttcttctttctttccttcctttcctttctttcttttttttttcttttttgagatggagtctcgctctgttacccaggccggagtgcaatggcacaatctcggctcactgcaacctccacctcctgggttcaagtgattctcctgcttcagcctcccaagcagatggggctataggcatgcaccatcatgcccagctaatttttgtatttttagcagagatggggcttcactatgccggccaggcgggtctcaaactcccgaccttgcgatccgcccccctcagccccccaaagtgctgggattacaggcgtgagccactatgccggccgcaaaggattctttaacacaaaagggcaggactcatgagactgacctgaccattacatggtgcagtgagagttcaatttaagcctccttatgcttctttgactaatttagggccatgcagtgtcaaacgcaatgagggcacaaaagcagcttctccctggctatcttcagaaggaatcttagattgcccttgaacaccatcaacaatctgctatttggagggc

SEQ ID NO: 210599 - DNA, 488 bp, Homo sapiens
acttataatcgaccaagatttcttccatacatgaatagataaacagtagcacatcaagaaagtagaatacaatttagcattacaaagaaattcaatttcaagcaatgaaagtaaatatagaaaacttaatgcaattaccaagactcccaaaaatctcaatctgaacaagctgcttacggtttgaatccaactatatgatatctatatgcaaaaggcaaaactatgaagacagtaaaaatagcagtgtttgccagggtttgggtagggaggtatgaattgatggagcagaggacttttagagcaaggcaatgaaactactctgaatgacgctataattgttgatacaagtaattaaacatttgtccaaatccatgggatgtacagaatcaagagtgaagcctaatgtaaactatggactttgggcaataattatgtgtcaatgtaagttcattgattgtaacaaatacatcactcaggtggggaatatt

SEQ ID NO: 210600 - DNA, 348 bp, Homo sapiens
cgcagtcttctcccatcagcgaactcccatatgttccacaggaagagtgttttaaaactcagttccttgcccagcccagtgagttagtaccacccacttcctggactcagttcaaattcctcaacacactggagtcagaaaagaaagtcaatgaagggttccttctgcctgagctctggcttggaggcatgtctcatcctcagtaacctttcaagtgtctcataaagcagaaaaaaaaaaaaagcaaggtttcttaaagagggtatcctgactgggtgtggtggctcatctcatccactcccatggcttgaaatacactgatgggagcaagatggggatcctctgtac

SEQ ID NO: 210601 - DNA, 500 bp, Homo sapiens
tgattctgtttctgtggctgctggataattccatctggacatccagctatcatctcaaatgcagcatgtctagaattgaacttatcctaccccctgatgactggccttcctcttggtgaccaagtcattcatttctcagttcattcagtctatgtctgaacctctttaactcttttatctcctggataacccatatttaattaccttcaagcaatgtatatcctttcattataatatcctttattctattccccttctttccatttcacaaataccaaaaagtacagatttttagtacatctaagctagttgaatatcagccaaattggtcttcacgctttgattctttcccttctctggtccctcctatatacctctgccagattaatctgcattaaagactctttcatcagccgggtgcggcggctcacgcctgtaatcccactactcgggaggctgaggcaggagaattgcttgaacccaggagacggaggttgttg

SEQ ID NO: 210602 - DNA, 302 bp, Homo sapiens
atttgcagtgaaggggacagtgctgctagcatctggcacctggggagagaccaaggatgctgataagcatttcacaatgcacagggcagcccccattcccaggccccagtaatgggttatccagctggaaagatcaacagtgctgaggctgaaaaatcccgccctatctccttgctaccacttagcattgtcaggcatctaactttattcatcctaataggtatgaaatgttatcgtgttttgctttgtgcttctttaatgactaaatatggtgaacatctttttttgggacttactggcca

SEQ ID NO: 210603 - DNA, 462 bp, Homo sapiens
tgcagaaacacacccacacctacacagtcctgtcactctcagctaaagtgaaggaagcaatttaagatctatttaaggtcttcacatgaatggcaaataagcagagaagagtaaaattaaggatacaaggtatgattcatattcttgttaggactataggtatcagagacgacgctgggcaacattttggcagaagtgcagaaagaatgtagaagtgtcataaaagggagtagactagatgacttataagctcccttctccaattctaagtaaacatgtttcattctaatgaatggctgcttttacagcaagattcagaatataaatttaactcattaggagtttaggattagtttgatgaatcagtgctacacaaagaaagatccagttataaatgttctctagataaaaagccttgactgtttctgagaaacttggaacaatgtttcagttaagagtatg

SEQ ID NO: 210604 - DNA, 444 bp, Homo sapiens
catagtgagaaggggggtggaagaaggggtcagctgctcagtccggagtaggcttgcaagactgcattcctcaaacaacaggctctagatgtcgcagtagataaccttggtgacagggagtgatcgcctccagcaaacctgttggcaggagcagtcatgagtttgcccacatcctgcattcatgataaacagtttgctgtttgatcacacagcctccagtggaatgctgagttggtcacgtcccacgggccttcggctccctgcacccactagccaacatctcttgctccctccctcccactcatatatccttcccatcctctagtatctatcgttcttttctctacctccatgagatccacttttttttttttttagctgacatacatcagtgagaacatgcagaatttgtctttctgtgtctgcctttttcactgaacataa

SEQ ID NO: 210605 - DNA, 585 bp, Homo sapiens
tgagttggggttgctcagggtgaaatgagcccttacccctaaagaaaaatgacaaggacactttagtcaaattgttaatcctactgaaggaaagcatccctggagagaacactggcttccaaagcttttatctgttacctgtaaatgagttatgtaacacatggaccattagctgcaaatgttttcacttttgcattttacaataatttcagaccttaaacacatcattctactgaagacttaatggattgaagaatatctggtattgatatctttgatatacagctttgggagggagaggggccttttgcattgccactgctattgattggtaaatggtatttaaaatttgggtgagaattgggacaggttgggagaattttcacaaagggtgggagaagtgaacataagctctttaattaaatggaatattgagacaattttgtaagaagttactggtgtataatgctgacttagtttcaaaaatttagcctaactttttgtaagttaattaccaaaatgccaacagacagaaaccaagttgtactagttatctcaagaatttaaaacctttccctactattc

SEQ ID NO: 210606 - DNA, 393 bp, Homo sapiens
tgcgtaacaccatgtgtgatggggcagattcgtttaccttcttttcccacatcaccctttaggctgggagctagttcttgtttcctgttgcaaatcaccattctcacaacactaaaaattactacacttaggactacttcattgactgacaatatcccactgtcccagcagcaagagggactgccgactctgtccctttaaaatgaagagaaggactcacaaaggagctcccatcctccactagcaaggggtcccacccaccacagaggcaagctgtggtcaaggcaggggcttcttggggtctcatggagaaaaggttcagaaatcaaagccccaccccaggttggtcccaagccagtcactggatgaacacactccctggtacctgtggaa

SEQ ID NO: 210607 - DNA, 318 bp, Homo sapiens
agtcctgaactgtcagtgctttctagggcgtgtgagcagacataggttatatgttgagacacaggctctactgatggacagttacctgaattgtaaatcctggttcttgtcacttaccagccatcagctcttaagtgactttgtctctcagtctcagtcactgctatcagtgatgacagcacagaatataggctagtggatgaaagtgtgggctctggcccttacgagctgtgtgactttaggcaaatcatttaccccgtctgtggtgttcatctgtaaaatggaaacaataataagacctaccttgtgggtttgttg

SEQ ID NO: 210608 - DNA, 391 bp, Homo sapiens
cgcctggccagggtcagtcttcttgatgataaatgtaaaactatttaaataatttggatatttagtagtctaagaaatttaatgggatgaattttccctagattgttaattatctctttagaaatacatactgcatctactttgttctggcttactctcttaatagctatgagaccttgggtatgttactacacttttctgtgtttcatttttgtaacctttaaaagggaagtgtagtaataatagtacataattcctatgtagttgtgaggattgaatgagataattcataaagaacttactacagtgcttggcaaatattaattacttaacaaatggtagctgttattaatgttatctttctagagtagaagtatggaatttattgtga

SEQ ID NO: 210609 - DNA, 1401 bp, Homo sapiens
  misc_feature (1344)..(1344): n is a, c, g, or t
  misc_feature (1390)..(1390): n is a, c, g, or t
  misc_feature (1399)..(1400): n is a, c, g, or t
tgcaaccaccattacggcgtgatccactccttttcctctaagaatgctgaacggtaccactctagaggcagtcctaacccagcgcagccgtttctgcgcctgatctcagcggacgcagtgcgggacttctccctttatttctgcagagctgagggcaggcggcgcaacaaatctcagccatgctctttcacgggatctccggaggccacatccaaggcatcatggaggagatggagcgcagatccaagactgaggcccgtctggccaaaggcgcccagctcaacggccgcgacgcgggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacagaaggttctctgtgcagagatgtgcccgctgccaccttggcatttccgcctcggagatggtcatgcgcgcccgagactctgtctaccacctgagctgcttcacctgctccacttgcaacaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggttgtaatgagaatgaggcagaccacttggaccgggaccagcagccttatccaccctcgcagaagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagccaaaaaaaaagagagagagagagacttaaatgtcatttactgaatgttaacgaaacttgtgttctttatggtgtctaacacaactgaaggcctaaaattatgtggtttaaacaaaattagataaaccangtacaaaaccagagcaacctggcagtaatatgcccaccccatattngaaaaaaanna

SEQ ID NO: 210610 - DNA, 1016 bp, Homo sapiens
acgcagggactggcccgcacctctggccgccgcctcccgccgagaaccgagttctagttggggaaacgtctgacatctggacatcaaggtaagaccctgatggagatattttagtcggagcagttttctgccctcggagtgcgcccggacgcccgggagtttcagggacttcttgggagcctaccggaggaaggcccggctttgctccaagccgcgtccctacctgaggtctccacgggaggagcggtttggacgcgccccaccggatgggaggaggtgcttggggaagccgggccgtaccgccggtctgactcccggcttttctctgccagtgcaaccaccattacggcgtgatccactccttttcctctaagaatgctgaacggtaccactctagaggcaggtgagttatgtgccaggttccttctgatgttctctgccccttgggccagtgcgtataccatgtgagtgtgtgtgcgtgtgtgtgcgccttcgttgggtggaacgaagaggagtgtgtgtttgtcttaaaaattaaaccgcgcttcgtaggctcaaaaatacacattctctttcagagtctcctgataggactcctgaaaccctccttttgcctttctctttgactgtctttgactttcctcaggatcagtgtccggggcgccaggcagaggtcctggttccactgatcctccagtagtcagtggctccagggacgcgctcctgaccctccggggagctgctgggggtgtctctttcttggaagggatggaaggggggccgagaagacactgtttctcacacgtgtaggggttaactggaaactggcttcacccacatttttttgttgttgttcagtcctaacccagcgcagccgtttctgcgcctgatctcagcggacgcagtgcgggacttctccctttatttctgcagagctgagggcaggcggcgcaacaaatctcaggtaaaagagcatcagatttcagaagagctgtattctagacttggcgcaggcc

SEQ ID NO: 210611 - DNA, 1207 bp, Homo sapiens
tgcaaccaccattacggcgtgatccactccttttcctctaagaatgctgaacggtaccactctagaggcagccatgctctttcacgggatctccggaggccacatccaaggcatcatggaggagatggagcgcagatccaagactgaggcccgtctggccaaaggcgcccagctcaacggccgcgacgcgggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacagaaggttctctgtgcagagatgtgcccgctgccaccttggcatttccgcctcggagatggtcatgcgcgcccgagactctgtctaccacctgagctgcttcacctgctccacttgcaacaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggttgtaatgagaatgaggcagaccacttggaccgggaccagcagccttatccaccctcgcagaagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcaggtttggttccaaaacgcacgagccaaattcagaaggaaccttttgcggcaggagaatgggggtgttgataaagctgacggcacgtcgcttccggccccgccctcagcagacagcggagctctcactccacccggcactgcgaccactttaacagacctgaccaatcccactatcactgtagtgacatccgtgacctctaacatggacagccacgaatccggaagcccctcacaaactaccttaacaaaccttttc

SEQ ID NO: 210612 - DNA, 1695 bp, Homo sapiens
  misc_feature (1638)..(1638): n is a, c, g, or t
  misc_feature (1684)..(1684): n is a, c, g, or t
  misc_feature (1693)..(1694): n is a, c, g, or t
aagcagccagggaacgctgaaaatagcacgtctttttctttctttgtgttcaaaactattttctttcttcaccagattttgttttcctccccccgctgcagttgtttcccattagtaactcgatctctcagagcagtaagattcgccttctacgcctctttttccctccgcccgaattgtttgttttctgcacatctccttcagggagccgctgaggcttccccccaactcttcccagttctttttgcttcccctcggccccccaagcagaccgatttccactccatctgtttcttctcctcctttctctccctctttccctccatcctcgagcgtctctgcgctcctacagggcagccctctctggtcccttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatcatggaggagatggagcgcagatccaagactgaggcccgtctggccaaaggcgcccagctcaacggccgcgacgcgggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacagaaggttctctgtgcagagatgtgcccgctgccaccttggcatttccgcctcggagatggtcatgcgcgcccgagactctgtctaccacctgagctgcttcacctgctccacttgcaacaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggttgtaatgagaatgaggcagaccacttggaccgggaccagcagccttatccaccctcgcagaagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagccaaaaaaaaagagagagagagagacttaaatgtcatttactgaatgttaacgaaacttgtgttctttatggtgtctaacacaactgaaggcctaaaattatgtggtttaaacaaaattagataaaccangtacaaaaccagagcaacctggcagtaatatgcccaccccatattngaaaaaaanna

SEQ ID NO: 210613 - DNA, 540 bp, Homo sapiens
ttgtaaggatgaccatggttccatccttccctctcgtggcacccaccatctgctaagaaacatgactgattcctggttttctgatccgtttgcaattttaacttgagttttttttttttcaaattgtcctattcgcaactctaaatatgtcaagattagtcagaaaaaatgcaatccttcctttttaaaatgttatcttaaagggatatattatctttggtaaaatgaggttaatttcagatcactcacacacaaacacacaggcacatactactttagatctgtgccacatcaataatgcagtagcccggattattgaccagctgaaacaaggaaagtcagactattctgtaggtctatagatgcgggacattgcatttaaattgcctgacattaaaagccgaaaaaggaaaggtaggaacttttgccatcagaaaatttgtgagattaaaataaataaataaataaataaataaagaagaaaaaaaaagaaaaagaaaacacaaaaaagatctaaaacaaaagataaccaaaaaaaaa

SEQ ID NO: 210614 - DNA, 445 bp, Homo sapiens
caatcccctctatactcctagcccctctacacccctggcacatggtaatggctgcataagtatccaaacaaagcatctatacattactactctgagctcttggtcacactcaggcactttgcatcacaaaaagacgttattctcttcccagttctcctagttctttctcaatcctcctgagcaggtcaaggaaaaggctcaatgtagtgctaggttaccttcaacacctctccatctcttgctaatttccctttttaaccaaaagagagtatgcctcatgttgtgaacaggcaacagtgctggctggaatttaataactgtttggggtttatttatggttaccttccatttacctagtgacgctgtttttccattattatagtgacacaaagtctccttttcaaatacatttgttttacaagtgagtcaactgcaggggaaaata

SEQ ID NO: 210615 - DNA, 860 bp, Homo sapiens
ggagagagggattagagggattgtccggcgtgggtctagggtcgttgaggcctaaagttaagcctttgtggggaggacggattgggggctgggtcactttaagaaaaagattctaaaattacgaaggcagaattccagggagtctcccgggcctggtcctgaagcttgagaccccggatatatacgctccagggggctgcggtgcgctcttcgggtccccgagccctgtgtttaggaacacgcggggacgtccaaacacccgctcctctcccgccgggcgggctcctttgtcttctgggctttcgtcgcgagatggaacgctgggtcagtgcatcccagcaaaacacgttaggagtaaacgaaggcctttccggggacctgggtagtcggttgtaatggcgtttgcctgggatgcagcacctttggtgggccattagatgacgtgtcgcttctccaggggcttgctaggcactagcagaaatgctcccctgtgcttactcggtgttatggaagattgcttgcacaatgctattcgtacgaaaggatattattaaaagtgatttatgggcgggcgcggtggctcacgcctgtaatcccagcactttaggaggccgaggctggcggatcgcctgaagtaagcagttcgagaccagcctggccaacatggtgaaaccctgtctctactaaaaatacaaaaattagccgggcgtggtggcatgcgcctgtaatcccagctactcgggaggctaaagcaggagaatcgcttgaacccgggaggcaaatgttgcagtgagccgagatcgcgccactgcactccagcctgggcgacagagtcagactccctctcaaaaaaaaaaaaa

SEQ ID NO: 210616 - DNA, 504 bp, Homo sapiens
cccctcatgttctctaccctcaagggtcgccgaatcctcctgaaatccccggtggggttcgggctgggctcagctttcttctctgcctatccgcggtctcggggagccaggcgcggtgtctgcgctgcgccaaggagagcttccagctgaactcagaaacacctggggcttggggtttcgggcaggagacctctgctcctagacttgggggtcatttacacactctcatccccaaacccccctcccgcacggggattcagacgaaaatcgcgaagaggaataataaaacaaaatgcaaagtcctcagggagtcggcagcggagtcggtcccaggacatggctattgctttgcagctctcactgggaccttgggacggtcagcctccctctcctttccacagccaattccatgcgcagagagcgtcctaacccttacaactcgtctgtgctacacacccaccgcccaatggctctgaaactttttgcccatactcttagattgag

SEQ ID NO: 210617 - DNA, 413 bp, Homo sapiens
attgggtttaagcttggaggataaatggaaacagccattcgtcttcaaatgaaccaaaataatcctgcaagataaaaatacagtattttaacagtattaatattttaccaaaagaacttgaaggtgaaaatcccaaaagccacgacaattccatgattgtgaaaatattaagtatgcaaaattttttgtttgtttgtttgtttttttcttttgagacagagcctgggcaacaagagtgaaactcctttgaaaaaaaaatgcaaaaattagctggacatggtggtgcgtgcctgtggtcccagctactcgggaggctgaggcaggagaatcgcttgaacccggaaggcggatgttgcagtgggccgagattgcgccactgcacttcagcctggcgagagagtgagactccatct

SEQ ID NO: 210618 - DNA, 293 bp, Homo sapiens
aaacacataaccatcctcaagtctctgcctcccaatgcaacaaaggattggtatattcatttactccacaaatattcagagtttgagagaaattgtaaaataaattctttgaaagatttaccagttcaagaaatgcatatcatgtatatgaatgacaattaatatttattaagtgccactattatcagaatttatctcatttctctcgccccctctaaataaattagtctgtgaagctgagacaggaaaagagctgccccagggtggaaatcctcaaatggagccagggcact

SEQ ID NO: 210619 - DNA, 211 bp, Homo sapiens
actccagaggccatagtagttcaatactccatcctggacaagttacacggcagagtaatcagctgtttccttatgtcagataaacttactggaaaagtcagtttatagaactatagacttctataggtacagaagaatccctaagaagggagagggtgctttgtgcgtattcagagccacacatttctccggagaagagatggttagagca

SEQ ID NO: 210620 - DNA, 113 bp, Homo sapiens
gtgggtcccaagtttctgaaagaagagggctaaggctcagagaaggctctggcttctgagggggagaagccatgtgtgaacatggcactaatctgagctgatgggaaggcaca

SEQ ID NO: 210621 - DNA, 929 bp, Homo sapiens
gggaggccaactcaggaggattgctttaggcgaggagttgaagaccagcctgggcaacaaaaaacaaaaaaattacccgggcatggtgatgtgtgcctgtagtcccagctacttgagaggctgagatgggaggatcccttgagccctggagttcaaggttgcagtgagccatgatctccccattgcactccagcctggatgccagagcaagacacagtatcaaagaaaaagaaaaaaacacaaaagaggtagaagggctcagcaagtgctttccacattcgcattcccttaaaatcgggaatgctctaaagctagaggacttttaaaaaacagaaaatactacttaagtattttctggtgcccatgtgaagtctggcaaaagacagaactttaaataattaaagagggctaatcacgaaagaccctaagtctgcaggaaagatgaaaggggtcttcctaccaatcctcagatccttgaggactgacttcacagcacacaattggaaacaacttaaggtctcacaactactcatgaaatagtatgaaataatattcaaattaaaaattttatatagtagaatgtcaaaatttagattcggattatcaatgaaataacagcaacaacactggtaattgttagggtatctttacagctaaagcataaaattatgttaaggtcctgtgtgtgcaatctggaatcaattcgtctaaaaccacacaaataaaagtggtttagaggcaaacttaggacagcataacttttcaggtaggttaaaaaaaaatctcgaaccaagagatgacaggaattggtgatctgctggcagtgagatacaagagatgaatgaagggtgatatgggtactgtggggctgccttccttttccacacaaaattcttatggttttaagtcatttagagaagacagatttg

SEQ ID NO: 210622 - DNA, 398 bp, Homo sapiens
ttgtaaactctgagttgtacttttcctgcgcccactgcttctatgccactgtctccagatgcctatgaatttcaaatgcacagatggagccaggatctgtatatcaagcagcatctccccaagtggtttccacccaacacaagcagtgtaggatgtgaacaggcacgatttcaatacaaacactactgctcgaacaacagtggaagcacattaaacattcgataaaatgaggtcactgaagactcctcagaacttttcagatgctgatgtccagggttggtctccagggagtgaataaagtatgcggggttccccaaacctactggctttagggctttctgttgatgatcatttctggggagcagtggtctgcaaaactctttattttttattttttg

SEQ ID NO: 210623 - DNA, 354 bp, Homo sapiens
attttattgtggaaactggggagaagcatgcctcctgtccccagggagaaggcaggagcgaatgggcaagggcaagggaagggctttaagggagaggagaggtgggcctggggctcgctgagtggtcggctggagcagtgggaagtgccccggtggggccggtggctggtgtgggggtagaaccgcggtcagtagggtgaaggtgctgagggctggaggctcaggaggtggtggcaggggcctgactcttggagccgggcagcaggctgggtgtgctcagaggctcatggcccacctggcgaagctccttccaggtgcaggcaagcctgaggcgtcagggcagcaggcggccgc

SEQ ID NO: 210624 - DNA, 855 bp, Homo sapiens
catcattgtaaagttgaaaagtcttaagttaaaccatcctaagttggggaccgtctgtatttgaagggtatccacaaaatatggtaggtagtaattgcatttatttaagtgagaaatgctgataaaaatatacaggagaaatcttagaagtttgaaggcctgctgacagaacctgacaacatgagagaatctatttagaatctcctaaaatgtcaagaaaacgagtaatccacattatcagctgtagagaggtcagggagtatagtattgtagaataggctttttgaaatgtcactggaaactcatcaatgagaatttctggataagattagagattatcagtgacaaaattggagggcagtgttcatgaagatgtacagttctaaaatttggaaacactttaaaagacatgtttcaaaatagagtttaaatgctgggtttgttctcttttagctgtcattataaaaagcagaataaatgtttcaatgagcaatgtttgatgacatttaaatgtataatatcacccctcctatctgtaagccagattaatgctaagcacaattctaaaaccaaatgcaagcaaaaatgtacacatacactccaaagaaaagactcatttagattagttttcttgattttatgtcagcttctagtcggtgggtgggggggggttcgggctcccagtaagcagaacggacggacccgcaaagggacactgctggacgaccaacagagcgaagaaccggtggagaacctagtattaaacccggtaagctggaacaaatacggtacaaaatgggcccacgagaggagggagaccccccacaggagagccccgggggcccaccgtatcac

SEQ ID NO: 210625 - DNA, 319 bp, Homo sapiens
caaaaatcaagctgtctaacatagggtgacagcagtactcccaaaaagcagagaaggatgaggcagaaaaagtatttgaagcaatattggctgagaaatttccaattttgattaaagtaaccccacacaaacagcagcccaggaagtgtggccaattacaagtaggataaataacaaagaaaattgcatcgaggtgtatcacagtgaaactgctaatattaaataaaaagggaacaatgatgagaattatggctgactcataatcagagacagtgtagcacacgggacaatggaatgatgttttcaaaatggcgaaaga

SEQ ID NO: 210626 - DNA, 421 bp, Homo sapiens
gaaacgaaagctccttctggtcagcatcccctcgtggatcaattcttgccagggtgcatttggacaataattttgcagggtcaggcaaagcagaaacaaacaagagtcaggctacctgggcaagctcaggtgtcgctgatgagtaatgcctgcagaaccctctggccagtctgctgcctcctcaagaagggctgttagctcaaccagatacactattatcagcttttaaacagcgctttggagcaacagctttactccccgaaaagatgcagaaaatcagactctttcaggtgattctcaaaaacaggggacccaccccagcccacgacaccattcaaagttgagaaagcaaagtgaattaaaggggtttgcaaccgctttcagactcatccagctgccgtccacaatgacaaacatatat

SEQ ID NO: 210627 - DNA, 404 bp, Homo sapiens
tcagctaagaacacagttccccatcaccaagctttgctttgcccaacagaccccttctcccttaggatgagattcagtggataatcacatcataatcacgaccctctgggaagccgcctctctcatcctgggttgtgtgttgtgtgtttcctttccacactccctcagcagcctttgcctcccactttcatagaatctaccatatgggattttaactgtttgtcttccactagacaataagctccttgaagactgaatttccaggaacttctgttggatctgcatgtttgtgaagtgaattactgaaggctgcccagtttcatctgatcctagtcaaaacctaaatcccttatttctacgctaccttttgccaggtaaaaataaaacatgtaaaccatcatatc

SEQ ID NO: 210628 - DNA, 362 bp, Homo sapiens
tagattggtacagccattatggaaaagagtaaagagctttgtaaggaaattagaagtagaactacagtatgacctagcgatcccttttctgggcatatacccaaaggaagtaaaatcaccatcttgtaaagacatctgcactccatgtttacagcagcgccattcacaacagtcagcatatgaaaacaactgaaggtctgtcaaggatgaatggataaagaaactgtggtgtatgtatgacagaatactattccgccctaaaaaagatcttgtcattcaccacacaggaataggcctgaaggacattaggggcagtgaaataagccagatacagaaataaaatattgtatatggcctggtgt

SEQ ID NO: 210629 - DNA, 512 bp, Homo sapiens
cgtgagccactgcacccagcaccatatcaagttttgtaaatcaggaaatatgagttctccaactttgttctttttcataactgtttaggctgtttggggatccttacgattccacatgaattttaggatgggcttttctatttctgcaaaaaatcattgggattttaataggaattgcatcaaatctatagacgactttgggtaatattgtcacctcaacaatattaagtcttccagtccatgaacacaggatgtcttttcatttatttacatctcctttgatttattttagcaatgctttatatttttcagtatataagactttcatgctgggtacagtggctcatgcctgtaaccccagcactttgggaggccaaggtgggcggatcacaagatcaggagattgagaccatcctggctaacacggtgaaactccgtttccactaaaaatacaaaaaattagctgggcatggtggcgggcgcctgtcgtcccagctacttgggaggctgag

SEQ ID NO: 210630 - DNA, 532 bp, Homo sapiens
ccgctcatctcgcagtatccctacctatgctcctgggaggagtctaccccagatacggttagggacctgcctttccctattaggataatttcttggaacttgggaattggacttctatggaacggaatcgattgaattaattttatttatttatttatttttaaaactttaattttaggtcgaattaattttaaagctgagttcaagggcagggaaaacgaccgggtgggcctaagcctgctggggtgtgacagcttggggctgtggggacgggggctggcgaaactttccttgctctgccgcttgggctgagtcggcaataaagactgcggggacaagacttttgccccttgtaaggttggatgagaggcaggaagataaaggggggactgtctgtgctgacaaaatctggaaaaggtgatgcactgggaatacttccttttggaaactggtgctgacttataccatcttccccacttattatagcatttttgtatccatttcaatacagttaacgacgttctgttaaaca

SEQ ID NO: 210631 - DNA, 350 bp, Homo sapiens
atcttttcaatatgctgctggattccatttactggtattttgttgaagattttgtatctgaacgcttaagataacatttacactctatcagaaatgaattgaccataaatgtgagagtgtatttgtgggttcttgattctcttccattccaaagatagacatacatccgtctgtatgtctgtctttatgccagtaccatactctcttgattactattgctttgtaataagttttgaaatcagaaagtataaatgagattttggtatctgagtaacagtcctcatagaattagttgggaaatattccctctttattctggtccctctttcttttttgtttaactgtgtatc

SEQ ID NO: 210632 - DNA, 377 bp, Homo sapiens
actcggcacgaggagatttctctcagcaaatgaaggaggcatccaccaaactgtcagggcccagagaggagaaaaagacagaggaagggtgcatttgatatctctgactgggacatccatctccgcctatcctgggacctccacactcctggttctctggccttcagacttgatcagggactaacaccatcgcctcccacccccacctttgttctgaggcctttagactcacactgaatgataccgctggctttcctgcttctctgtcctgcagccagctgattgtgggacttcactccaaaattgtgtgagccaattcccataagagataaataaatttgtaaataaacacacaaatttcctacaggcttatctta

SEQ ID NO: 210633 - DNA, 485 bp, Homo sapiens
tattaatacaacatcccctccagcaaaggggagtgccccccagtcccaggtaccgtgtgatggcgatcattgcgtcccctttcctgagacctttcacggcagcgtacacctccaggtgctgcctcactgtcaggttgggccacagcgcattctcctgagggcagtaccccaggaagcccaggggttcccctccaccgctccctttcaaaatcacctatgcaaaataagttcattcttagattctatcccaaatgtcacgtatatgtatatgcatgtaagccgtacttcagagatgcccttctcttcacacacacaggtgctaagtgcacaaatgcaaatcagtaatcacttaactttggggaaaaggtggtaaaagcccactttaaaaggcagacattccatggttatccattgtagtgtagactttactaccaattccatgaccgtgattgaactcaagattgctgatttgagtgtcttttact

SEQ ID NO: 210634 - DNA, 1155 bp, Homo sapiens
gttaattcatgatacaattttaatacattttaccaacctaaatagaaaatcaaactgaaaaagtaacttcctcattaaacaaacacaaaaaaattctaaatttacatgctaggtaatttctaacaataattttttaaaaggattttatcttaattttcatttatgtttctatagccagagtcttcccaagattcaatactttgtttggtttcctatcatctcaatgatctcttccaaatcctgctgaagttgttagaagtaaaattatctccatcttataaatgggaaaagtaaactggcaagtcaaagaattttctagagaataggcccacagagaaggctgttaaaccaggatggagagatttaaacacatacacctaggggaggcagagaagagacgggaacatgaggtggcctgaaaatgagcacagtatttgaaggtctcccaacatgagtttgatcacatttaaagcccaccaatttagagctttttcaaactccattcaaagggggttttcctgacgtatctgcaaaacctaataagaaggccctgtcctctgtgtaagcagcttttcatacatgcatatattcatttattgattcattcagtaactacttattgagcatctactatgtgaaaggcattcctatcagccctggagatgcaatcgtgagtaaaacagacagaaatgtccctgccctcacggagtttacatcctggtagtggggacagaaaatttaaaaaaaataaataagtaaaatatgtgtcagtattaagtaccatggagaaaaaattaaacagcgatgaaaaatataaaacgtaaggatggttgaaatattcggtcagccaggaaaggtgtcatgaagttgagttaggaaactgactacatgagaaacatttaaacaccttcttaccttgtcagacggtattctgagttccagattcaagcagcctggtttccatacacagtaccactttttatttattgtgagaaaattgcctaattttgtgtctcagtttctttatctgtaaaatggggataatttttttaactagtagagttgtgaagagtcaatttaaaaacaaaacacatttagtgcttaaaacagtgcctgatgtataagaactcaataaatattaggttttgtaaaaac

SEQ ID NO: 210635 - DNA, 351 bp, Homo sapiens
  misc_feature (2)..(2): n is a, c, g, or t
  misc_feature (13)..(13): n is a, c, g, or t
  misc_feature (39)..(39): n is a, c, g, or t
  misc_feature (42)..(42): n is a, c, g, or t
cncccccactgtnggcatcatgatgccgacagtggggcnacngtcggcatcatgatgtgattttactcttcatttgccttctgccataattgtgaggcctccccagccatgtggaactgtgagtcaattaagcctctttcctttataaattacccagtctcgggtatgtctttattagcagtataagaacagactaatacatccggtctcatctggaggtttgactgagggaagatccacttctaagctcactctgtgactactggtaggcctcaggctgtcactggctattgactgaagactaattagtttcttccctggtggacctcttcctagggcagctcacaacac

SEQ ID NO: 210636 - DNA, 406 bp, Homo sapiens
agcccacattggactagagagagacttcagaccaagatatcatgtttatgttcttttagctagaattgtgttaaggcaatgactatctcctacagcttagaagttctgaagtacatggccaggagcggtggctcacacctgcaatcccagcactttgggaggccgaggcgggtggatcacccgagctcaggagtttgagaccagcctgggcaagatggtgaaaccctgtctctactaaaactgtgaaaaacacattagccgagcatggtgatgcatgcctgtaatcccagctacttgagaggctggggcacaagaatcacttgagcctgggaggcagaggttacagtgagccaagatggtgccagtggactccagcctaggcaacagagcaagactctgtctcaaa

SEQ ID NO: 210637 - DNA, 500 bp, Homo sapiens
tacggcactgttagagcctgtgtcttcaatgccagccccgtggatgcctacgagccttctcggcagccgtgcgagtgccttccggaggtagccttcatggggccgcgactgctgtccaggagctctgccaaaagcgtgctttcctcccaccgtcacagcagtgctgggacgtaggtgtagcatccgtgtgagaacacgaggcctcgctgtgccagtaagaggccaggctgggatttgaaccagattgtctatcttcagagccccggcctcgaaaatttcacttcttatgggaaattccaaatgtgcacggtaggaagaaaagagcgctccaccttgagcttgtcaccacatcatgtggtggcctcgcccacgccgttcccctcccccagataacccgcctaaatctcactcattcttttgtttcatttgtaaacgtgtgtatcttttaaaaggctctttgtaaaaacataacctcaataccggtagctcatgtaaagcaa

SEQ ID NO: 210638 - DNA, 473 bp, Homo sapiens
attttatgctgctaaaacctgctcttctggtttctttagaaagaaccaggagatcttcatggtttctgagcctgtataggcttcccatttagagggcccctggcacccacgtgtcccactctgttaccctttgttactttatgtgtttataagctgttaagtgtagtgccttaaaacctcaggctttggccagacgaggtggctcatgcctttaatctcaacactttcggaggccgaggcaggtggatcacctgaggtcaggagttcgagaccagcctgaccaatatggtaaaaccccatctctactaaaaatacaaaaattagctgggtgtggtgacgtgtgcctgtagtcccacctacttgggaggctgagacaggagaattgcttgaacccaggaggcggacgttgcactaagctgagatcgcacaactgcactccatcctgggcaacagagtgagactcaaaaaaaaaa

SEQ ID NO: 210639 - DNA, 247 bp, Homo sapiens
agacttaagacatctattctccacactgtatatttttagactctatatattacagaatctatatatttaatacaattcaatccaaatcccaggaaaatttttcaaagaaattaagaagctgtttctaaaattcatatgaaaatgcaaataatctaggattgtccggacagagacggagttttgctcttcttgcccaggctggagtgagtgcaatgacgcgatctcggctcactgcaacctccgcctc

SEQ ID NO: 210640 - DNA, 591 bp, Homo sapiens
attaattcattcttagaaagtgaccataccaaaggcttctatgttttctttgtagaattcatgctactattttcttgaatttttatttagatttaactcccttccttttccatacgtaaagggaaaaaatagtggaagtggagaaattattagccaaaactcactaggacatttcccaccgtatgctgtactagatttttaggttcttaaggaatttactgtagatatttcagtagaccctttgacacggacagtatagataaaggtatatcctttccctcatagactatattactcttaagataacatttagccaaactacatgtaaccaagttgttacccttatgcttgttatatagcagaaatctctgtgcccttgctacctgttgtttatattcattttaagtagaaattaaattcaaacaggaaatggcaggcatgtatttgcaaatgaagttgaacttaaaagatattaacttgggcctggcgcggtggctcatgcctgtaattccagcactttgggaggccgaggcaggcggatcatgaggtcaggagatcgagaccatcctggctaagacagtgaaaccccgt

SEQ ID NO: 210641 - DNA, 492 bp, Homo sapiens
tgcggcagtgctcgtaacaatggtcgtagcttgtgttccgggtagaacgtgggctgctgatctccagtgggtctctcgtatgcattacagagccgatttcactaatctgcgtgtccactcttcctttaaaaccatgggtgtcattccattgcaggctcagtcctctgcctgtctctggtttctgagtccaggcctctaggtgccatagataaggctctgttacatagcctgaatagccctgtgaatgaggagaggaggcatctgttgtgagataatgaaaatggtaggtggctagcacctatttatactgttgttcgtacaccacatactcagtgaatatcagaagaatggcgtgggtacatctgtgcattcacgaatttaaaaatttcacttattttggaatttgtcacatatgtgtgcctatatgcatcttttcttgttatacttacaaatgtgtcttccaacatttgttttccttagattaagtcaaat

SEQ ID NO: 210642 - DNA, 575 bp, Homo sapiens
aaatgaaacagcacagagatatcagatttcacctatgaaacagggagtggaggtaagatctaatgatgtagaatgtgccatgtcatatattgctggtgggagtgcacttaagagatgatttggaaatacttatcaaatgcctcaaaatatgtgtatttttgacccaatagttctatttatggagttttatcctaagatcataatttacaatatgccagataacttggatagaagaagggtcaatgtgctgttcttaatacctaaagaatggaaacagatccacatgcccatcaatagggaactgtttagaaatgttacagtaatccacacaaacgaaaactgttggcgacatattggtaacagaaagaaagcaaatttgcatatcacagtaccttttttgaaaaaaaaagtataaggaaatatgtctggaagagcgtgtaaaatgttagctgtgcttaaaggctgtgaatgagttttatgttgtcctgtgtttccatattttccaatgtatcaccaatgaatacctattatatgagtaataaagaaaattgaaatattgatttttgaggaaaaaa

SEQ ID NO: 210643 - DNA, 991 bp, Homo sapiens
agatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatccaagattgattcatgaaataaagaagacatgaattgttttaagtctacactttgtaattagctaagttgtgcagtattttttgacttaaacagagtatgaccctgaaaaataaaagaatctttttttttcaaaactcatcctacctacctgtaaaaactgtacaaagctaatgtatttttcatattgtaaagtttcaattgtagaaacaactggtatgtacagtaccataatttaattacattttactttaaaaactttacacatttcagtttctaaaattttaaattaacaaaaattatttcttgtgttattcagagttactcagttttgtaaggactgttttgttactgcttttgtgcccagaaaccttgactctaaaattctgtgctgtgcgaaacatgcacgatttttattatgcttactgcgtagaattttatctacttgttccagaaataatacattaaccaaaaaggatttaattgttcagacttgtaagaggttcttcaattacataggcaggtttttcttaaaaatgaaaaaaaaatcaaagatttttttaacagttctcagacttaactgttgccttgaattacagcctagtttctaagcagtgaaatgtaatgataaagagggatattttaacata

SEQ ID NO: 210644 - DNA, 374 bp, Homo sapiens
caaagttatctgactttatttattcagaaacacaacccattaagtgaaataatggtgaaaacaaaagtgactttccagcttttcgatcgggccccgcctccccggcccttcaattcccgaggcttgaccgggagggagaaagttcccccaaccgcgccaccgcctgcttccactgcaggcaccgggcaggacattgttgggccaatgaaggtgatttttttgtcactctttgtgtttccacttcctgaataacactcgctaccatcattaccatgcaaccagaggcagctccctcttccattcccttctcaagtcatatgtcctttttcagaattgtctgcattacttttctaccttttagaccctcaaatgct

SEQ ID NO: 210645 - DNA, 179 bp, Homo sapiens
ctatggctgtatataggaaatgttgacttgactatcttacggaacagattctgcatggttttagaggtaaatgtttgggaataatttgcagctaacgtgtatcccaggagttcaccatttagtgcaattcacaatcagaatttcttttaacaaatcatattcattgaaaatgatagtca

SEQ ID NO: 210646 - DNA, 332 bp, Homo sapiens
taagttgtgttgtttaataacttcacagaaattttaacttcttaaaaactaccacacccaacccttagacttttaaactttcatttagatttgtggttgaacacaattacaacacaattatgtgctgtaataatttaaaacaatgttcagtgattttacagttcaactacctctgtttcaattgctccattaaatcatattctcactatgtaccaagaagtacacaatgagtattgtcattgacttaggatataattcacctatatttgatttcagaaaaaacaaaaacaaaaaactagctgttacttacaaaagagatcaataattgatat

SEQ ID NO: 210647 - DNA, 376 bp, Homo sapiens
agaaataggagtgctgggatggtgccaaccagtgtgtaatgtgccaatccttattaaagtttatctttgaggaattttagaggaatttgaaaatatggcactaagggccgggcatggtgactcacatctgtaatctcagcactttggaaggccaacgcaggcggatctcttaaggtcaggagtttgagaccagcctggccaacatggtgaaaccctgtctctactacaaatacagaaaattagccgagtatagtggtgtacgcctgtagtcccagctactcagggatctgaggcaggagaattccttgaacctgggagtgagccaagattgggccgctgcactctagcctgggtgacagaatgagactctgtctca

SEQ ID NO: 210648 - DNA, 313 bp, Homo sapiens
tgtgcagaagctttttggtttaattaagtcccatctatttatctttgtttttgttgtatttacttttgggttcttgactttggggacttgggggaaagggtggggggtggagagggataaaagactacacattggctacagtgtacattgcttaggtgatgggtgcaccaaaatctcagaatgaccactaaggaacttactcatgtaaccaaacaccacctgttcccgaaaaatctattgaaataaaaaaatttaaaaaatgaaccaatcaaaaataactgcaacaacttttcaagacatagacaacacaata

SEQ ID NO: 210649 - DNA, 172 bp, Homo sapiens
ggaagttggcttatagccctcaaatgctatgatgggctgagctacattttattttttattattattgtttgcagaagtctataatagaaagtcaggtgtggaaatggggaagcactgaagttgagttcacaacttagtgaacacaaattagttgggtgaccttggagagatt

SEQ ID NO: 210650 - DNA, 502 bp, Homo sapiens
aaaggtggaatcctcttccccgatgccttgttttatagcttcctttgccattaggaagatgatcattgctgtagtacatttatctacatacacttaggagtttagcttgtccagggcagcaaagcccatcttttctatgtcctcagatttaaacaaatttattatgatttttcaccaagtactaagaatgatttgtacatgctgtagataatcagtcattaattctggggaacattcatatccatgggcataattatttctaaagataattttatagggcacaacctgtgcttttgcagttattgtaaaacaatttttgttatcttgctagttattgttgttattgtaaaatacaccgaaattctctaccgtataatttttaaatgcagcattcccagaaattgaggttgtaaagagaccattaattttgcaaatgattaaagtctctcactggttgctggaacctctgttggaatgctgtctttagaagctgcatttggat

SEQ ID NO: 210651 - DNA, 336 bp, Homo sapiens
tggaggcctaggggattttcagccccctagcaaatccattctgatcctgacttggattttaatctctagaactctcatgtataaaattttcagccatttctaggaattttaagaaaagctaatatgggacttttcagttcagttcagatttaaaagtgttcaggacccctgaagggagtactgaaactaaggaagttttctgaataacctaaacctgaaattggactaggagcagaagagagtagggtctggaggatctgcccatcgcagacctaaaattccgtagtctttttggagatctgaaatgagtgatttttgcacttaatgacttccctc

SEQ ID NO: 210652 - DNA, 452 bp, Homo sapiens
gctagaaattggtgtttttattatttttgaaagccgtcccctagattttttaaagcaaacttttttgaaatttatacagaaactgttttctatatacatctttatactaaaagtacatagatcataaatgtccaactcagtgaatttttactgtttaaatatatctgtgtagtcagcactcacatcaagaaatagaacgttaccagcaccccttgtaaccacccagtcccctcgcagtttcttttgtcgtaaaggtaacaactactctggcaatagatttgttttgcctgtttttaaactttaaatcatacagtatgtactcttttgtgtctggcttcttgctttcaacagtatgtctgagattcatccttgttgtcacttggaacaatagttggttcattctcattgctatataatgtttcgccatataaacctgtcattatttgtacatt

SEQ ID NO: 210653 - DNA, 321 bp, Homo sapiens
taaactatttgaaatgagcatgtctttctttttatcatgatggaaagaacagtttttttaaaaactagaatcaaaaagcaactctgcccaaggaaaattctgcatggaaaccccacggcggcatgatggggaggggtcagggcggctcctccgagagcagctgctggctccttatcctggtggcagccgcggccttatctctgtgatgcagacagaggctgccatggaaggaggaggcccctggccctgggctgcccacacagtgtatacaagacacagccacccgcacctggcagccactgtcgccaagtcgctagggat

SEQ ID NO: 210654 - DNA, 194 bp, Homo sapiens
tcagaactactggaccaaaaactgtgggatggggcccagtaatctatgtctaacaagccccccaggggagaggaaccactgataaaaatcttgctagcatgctgcagagaaatatgctatgacaatctgtactttgggatccacgcttcaagagcattctagactgggaaatagggagattacttacttagcct

SEQ ID NO: 210655 - DNA, 619 bp, Homo sapiens
  misc_feature (308)..(308): n is a, c, g, or t
ggcctctcaaagtgctagaactacagatgtgagccaccacgcctggacccaaaacagacttttaacagaagaaagtttcacaagacttatcatttttctgagatctgaacaaccattgccttttaaaagcacatctgcctttgaagtctcccattggtggacaggggagtcctatctcctatgagaccaccttggttcctgctggagggcagcttccacatattggtgtgtggcaggatgaaaggatgctgagctcctaaagccagttatggtggtgtgtcaggggtcccccacggaaattgtaaaanccccaaaaaaaagcccccagacccccgggtttttatcttttttttccccccggaaaaaaggggggtgtgtggagggaacccgttgtggcgccaaatttcccccaggaggaaatttccccgttaaaaaaattttttcttttttaaggcttattttcccttacctgggggcaacagaggtttaaaaaaggcttttaattggcacaaacagggggaattgggggtgggcccctatccaaaccccaatcgccgaagaacaaacaaggcaccccccaaaaaaataacccccgtttatcggcgctttcaccttttcc

SEQ ID NO: 210656 - DNA, 372 bp, Homo sapiens
cctagcaaaatggaaaaataacaatatgtgctgaattaattattagcttaaaatttaaaacttaagtagcatgatttgagtgcagccagcatcacctgccgtgagatcggtgctgtctacaggaggatggagcttttggtgaaccactgagctgggagtagctacgggcacctttacccagtcccaaaatgtggaacatttgagtttaaaaagcagaaaactctacagttaaaagccaatattaaggttgagtccattaatctaaattaatctgattttttatttctttaaataaaaaagtaatcctatgcaatcaaagttaaagttcgtatatggctccctatgaggtactacattccctgaagtgtccca

SEQ ID NO: 210657 - DNA, 395 bp, Homo sapiens
aacggcagtgcaccctatctatctcatagtcgactctctgagtatcccccgttttaggagttacatgaacaattattcaaaatatttctctattcagttttctaagattttattcggatttttgcatctatactcataaaaaaatcacctacattatcttacatcctcttgcatcatctttcttacataattttatttttaaaatgaaaatcctgtttacttcattaaatgaattagtgtcttatgatcattttctatattttgggagtataggggttttttgttttgttttgttttgttttttgagatggagtcttgctctgccacccaggctggagtgcagtggctcgatctcggctcactgcaacctctgcctcctgggttcaagcaattct

SEQ ID NO: 210658 - DNA, 426 bp, Homo sapiens
ctcttcaaacgatgtatgagaagacaggtgctacaccccgtgtaagttttccctgagcaatcctgaaatgatttggttttctgacaactctccccatgtcagatcaactctggcttggcagagaccttacaggaacacgctagagaactccagacgaattgcatcccacggaattctaatcaccaaaacccagctgatcagaatcaccggggaacttctgaaaactagttttctcatctgcagtggatcaaaatcttcagggatcaatctcaggaatcaaaacattctactaatcatccagatttgatcaaatcaatatagcggcactacttaagacagtttggctaatggaaagcaagcaggaggtatgagctttcctcagttatgttttataccacagtttaattatatgacaaattgttgaga

SEQ ID NO: 210659 - DNA, 319 bp, Homo sapiens
tacagtagaaacttcctttgcaattctctcactatatcaaatcctaaaagagacaattttgctgtcctgaattctcaccaattctgagttctcccaaagaccaggttcctgccaaactatagcagtgagccctggatcttctcaaagaaatttaacatatttttacaagaaccttctcacaggtggtgtgcaacttgcctgttctacaggaataccaaccaggggctgcctcctatagctgcaccataaattccatttccacaactcaagagatttaacttctgcagagagagatcctgaagaatggatttgcttaagg

SEQ ID NO: 210660 - DNA, 310 bp, Homo sapiens
agcctccctggccctcaggcactctaaggtcacttctcctgagacacctgctggttggtctactgcctaaatgccagcctgtccacctgctgccacccctaaccccccgcaaggctggctcctctgtgtgactcaagtctcagatgaactagtaccttggaaaggtcttccctgcactctcccatctaagatcccaacccccggcacgttatcttggtttactgagtgcccagctcccaccaccatcagaaattaccgttcctgcattaacagtcactgctgctccccacgctctcccccacacactcta

SEQ ID NO: 210661 - DNA, 619 bp, Homo sapiens
ccggtcttgggctttgaagaagcctaggagaaattccgcttcggccatcacgctatgaaaagtggatttttttttcttaagtcaattttttttttttgaaaatatgagacttagtaggtttgggaagtgggctaaaagaacatttgatattgtaattgaccccccctttaaggtgacagtgtttttcccctacttaaagcgccaacttttttgtgcactataaaagctattactatccataaattgttactctcggtagaaaataacctagtcttgctcggtgttattgaagagccaagagggtattggagaatcacctccagaaggaacaaggaagctcattagcactgaaagtcccccggatcaggcccaggaagctaagcatccgtatactttacaaatggaactaaagtcagctactaatgggaactttgcacaaaagaattagtttctgacacacaattcgcagatacatttacacaaactgatgggacaacttgcagtcacaggagcaggctgcattagggagggttcctgccctactgagttccaggtggatttaatttcactcattcctttccttatgatgtgacgtttctacccccccaccctttttgta

SEQ ID NO: 210662 - DNA, 307 bp, Homo sapiens
ggacaggttctattggaaattcctcttagaagattcttaaagtaagtggagagaggctgagtggaaatttagagctgggaatcctacagagagtgttcaaagccagggatggattggctctcttgggctgggtgggggacatttgtgccctggaatactccattcttggcattcaaaagtgagccctgttgggaactcttcacatgactgaaaacttgtattctttttttctagttcaagcaaatatattcagacatcttacactatcactctattactactaagaaaaacaaaaaccaagactgaa

SEQ ID NO: 210663 - DNA, 101 bp, Homo sapiens
tgaggagatgtacaggatgagaaggagctagctgtgtgaaaagtggtaaacaaagtaaaggggctaatgtgcaaagcctctgagggagtgtgcttaaggac

SEQ ID NO: 210664 - DNA, 474 bp, Homo sapiens
ccaggaaggtgcttaacaataataacgtctaccgtcattgcctactttttgagagaggcactgctctaagagttttgcacctattgtgtatgatccctaaaacatctctattttacagatacggaaattaaggcatatagaagtcagctaatgtgcccatgatcacacgggaagtgaacctggattcaaatccagttggcctccagagcccatgcattaaccattaagttctacttcggtccaataaatgatataggtttgcataaagaagtcaatctggcagggcacaatggctcctgcccataattctagcactctgggaggctgaggccagccgatcacttgagcccaggaattcgagaccagcctggaaaacacaagaagaccctgtgtctacaaagaatacaaaatttagctgggtgtggtggtgcacacctgtagtcccagctacttgggaggctgaggtggagggat

SEQ ID NO: 210665 - DNA, 260 bp, Homo sapiens
ttctatgagaaatggacaggcccagaatgcagaaaaccagtaaagacctaacttcttgttgtagttaaactcaacatcaccatcatccaactggatattcatagactactttatctaatgacaacagagtacacattcttctcaagctcacatagaatgcttgtaaagatagatcacattctaggccataaaacacactttaacaaattttaaagaatacatatcattaaaggtctattaaaatagaaaccattaataga

SEQ ID NO: 210666 - DNA, 250 bp, Homo sapiens
tgtcattattcttatcatcattatctagttgtatacacagctttactgatttttcccccccctaaatagatggcatgattgtgggcaatgacttcattttcctacttgtagaaatcagttgaaattctagtctccctttcattgcttatttatgatagacttgctttcatagggttgctggtgatggcaccagttcaaacattttagatgaaggtttataagaatgtgtatactgttcagatatggggtt

SEQ ID NO: 210667 - DNA, 600 bp, Homo sapiens
tttcagcctttaaaagcgcgggccctgccacctttcgctgtggcccttacgctcagaatgacgtgtcctctctgccgtaggttgactccttgagtcccctaggccattgcactgtagcctgggcagcaagagccaaactccgtccccccacctccccgcgcacataataactaactaacaaactaactaactaactaaactaactaaataaataaaatctctacacgtcacctctaagtgtgtgttcccgtgaggagtgatttctaagaaatggcactgtacactgaacgcagtggctcacgtctgtcatcccgaggtcaggagttcgagaccagcccggccaacgtggtgaaacccccgtctctactgaaaatacgaaatggagtcaggcgccgtggggcaggcacctgtaaccccagctactcgggaggctggggtggaagaattgcttgaacctggcaggcggaggctgcagtgacccaagatcgcaccactgcactacagcctgggcgacagagtgagacccggtctccagataaatacgtacataaataaatacacacatacatacatacatacatacatacatacatacataca

SEQ ID NO: 210668 - DNA, 326 bp, Homo sapiens
cagaagccaaactaattttgactactaaaattgtgagtcagaagccaaactaattttggctactaaattagttacttccctcgggcctaccaatcttcatatgtataccatggcttattttgacttagctggttaatttatccagatacgtagatggtagcaaattggcattatcaaactctactttttcataccaaagagcaaaataagtgtgcttataaccgtagttcctgtctttataaaaatgtatgaaaaaatttgagcttctgttgataaataaaatgtaaatgctactttttgaaataaaactttacacttataggctt

SEQ ID NO: 210669 - DNA, 211 bp, Homo sapiens
gaaatctccgtactttcttacctcaatcttactgtgaagcaaaaatggctctaaaaaattaagtctcaacagatgttttgatgaggcagatctattttactctttcgtgaagctcagcatgcagctctgtgatgttgtactaggggagatgctagaccagagtaaaaatatccagccagttagggctcagaatctggacccactgaatctt

SEQ ID NO: 210670 - DNA, 248 bp, Homo sapiens
aatggctcaagcaagtactctaaacagaaaaaaagtatagaagaggaatttctggaacagcaagaatgaagcaaaaaaagaaaagaaaaaaagcaacagaaaatggggaaaaagtaagtaaacacaaaacattttcctttttttctcaaattttctgcaggagtttcaaattgctcaactggctattgctaatattaaggaggaaagagatctagggaatgaggcaaaaaataacattcttctctggt

SEQ ID NO: 210671 - DNA, 632 bp, Homo sapiens
cactttctcatcattccatgactttgctttgcatctactgttggcagctggaagggccaagggtccttgcattgccctgaccttcaagggctccggatttcctgtgagagatgtccaagctccttatctgggcatgcacagccttgttggatcatcagcctcttctcctgcccagccccaaccatgccagccacgtcgggctgctccctgctcctccaaggcctctcctggcccctgcacctttgccactctccacctgtggtgcatataaatacctctttggggaaaataagaattaaagccctagtccctctatgatccaacagaagtgtactcggtttgcttgagagagccctggtttgtatcaatatatgtcggcactttagctttcctagcgcaggagtgttttatatttattttgataaaaacataattcagaatattaggtgagcctttaaggagcatcgatttattcaatgcattggtgaactccagagttgacataaatgtgctcttttgggtgagaactcatcctgcctctcgtttgcaggacctaatgagatagaattataacgtaattttttttaagacagagtcttgctcttgtcgcccaggctggagtgcaatggcat

SEQ ID NO: 210672 - DNA, 408 bp, Homo sapiens
ctcaggcttaggccggggatggccctgcagtatgcctgcacaggagttctggcctgccagcagcagctctggcaccccactggaagctccattcccccacctttctggaagtagccttgaaggcctagagcttccaaagtagtgagatagagactgcagggattgtccgcctggttgagcactcatggttccagggagggttgaggcactgtgctcccatggctgacttggcaaatcccaccagccaccccatgtcatacccatgacagacatcactaatggaacatggagctcttctctgctgagtcctgctcaggcctctagagcagagctagccagtcagaatatagtgcaatccccatatgtcattttaaagttaaaatatttaagcatgttaacaaaaatagc

SEQ ID NO: 210673 - DNA, 279 bp, Homo sapiens
cagcattttgacttgtccttttagactggctctcctcaactcaagatgaaaactcaggcaacacgtgcatatgacagctttcaaaaaggattgccccacatctttactcagatccaagaaaagcttcctaatctcatcaatgacaagaggactggaattcccagctttaccttagactaaccaagatccattctcttggagctggggatagcattccatttctggaacacatggcttggtgagggatgaacacctgagcagcatcagagccctcctggc

SEQ ID NO: 210674 - DNA, 370 bp, Homo sapiens
ttgtgcactccaaataaatgtaataaccatgcacactactataaccaccctaaccctgacttccctaattcccctccatccttaccaccctcgtaaagcctaacaaaaaaaactcatacccccattatgttaaatccattgtcgcatccaccttttgtgagagcgttggtgggaaaacccttcataaaggacattggagaggggccatttaattatcaaatgtaacacagttaaccttagggagatgatgaagcgagatcattatgtgtcactacttgctgggattctttctatttaaattataagttcaggttatatgatgttgtatgttcaataataatgctcataatagatgaaatgttataatgag

SEQ ID NO: 210675 - DNA, 396 bp, Homo sapiens
agcaaaagtgtctctgaagcagattcagggattagatagcccttatccgtaatgaaagacttacattataaaagaatataagtttccatggtttttatctttcaggattaccaatgatgtgacttttacatgttaattgttaattttgcatcttaaatatctgaactgacaaaattttaatttaagttttgtaccttttaactcccttttggccaaaaggaattttcaaaaatatgtattccattcccacagcttgccagttgcctccaccgtaagaaaatgctgaatatgacatcatatcactaatatgccctctcagttgccaaatattttggttgttagattttttttttttttgagaggatggtactcataaaatcaagatcgctctgtcac

SEQ ID NO: 210676 - DNA, 355 bp, Homo sapiens
gaagcaggtggtgaaaggagccctgatgctgtatcctaaaaagttctgactcaggcccaagccacaaaagagaggctgtggccagaacaacaaattgtgggatgctcttggcccattggtactgctgtttgcgcacatccagtattgaataaggaatagcagagacctaataacatttcattacatcaaaaccctttcacatatcctccaaaaggagaatttctgcctaaaaatagactgtttttcagcactcgaattgcacacatttattgttttctgtattagctctttgattttatcaatttattcaccaaccatcccagtaatcaatagcaataaacaaaaatgaattaat

SEQ ID NO: 210677 - DNA, 310 bp, Homo sapiens
cccaaatggaatccttcaaggcatgagcagatgaataaactggaatactactcaacaataagaaagaaagaaactatttgatatatgcaataacttagatggatgtcaaggttatcatgctgtgggggaaaaaatccagtctcaaaaagtcacacactatgaaattccacttatatttcattcttgagatgataaaattatagtgatggtgaacagaacaatggttgtcatgagttagggttggggaaagttgtgactctaaaggataataggagagaattaattttttgatgatgaaacagtccatctt

SEQ ID NO: 210678 - DNA, 391 bp, Homo sapiens
aagtgttaatttctgcagcaagttttatgtcagcatagattagaattcaattatctttgtatttcttgagtataacttgagttagggaaagtgagataagcatttggtaagattaataattaaccaatgttctatattgagatttgtgccaatttccacaacaaattcaacattaagtccttcgtttacacttgatgcctatggagttttcctatctactttatgaatgtgagaaagcacaagacgatgcacataattatgtataaatatgcttaaacaagttttgaaggcccaatagactactactaaataaaaataaactatcaaaatagagccctaacgtaacagcgaatagattttgtacttttcagaggcagatctgcaattactt

SEQ ID NO: 210679 - DNA, 122 bp, Homo sapiens
ttagagagtgtcatggagagtggcaagtggtctggcttgttaatgactttgtgaagccttaaactgccttcctttgggtttctctctgaaagaaaaataaactcttatcttgtttctgcctt

SEQ ID NO: 210680 - DNA, 275 bp, Homo sapiens
tgtgttactttctgtgtttctttgtggcctgtgagttttagccccttttgtcttcagttatccctcttacactcaaccttgagaaatgatattatcctattattttggatacttttggcagttacactctcaagtctgtgacttctggaaccatgcagatctttattgtaagacagaaatcccattatctgatttacctgcccattttcagaggtccccaaagaacccctaggttggtgaggtttctttgagaaaatggctttatgtgtgtgcaa

SEQ ID NO: 210681 - DNA, 325 bp, Homo sapiens
tttaggagtaatttacataaggaatgtattgagggcattagagatgactttatgacctgcttatgatctcaagctttttactgaataatttatcatcacattgtgttagctattttgcttcttgatagatcattttacaccacaatattgctggtgcctaaggaaaaaaaatgtctcttcagcagatcttaatgatttctagaaagggtaatttgattctgaagataggattttgacttgccctggtattaataagaaattttctctatgatactgtggttatttccaccccccaaacaatcatagatactaagtgcaaacttgc

SEQ ID NO: 210682 - DNA, 1895 bp, Homo sapiens
cctgaagatttactctgaacttagcatatataaggctttctgaaattctacggaaatatatttaactttttttaacccagtatgtcacagacttatttgatagttagcctgctttcatggaataactactaacatctggaggcatactagtgtttcattagattcattttaagaaatgtttccatataattatggaaacatatataattatatatattttatctaattttgattcctagttttgtgagatttttttcctttgagcacatagcaatttttactacagttgcaggcattttctttagctagaaaaaaaacaaaaaacaaaaaaaacaaaagcaggaaaagctggggccccaagtactctgaaataccaatctgtgggcagtgaggaatcactgaagcttttaagcaaaaaagttgtaaagttgtatcagagtttttaggggaactaatatggcaatggtatatcaaatagattaagggctaaggctgttaatgtaatattttagatgagatataagaacctgatctggagttgtgacagtaaaaatgggaaggtaagggactttgtgtgagaaaatgaaggaggcaagttgctgaagctgattggctagaggaggagggaataagtcgttggatgactgctaatgatttagactaaatgaatacatttgtatttcaagacttgtcatctcagatcactatcagcctactttaaaataaaatttttgacaagcttacttagattgacgtttgagatcacataggcactcatcagaagcaggtctgttctcttcctctttcatattactttgtattttatgggttatctgaatttattttcaggtaaccttttcaagggtcccaaccccttctggcacttttgaaattataaaagaatttcaggatgtttactgtgtgccccccacatgtctccagcatctcaaagctgtaattttttagacagtaagttaaccttcattcagaaaacccaggagagagtattccacaggaattgtctatattttgatataaaaaatctttcattaaagaattattgagtcttaacttgggaatgctcctgttccagtttaagctcttttctcagcgtatgaaaaggagataagcaggataacagcctctttagaatatccttaaattgcagccagagattaaaatgcatgtgtcactggtaattgctatttactgtgatttataccagcatattattattgtttattttgggttcagggggtacatgtgcaggtttgcttgaagggtatattgcgtgatgctgaaatttggatttctattgatcttgtcacctagacaatgaacatagtacacactaggagggttttcagcccttgcccctttccctacacctccctccttttggagcccccagtgtctattgttctcatctttatgttcttatgtacacagggtttagctccactcataagtgagaacatgcaatatttgttcttttttttcaatactagtagattattaatagaaatgtagcgttctctgagatcccttgggatctttatttcatttatatatttatttttaattaatttcttttttaagagacaggttcttgctctgttgcctaggctggtgcaatcatatctcactggatcaaacgatcctcctgcctcagcttcccaaatagctaggaccacaggcacatgccaccacacctggctaagtttaaacagttttttttgttgttgttgtttttgggtttttttttttgtagaaactaggtctcactgtgttgcccaggctggtctcaaactcctgttctcaaacaatcctcccaccttggcctcccaagatgctagggttacaggtgtgagctaccatgcttggataattagttc

SEQ ID NO: 210683 - DNA, 351 bp, Homo sapiens
ttcactcagctgtcgctatggaattagcagacagaaaaggcacagcgtcagtggctgggtgtccagagagaagcagcctgtctctctagataatacttggcaaaatcacagcagtccggtgtgtggccctttactgaccttgattaaaaatcgggtgtcagcaccccaagtggatccttcttacaggtgcagattcagactcattatccaagttgacagagacagaagtaaatattcaacaaatatttattgagcacttactatgtgccaggcactgttgttgtaggtgctggaatacagcaatgaacaaaaaaagtgaaacattcttccttagatggtggtaaagcgata

SEQ ID NO: 210684 - DNA, 430 bp, Homo sapiens
cattttaaatataatttggtataataaatgcaattgatataaatcgggtctcctaaaaactgttacttgatgagttattaggttgtacaggttattccatatttgaggggaacaaaacataatattgctatgtatgtgtgctttgtatgaatatctaaattaataatgaaaaagttcttaatattggtcagattttagagaagacagtgtaattgttgtggaatgatatgttctttggcctcaggtgctttatgcagaaaagggtagattctgaaaatgaaagaagacaggttgtgtgatttatggttgtgggctgtgaaggtgagcaggacctcttttctacatttaaacgttgataaagttttcatctttgttgctaacttttgagtaagactgatctactagcattcagcagggggcagcaaaggca

SEQ ID NO: 210685 - DNA, 458 bp, Homo sapiens
actggtttcttctgggcccctcctagacgctagtgcactttctctgtgctcattcacaagtgtgatcacagctcactgcagcctcaacctcccagactcaagcgatcctcccacctcagcttcctgagtagctgggaccacaggtgtgcaccaccacacttagcaggggtgaagcgctttgtggatgtcattgcacacgaccctaatggcaggcagagagggtagataaccccatgtagagataaggagatcatcactgaaggacgttgtgtcacttgagtcacttgtctgacagtggacaagcttgtgtcagggcagtggttaggagctcaaggcctaataataataaacgcagatacacagatgggattaagataaaaggatttggggcggccgagggagttgccactttgtgtgtccatttcagagtgcctcagaccccagcccagctcagccac

SEQ ID NO: 210686 - DNA, 503 bp, Homo sapiens
aaggaagtaaaaaatctgatctgggatgtagatttctccatcagtcgactttaaggtgggcagtgtctttgcagcatctttatctgcactcagtttttcagagcttaacacactggaaagtgtagcagttcttgaagccactaaataaatcactagatttaggaagtgcagagccaggcaagacgtgtgaacaggtgaagcaggctgggcatgagcgaggcctgttctaagcgtgctgccactgctctgttctcgtccatggctgccctgcagaaatgtcagcctggagttgctcagttatccagtttccaggactggctggatgtttgcatttttgtgtgaagccttctgagtttttaatgttggcaaccaactaatatttttaaaaagcaaacactgtgaagacctaataaattgcttctgcagccccgtttcatctgcggggtgccagtttgcatttgcagcctagattatgaagagttgatacgtttcacagagcaaaa

SEQ ID NO: 210687 - DNA, 468 bp, Homo sapiens
gtccaagaataaggtatgacttttcttttactcaagtggtctttttttcaatgtccattagagtttaaagttttcttcatgtaaatccagcacatttcttattaaaggtattgttaataataacttattaaagttatttcatctttttgtggttattgcaaataatatctttctgtatctcttgtaactgttttttttttttgcaagtagtgtctttttgtatatcttgtaactggtttttatataggaaaattatgtgtgtgtatgtgtgtgtgtgtgtgtgtgtttacattaattttataaccaaccaccttgctggacagaaagagcatactgaattaaggatagacaggactattctttcctgttattttcttgacacagaatggggcaacttaggtagtctctaataacacaggaacttggttaagaattttcttcatcataatcactactcattgtagataa

SEQ ID NO: 210688 - DNA, 408 bp, Homo sapiens
ccactcccctccccaccaaggaaaaaaaggactgtagaggatgttaataggccacatggctcagcttcagatgactcggcaaggagattgatgcctggctttggttaaatatttgaaatagtactaatccattgcctatatttaaagtataaactttgcatagctacaaacattgattctctaagacattagatcctagactatctggattgtgctgttctgtttttgttcataatctgaaaatgtaaatcttaccattttagaaaaggatttccctaggattttaagttcttaagagtcagacttatctgtagacatcagtgtgcctaggattcacctgctatcatacagtttcttttctgttttccaaacttagaccaaaatagaacaaaagttaaagtttctaga

SEQ ID NO: 210689 - DNA, 567 bp, Homo sapiens
tgactctgaggattacagtcggtctaccattcacaagaatatactccaaatagcttagggatccaaatatattttttaaatgaaatgataaagcactgtactagaaaaaaacatggtgaacttgtctttaactttgatgtagaaaaaaagctcaactgtgattgtgccactgcactccagcctgggggactgagcaagagaccctgcctcaaacaaacaaaaaacaccaggcatggtggctcatgcctgttatcccagcactttttcaaaacaaacatttacaattttatgtttaggcatcatgttccatgatcttatgataggaagataagttcttatagttatttgtggtttgagagctaagaaaatttatataataacatttctttctttcttgggtgtgctatcattttctctcttagcttggttgcttcgtattaaatttgaataaacatgtttccctagcctgttctccatatatttcccgtgggagtatgaaaactatctgaccattattccaaagtgactaagcatcataggccacagtataattggacaaaaggagct

SEQ ID NO: 210690 - DNA, 695 bp, Homo sapiens
tgttcagactatctgaggtgagatccaaaaattgaaaggcttaaagaatatgctaagtaagttgattgggcgtgatataggaaaaataataggataagttgatgataaatggcaaccaactatagcttcaccatcaagaagatgatggggacaggtggaggctttgcaaaccagggtacacccatccttaacaagagaagccaaccactcagctcccaacctctgtcactatatgcaaattcatgctcagcataccagatactctttttttttttcaagtgaagtcagaatttaggagttacatatgagatatgatccaaaaatatttgagccaacactaaaaaggcaaaatctgaggctgctaatcaaggcaccaggcaggtctcctttaatctgcaacattcaataacctgggtaagacttgcaactgatcccaactccaagtacttatcatctcttccacaaccagagtccaagacaatagcatttccaacctggttggctaaatggcttcctggcttcctagaacctctattcccttacaatccattatctatagagcagccagagggcagctttaaaatgcccatcagatcacattacttccctgacaacccttcaactggcttcctactctggcccacaaactatatgcagtcaggtgccgggtggtctcccctgcctctttgtgtccc

SEQ ID NO: 210691 - DNA, 681 bp, Homo sapiens
aacatgatgaaaccccgtctctactaaaaatacaaaaaaaattatccaggcatggtggtgggcacctgtaatcccagctactccagaagctgaggaaggagaatcacttgaacccaggaggcagaggttgcagtgagccgagatcacgccactgcactccagcctgggtgacagagcaaggctctgtctcaaaaaacaaaaaacaaacaaaaaaaaaacaaaaaaaactggctgaggtgcttgctggggaccagtgtgataggaaatgagtggtgggagaagggaattacacataccaattacagccatgtgaccagttccagaaacaagtactctagtcattagagatattttctttattgcttagatatggacatttgtatacataaactgatatttttcttttttttctctcccattccaataccctctaatagtatcagtatatgaatcatggttactcgtatggtccagttttaagttataggatagcaagataagattgtgaatcagaagataaacatttattcacagatggataaagtggaactctgggtttcttcttttaggtttggttgtatgaagaatcattgaatcatataatgtaaaagcataatgttgctaatatctttatttggaagttaaagattaaaaatagggtgtgtggatgccgagctgatg

SEQ ID NO: 210692 - DNA, 397 bp, Homo sapiens
cacaaattaccaaatggcctcctaggggctgaaataaggacctctttaggcatcagtgtcccaagttaggaattggaatcccagagctagaatgttcttcggggtcactcttgtgacgggcagtcctggcttgattcaagccgcttagagcacacggctgcctggaaaatgctcatcctcccggtgacctctccatccaggctgcatgtcggggtgggcatcagcactggcatcctggatgctgggtgaagtcactggcccaagaaaacccactgacttgggtgacagtgaagcccaccagtcccagagccccagatccaggacacacacgccagtcggggagccaagctgaggtgggagccatcactgcttctcagcagtgccttgtctctccatg

SEQ ID NO: 210693 - DNA, 796 bp, Homo sapiens
agcctgctgcctaggtggggccacagagcatcatggaggctcattagagatgggacatgcggcggctttccctgctgtcagcaggagtgggctctggattcctcaagatgctttaaaataaaacggaaaggcgcaattatgcagccaaacagaaggcgaggcagctgcctacaaaacgaggctttctccgtaataggaccccaaccccagagcacagtgcggccgcctcaccgtcccccccaaggctgcagccgtgacgcgtctgtaattggatgcttcgctgttccagctcttggattattcaaattacaggattttcagtttcaattaaggttatgaccaggcaacaagatgagcaagataccatgtttcacctttatagtctatttcagcaagaagcatggccaaactagtaacagtggggataatcataaaattaaccaacacgtactgagtggttaccatgtgtcaggtctggttcaaggtatgttatatacatattgacttatttaaccttcacgccaacttacttgactattgatattatattatcatcgtcccctagcctacaaatataaacactgaggtgcaaaaaggttgaggaatttgctcaaggtcacatagcagttaagtggcagagccgtgaatcgaacccaggcaatgtggtcctagacagcgtgctcttatttattttgttttgtttttttgagaaacaaaattagctggcgtgtgcacactcgggagtacttaagccagagaggttgattgtgatgccggataactaagcactcggaca

SEQ ID NO: 210694 - DNA, 501 bp, Homo sapiens
tgtaaaacagaaacatgttttatataaatccaaatataccataaattgctttaaatgtcaatggtctaaatacagcaattaaaagacaaagactgtcatcacggattaaaaaaactatattgactcatccaaggggaagcagagggcaactatacattgtctacaataagcccactttaaatataaagacaccagcagatgaaaagaaaagggtgggaaaataaaatgagtcaaaagaaactggagtatctatattaatttcagacaatgcagacttcaaaataaggaagattagagataaaaagcagcactacataatagaaaagagattaattatccaaaaagacataacaatgctaaatgtgcatatacctaaaaacaaaatgtcaaaacacatgagacaaaaactgatagaactgaaaagagtagacgaatgtacaattatatttgaagaattcaacatccctcccatcattaattgatagttcaggtaagcagaaa

SEQ ID NO: 210695 - DNA, 423 bp, Homo sapiens
aagaaaatcctattgattctatctttaaaatatatccagaatccaatcaattctcactacctctaccagatacatcatctctcaccaagagtattgcattgacctcctaagtagtttccctgcatctacacttgctcactatggtctagtctcaaaacacagccaaaataaaccctttaaacatctgtcagacggtgccacacctctgtttgaagttatccagtggcttcccattatccccaccacgttctgcttcatccatgccagttatgcttgggcctcggggcctttggcttgtttcctctgcctgcaatgttcttccccgcagacatccacatgcatgctctctcatcatcttcaaggtcaccttctctgtgaggacttttcctggctgctctatttaggtctgcaattacgcccaaa

SEQ ID NO: 210696 - DNA, 820 bp, Homo sapiens
tgccaccacgcccggctaattttttgtatttttagtagagatgggttttcaccatgttagctaggatggtctcgatctcctgacctcgtgatccgcccacctcagcctcccaaagtgctgggattacaggcgtgaaccaccgtgcctggccgacatttgagttatcctaaactttaaggaatattgcttcatttttacttatttctggcagttatagaatacatcatatatttaatgtagataatatttttctctttaggaaaagatctctcaattctttgaagtttttagtaagctaccatattttctaaaatctatttaaaataaaagaagttgcagccatattcttgtaatattaacacaagcataagccactagttgctggataattcttacagagaaggtgtaaatagaaggcaacctcaaatccttctccatcaccttttgctgtttataagactattttcctgaccaccccccaacaccacagtaagcaagccataatacgtagaacaaaacccactccctatgtagtcccttctgaatcacactctcacctttcaaatgacaggcagacagcagagaccaagtggacgaaagaatctcaaagttggaagatggcctttctgaatgaacaaagcctccaagaaatatgggattatataaaaagactgaatctatagctgattggtttacctgaaagagatggggagaatggaaccaacctggaaaacatatttcagggtatcatccatgaaaacttccccaatctagctagaggccaacattcaaattcaggaagtgcagagaacctcagtaa

SEQ ID NO: 210697 - DNA, 459 bp, Homo sapiens
gcgtctattcaactttctgacagaaatctgggacaactactgtgggtggatgagaaaacgataatgaaggaaagtctggcagtggtgtagtgaaaaaagtcttttcaaatcacaattgaaattgttagatgagttaagtcactgaagaagattccgtttaccttaggcatgatttttttatatatatcattcaaagagaacaacgtgggcttctgttgagtaatggattcttaaattttctaatcagaattcttatctgccaatttaatctaatttacatcagcagcgtaagattgatgctttggcaatatatcgtcaatcaaaagaacccaggactctctatcagaagagctggattctaatcctaccccaccagacatgtattccttgtactgagcaattcgtataaccctctcacaaccctttccccacctgtaaaataaggctattggcttggat

SEQ ID NO: 210698 - DNA, 425 bp, Homo sapiens
tcaaggagaactttccatatcttatttttgctcctttgtatgaatttccatttctcctctctctctccctttccccccaccccgtctccctctcccccatcttctctccccaaaattggccctctcagttgcctcatccacagggaccagtgcttccaaattttaaattttttcctttagaagaccatccagactgagattgaagctctgtgtcccaattccagattccagagagaatctaatagaccttggtgtctactctgggacagatgagctgtagccagtgggacagaatgacctagcagacacagagctttgaagtacccatttctgtgggttggggacagttcccagaggggcctggtggacagtccagcaaggcttctgctacagtcttttttgttgttgttgttggggggacagag

SEQ ID NO: 210699 - DNA, 670 bp, Homo sapiens
cccaaaggattttctttagtctttctcagacagctctgccagtaattaattctctcagtttttgtttatctaggaatgtcttattctgcctctatttttgaaagggttttgctgaatatgaaattcttagttgacatatgtattttttttcctttcagcatgttcaatgttattcttctgccttgtggcctccattgtttctgatgagaagtcatcattcattctatttttgtatttccctttttataataagttatttttctctttcagcagtttgactctgatgtgtaaaaatgtagatttcttttcttttttttttgagatagagtctcgctctgtcaccaggctgaagtgcagtgacatgatcttggctcactgcagcctctgcctcccgggttcaagcaattctcctgcctcagctcccaagtagctaggactacaggtgtgcactgctacgcttggctaatttttttgtatttttagtagagatggggtttcaccatgtgggctaggatggtcttgatttcctgacctcgtgatccacccgccgtggcttcccaaagtgctgggattacaggcatgagccaccgtgcctggcatgtgtagatttctttagttttatcctatatgggatttattgagcttcttgggtctgtagattaattttttc

SEQ ID NO: 210700 - DNA, 423 bp, Homo sapiens
catagattttaaaaggtttaattaaattgatagatgatagatccatcatgaaaggtaaatttaaggggtgggggacattctgaatgtttttaggacaatgtcagtaaagggcagtgctcacccaagagacatatattggtatcactgtcagaatatagggccggatgaactgttgtgcttgtgaattattgggttacattattgaattgtgacccatttaatgacgtgttctgcttagcgtctttaggccccacctaactcttccagctctctattcgacattctctttggattgttttgctataacttgaaatttgggatgtcacaaacgaaactgtcatctgtttccgccaaactgtggttctgctaatctcccaggctggcagcattggagacttgctgacttctttcatcccccactct

SEQ ID NO: 210701 - DNA, 632 bp, Homo sapiens
tccagaaatattgctgcagtaaatggactatagtagtatattttagttttgcctgattttaattgtcaaacttgtggagtttttcagcttcactgttttcaagtttctcatcatctcacaaaatattcatggaattggtaatgaatgcccagttgtgtgtgtgagtatgtatttaatcagtgccagattaggttgtccctttgtatataattttgactttccttgcttatatctataataattttcactaaacatttgtgtaactaggtaaactgtaaaataattatctcatgatatctgtgacataaataatacaattagagatgctaaactgaaattataaattatacattattttaaagacttgaatttgatttcttttaaatgctcatacgtatttaccatcatatagtaaaaaggttttaaagaatagttaagacagaaacaaggtctattaaatgggacagaagtgctgaaatttacaaacagaaaagtagctcatcttgtggtcttcctcactgttcagtggttacatgtgacatcatatttttaaatcatacctagaaatttttaactgtactggataatgtttgtcttctttgatgataaagacaaaccatccatctgggaag

SEQ ID NO: 210702 - DNA, 253 bp, Homo sapiens
cctactccaagaaatgaatgagggtggccagcctgtgaggctagaagcaaaatggaatcagccatgctagactttcttactgtcatcatctttgcaaaggcagtttcattaagacaaaatatatctaaatataagcccactccactactacacattgtacctcctggtattgtttagaatgacttttcccctgtctttccttttttcagggccaatgtattcttcaataaataaatgtgacttgatttcaaca

SEQ ID NO: 210703 - DNA, 508 bp, Homo sapiens
ttgaacccaggaggcggagctgctgtgagccgagatagcgcaactgcactccagcctgggcaacagagccaggctctgtctcggaggaaaagaaaagaaaaagagaaactataacaacattatgtgaagtgttgtctgctatggaagctcacaaaagcctaggagtccagggtttttcttggtgggtgatcttcaaggtacacaatgaatgaccagctaccaaagctctctagttcacgagaaggaaaggtgttcaccataaataatgctgtttgcacaaactggaacaatcaagttcaaagattcaatcacacaaaacgcaaaatattccaagagctcaattctggcctgtcaaggaacagtcacagaaaatggtcctcttgggaacatgaaagacttgagcaacttgggcctgctgaattaatcctttcctgcccaagataacagaaaatcatatgtggttatgtaagaacacactatacaacaatgaaatgttgctacatacaac

SEQ ID NO: 210704 - DNA, 523 bp, Homo sapiens
cttcacaaattcttctcaagtaacagggttggagcaaacttttactgttttgaattagatgaacaaaattgtatttaattttacttcccaagagaccttccattttctctgagaactttttctcatgatgaaattctttaagcaggtttattatcagatacagatgggattcatttagtgccaaggatgactaccaggttccagatttttgctgctttagtggttacctttattttatagcacagactgtaaatgagttattttagtaaaagcattttccatgagttttctgggaattaatttgataattagatgccagtttttaaaatgcataatatatgcatctgtatcaaatgtgtatgacaggtgcaaagcaacactttcccttacttggtttttctgcagcagcccccacatttatgaaagtactatggcattttttcttttcaccattgcactcctatctggcctattagagaatttttcaggatagggaagggagaagattgagaagatttctggc

SEQ ID NO: 210705 - DNA, 392 bp, Homo sapiens
ctaatttcatgacttgtggccgtctctgaagtgcttgctgcagtgtggagtgatcgtatggctttattgtcatagagaagaccaaataagagaaaaaacaacaaatgccaaccacacgatgggtgaggattaaacaggagaatgcacaggaagcttgcagcacctggtgagaactcaacgaaggtgtgggtccgccttctgatgacggaacctgttacagctgtctgtctgaagcgatgagatgaggcaacccttgctctgggaaggcagagtcacctggcatcatcaaggcctttagcacctgctaccacttgtctgctacgaagtaccagaaaatgacaaaaacctcggacttgaagcaaataaactaagtaaaaactctgaacaccaaa

SEQ ID NO: 210706 - DNA, 338 bp, Homo sapiens
ctctcatcctcccctgacaacactttacttcattcttaaagactccttttgtcctgatggtgtttgtttcattgctttctaccgtactccagtctgaattttactgactcctagtgattgcttagacttgctatttgattctgttgtgtgatttttgattatactcctttgtgctatttaaactagcagtgtttacctaaattagtggtggtagtgaaggacacaggttggcccatttgaatgaaaatcaggagcattgcactggccctgccgttaagatgaatttccatgaattccctctccagaagggcactaggaatttggctggactacagaag

SEQ ID NO: 210707 - DNA, 473 bp, Homo sapiens
cggggtgcacttcaacaaacagtagagaagcgaacaaagcacacacttatccctggagattatactgttgcaggcgggacattcatttagctaccattgtaataagggatctgagggaaaccatggtcttcgatggaggaaacatctgatggaatcaaggaactcacagagggacttgagaactcagctctgaaggaagtgcaggaaacaagaccggtcttgtttcctgcacttccaaaatatagtcttcaagggtcctgacattccaaaaatcatcacactggttgactgtgtagatgggtttttttttgttttgtttttgttttttgagacggagtcttgctcttatcgcccaggctagactgcagtagcacgattgccaccactgtagctattgttcttttttttctttttctttttttttctgagacagagtctcattctgtcgcccaggctggagtgcagtggcgcga

SEQ ID NO: 210708 - DNA, 138 bp, Homo sapiens
ccttcatcttctgcaaagcaagcaggtaagcaattctctgcctttgaatctttgccaagataatgtaaccatgggagtgaaatcccatcatatgcacaagttgcgtgcatattcaagcgggggagattataccaagtg

SEQ ID NO: 210709 - DNA, 471 bp, Homo sapiens
ttcagaaaacttagaatatgattttaaataaaaataataactaaactaaaaaagcaaatcctgtataagcccttagttacttgggaagtcatttaaaagttaagcccatatcatctcaaattccaaaacttattgcaaggtaaataatcaaaagggtggtgctggcacaaagaaaaaagatatagattgatgggacagaaatgaaaatctagaaataaacccatctatggtcaactgatttttgacaagggtgccaacaccactcagtggggaaaggaaaagactatcctttcccttcaacaaatgatgctggtacaactagacagccatgtgcaaatgaataaagctggatccttacacttcacaatatacaatggctcaaacacttaaatgtaagagctagaacaataaaactctacaaagaaacatagggataaatcttcagggtaaaccctgaaaatctggcaatgg

SEQ ID NO: 210710 - DNA, 423 bp, Homo sapiens
ctagcaacacttcagggtaagaactacagcctgagactccacctgctatgatttgaatgtatcccacaaatttcatgtgttgaaaatttaatccacaaattcatatgttgctatttggagaatggggccttaaagaggtaatcagaattagataaggtcatcagggtgtgacccccataatgggggccactttattagaagaggaagagagacctgagctgatatacacattcttaccctctgccatgttatgacacagcaagaaggcttttaccagatgtggccccttgaccttggacttcccagcctccaggacactaagaaataaatttattttctttataaattacacagtctgtattatagcaacagaaaatggactaagataccaccccagggttctcttctcctaattgctcaggt

SEQ ID NO: 210711 - DNA, 409 bp, Homo sapiens
ttctttttcctggagagaagcatgctgcctctgaacagtggagaggaggaaaatcatcagcatcctcattggggtcaggtgacctgggcctcgttcttccgctgccacctgccagggttgggattgtcacagaagactgttcctctccgtggtgactgattgcggagagataagggggttaggaacatgcagcttgctgtgctgggctcagaagggactccatgtgattgactccagtggagacttattttacctgccatttctgtagcaagaaggaacccagatggggccaggggtctgtgaatgcctggaaagtatatgtcaaacattgtgtgagggtacacatccttttctggggaagaagttccatggcttttaaaaatcagagtcctaaaggatcccagtgact

SEQ ID NO: 210712 - DNA, 582 bp, Homo sapiens
ctctaaaacaggaaatgaggttaaatgtttgtttttcaaatacagaattatttgctaagctatgattgcattcttttaaaattactttgttgaacttactttattcataaaactcaaatcaagtttttagttttcctctgtatttaagcagttttaacctccaagctatatttataaaattgtttgatctcaatagatgttattcagggtatactccatacaaaaattcatattagtgcagtggcaatattggattttatattgccatatggctacatataaataattgaataaatagtaataaaatcattgggttaaagatatcaatgacaattaagaaaatactaatgcccttccatccctgagaatgataaaaaaaaactatcttcatgattcattatatagttgaaaaaaatttttaaatgtctcattaactagttagagctgtcagattatttgtaggaagctcatttagatgttgatatgtttattactaggccaaaatgtaagaagatccactttgtgccaacaatgcgcccacatatgctgatcccttctggcttcttcataagtattttacac

SEQ ID NO: 210713 - DNA, 524 bp, Homo sapiens
ctctaaaacaggaaatgaggttaaatgtttgtttttcaaatacagaattatttgctaagctatgattgcattcttttaaaattactttgttgaacttactttattcataaaactcaaatcaagtttttagttttcctctgtatttaagcagttttaacctccaagctatatttataaaattgtttgatctcaatagatgttattcagggtatactccatacaaaaattcatattagtgcagtggcaatattggattttatattgccatatggctacatataaataattgaataaatagtaataaaatcattgggttaaagatatcaatgacaattaagaaaatactaatgcccttccatccctgagaatgatataactagttagagctgtcagattatttgtaggaagctcatttagatgttgatatgtttattactaggccaaaatgtaagaagatccactttgtgccaacaatgcgcccacatatgctgatcccttctggcttcttcataagtattttacac

SEQ ID NO: 210714 - DNA, 504 bp, Homo sapiens
aggagaaatacctaatgtaaatgacaaattaatgggtgcagcaaaccaacatggcacatgtttacctatgtaacctgctcgttgtgcccatgtaccctagaacttaaagtataataaaaaaatacaaaattaaacaaaaacaaacaaaaaaagaatatctgaggttccagttaactgtaattattcatgttaaaattagccttaccgtataaggtatcatttttcactatttttagcagtatcctctatatttacctccacatctaaataatatgttcataatcctatttcttgatttgataattttatactttatctgttgacttcctgttatggcaaataaggatttatttagttttttgtagttttccccctcctctcatccttccagtagagttctatcacaatattttgctaaatcaattactctgtgtttatgttattaatactataaaaatattgttccctgcaaagctaaataaacctgtgcttatatacctttta

SEQ ID NO: 210715 - DNA, 540 bp, Homo sapiens
ttctccatttctgaatggaccaggtagttcagtactcagactgcaggtatacaagggaagagagaaggccctgcccttcaacgggtagaaatgccctacaatataacatagagaaatgccctataatataaccacaggatccagccatctgaaattttcataagcttccccctacattatttctcctaggctatatgcaaaaacagtgataacttgatatgaacatggctttgggccctttctgtctagaaaaacaaatgggttcactatgacaatcagaaataaactctttcatctgtcccgcagaatttcatgaaggagtaaccttccattctaggctttgtctaatggccaagcattagacaaagcattagaaagcagttcctttctcaaaactgcctgctgagaataagcacatagctgcccgactatccggagcctcaggcccaaaggttccacttcagagacagagatgctaattgatccaacctgctgtccttcgtggagaagacagtggggcccagtgccctggtgaaccaa

SEQ ID NO: 210716 - DNA, 346 bp, Homo sapiens
agaggagtgtgtggctacctgctgatgggagactcagtgggctgctggggacacccataagctgcgggcacatacctactgcaaactcaccccagcaacctaggacatgaatatccccatagctagacctggtagacttaaagccaaccattcctgatacttctaatcatgaaaaattataattagaatgtctgtttggataaagccaaatattaaggagttagtgtaaaagctgtgcccaccctccccccgccccgagaatcctgtgtaggcattagaagtcatgcaatcaaagagtttatgagtacacgagaagcaaaaaaaagcagaaccacatttgcataca

SEQ ID NO: 210717 - DNA, 507 bp, Homo sapiens
agtgtccttaaggttcatccatgttgtggcatgtgctaggatttcctttcttttaaggctgaataatattccattgcatattttgtttatccctttatctgttgatagacacttgtgttgtttttacctttcggctattgggagtaatgctgatatgaacatgagtgtacaaacatcttttcgagaccctgctttcagttcttttgggtatatgcccagaagtggaattgtggatcatgtaattctatttctaattttttgaggaaactccatactgttttccatagtggctgaaccattttatattgccaccaacagttcacaaaagtgctaacctctctgcagcctaatactttttctttttttcctgttgagatggagtcttactctattgcctaggctggtaggcagtggtgcgatcttggtgcactacagcctctgcctcccaggttcaagcgattctcctgcctcagcctcccaagtggctgagatgacaggcgcatgcca

SEQ ID NO: 210718 - DNA, 576 bp, Homo sapiens
aaggaaattacctcaatgaaataaagggccatgtgtgaaaagcccacaactgacatcatactcagtggtgaaaactgaatcctttctctttaagatgatgcacaagggaaggattccttttctcaccacttctattcaacattgtattaaaaattttacccagaccaagcaggcaagaaaaacaaaaagcatccaaataggaaaggaataaatataatgatcttttcataggtgacatgatcttgtacgtagaaaaccctaatgattccacacacacacataaaactgctagaactaataaacaaatttagcaaagttgcaggacacaaaatcaacacacaaaagtcagttacatttctatactcagcaatgaccaatctgaaaaggcagttgaggaaacaatcacatttacagtagcatcaaaaagaataaaatacttaggaataaactttaccaatgaggcgaaacacttctacactgaaaactacaaaactttgcagaaaaaattgcagaaaacacaactaaatggaaagaccttctgtgttcatggtttggaatccttaatattttgttaaa

SEQ ID NO: 210719 - DNA, 383 bp, Homo sapiens
gagggctgtatcctttagtggtcaaagcctgtctccctgggctcttcccaaagggctcagctcccaagtggcctcttcctcttctgcctcctccccatccaaactcctgcttttcagtagggtcaatcctgagaatgaaacagtgacttgaaattgatcttccctgaggttggatgagtgatgatccctgttattcttggagaggtattttcttttggttaagtagtagattagcccaaacgcgtctctattcagtggcatcccagaagatgtgaatgatatattttgagatagtgagtttcccctgaaagccctaaaataggaaccctggtaacctctgcttttatgtatgtgcttggctggtcctattaacactagctgga

SEQ ID NO: 210720 - DNA, 594 bp, Homo sapiens
caccttgttatcagatatctaatgtcacacactatgtgtgagtgcagttttttatgaattgcagaattttaaaaaaacaacaaatgacatttcttttccagtacttactttgtttatttaagaaaaatttggtatccctcttctacctcctggagctctttttaccatccctgtctttgaagggattcagagtacccatgctcttctacgcatttttatttaggtatcttttgtaggtatgtccttaccttgaaagtgccttacgttccaaaatgtattaattcaacaaactttaagtgattattatgtgccagataagacagtatttcagccctgggagaattccaccttctgaatagttttctcaagctagataatcataggaaagcaaggactttcccataatttttagttcctctaagccagtgctttcaaactttagtttgtgatccattaatggcttgtaaattcaatttagtgagtcacaataacaattttaaaaagtaatggggagtgtcagtgtggtgcataaagtaagggtaaacattattatgggaaacttttgtttgcctcttttttttttttttttttttt

SEQ ID NO: 210721 - DNA, 381 bp, Homo sapiens
tcaggagttcgagaccagcctggctaaagcggtgtctctactaaaaatacaaaaataagctggatgtgcttgcttgaacccaggaggtggaggttacagtgagccaagatcttgccactgtacagccaagatcttgcctgggagacagagcgagactctgtctcaaaagaaaaaaaaaagaaagaaaaaagaacagggggttgagtcagacagtctggagttcaaatccaactgtgctccttcatttctgtatgaccttcggtgagtgtcttcacccctggaactcacatttcatcacctctgaagtgggcataacaatctgtgctttgcaggctgctgtaaggatgaaatgcaataaagtgtgtacagcacttggcacac

SEQ ID NO: 210722 - DNA, 1346 bp, Homo sapiens
  misc_feature (1163)..(1163): n is a, c, g, or t
tgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgangtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggaga

SEQ ID NO: 210723 - DNA, 446 bp, Homo sapiens
aacaggtggctttctacttgggtcccctctgggatattctcagcatgcaaaaggggtttgtttgcacattcagcatacttaggcaggctttagaaatattgacttaagtggaaattgcctcaaaaaatacagataccagctgggcatggtgtctcatgcctgtaatcccagcactttgggaggccgaggtgggaggatcacctgaggtcaggagttcgaaaccagcctggccaacatggtgaaaccccacctccacaaaaataccaaaattagccaggcatgatggcaggtgcctgtaatcccagctactcaggaggctgaggtgggagaatcgcttgaacccaggaggtggggtttgcagtgagccaagactgtgccattgcactccagcctgggtgacagagtgagagtcagtctcaaaaaaatacagagtgagagacagtctc

SEQ ID NO: 210724 - DNA, 573 bp, Homo sapiens
ttaattatgtacgtaagtgtgttttggttgcccaaaagcttaataagggtctccaggatggtaccttgtagaggtggagcagacagagaatagcagccctgttctgctctgtgctggttcaggaggtattttggagagtgagacactgtgtggttctaaagggacgttgactgaatagaggagctctataaaaaggcaaccaagatctgggaagaataacaccaataatacctcatgaatattgaacgcttactttatcccaggtagttctgtaaggactatatatatattttttttcaatcaatcaatccaacagctattgagattcttctgtgtgtctgacgctattctaggcactgtggattcagtcctgaatgaaacagacagaaacccatgccctcccatagctcacttttctagtgcaagggggcagaccataaatacaatgagtaatgaaatatggaaatgtttaagtgcctagagaaaagtacagcaggtaaggggaaccaagagccatattttcagttgtgtttcccataaagccttgtggcatttactcatagtcagattaaa

SEQ ID NO: 210725 - DNA, 368 bp, Homo sapiens
tcattgttccccagtggaatagatctcctgtacagcagtcttcccatcccacaatattacaaggaaggttctgcaagcaccaccctcttcctgacattctggtgatgagagttaatgaccgcttatgtgggacacatgaaataacagaggttaaaagttatcaaagcgtgccatgcatctgaacagattatgggagctttggcagaggatgacagccctgatactctcccagtcactagacaagtgagctgagtccctgtgtcaggatgggaaaggcagatgcccccaagggtgtgacagatcaaagtgggccaagtcaccctgcgcttgttaaagtgtttttcctaaaaggaaaactttaaaacatt

SEQ ID NO: 210726 - DNA, 467 bp, Homo sapiens
aagagaagctgctggaagattcatcctctggggtctctgggttgatgttttacctcaatgcatctaggactcagaatagctggttgcaactatgactcttcattaacctgctgaataacatagaccagccatccaactttccccacttaagaaatgaggacattatctagtcttctcacttgacagaactgtcgtgagaaaagattatttatattaatatgctgaaagcctaacccacatggtgatggtattaggaggtggggcctttgaaaggcgattaatgagaacagagacagcatgattcagattggtgctcttgtaaaagaggccccagagagctagtgagccttttccaccgtggaggacccagcaagagggctccatctatgaaccagaaatcaggatctcaccaggtttcccagcctgaagaactggaagaaataaacttctgttgtttataagctacc

SEQ ID NO: 210727 - DNA, 385 bp, Homo sapiens
actgtgatccagtgatgagaagatggagtgcaatgctttataaactgttaagctctatgaaaaggtgtggtattgttatttccaaaatactcagttaaattactgattctttcagaaagacaataaaagcctacctgaacatccagattaacatcactaagcaacaccacacactaagggaagctaaagtaatttctgcttaaagataaatgaaaacatgatctgtgaccttacccccaacccggtgctctctgaaacatgtgctgtgtccactcagggttaagtggattaagggcggtgcaagatgtgctttgttaaacagatgcttgaaggcagcatgcttgctaagagtcatcaccactccctaatctcaagtacccaggga

SEQ ID NO: 210728 - DNA, 353 bp, Homo sapiens
aaagagggcgggggaggaggctacaatcaaactttcctggcccattctcttcgaagattccttcctattctggctaagaatcaagccccgctcctgcagaaggggcaaggaaagcggccgattcctgggtcgacgagaatctcccaagaactgtctcgacaggagaagcaggggcacccatgacctacaacccgcgaggcctggaggtagcaaaaggccgccttcgtcatttctctcccagcttggatgggagtgaggggttgagaaaatgcaggatgagaaatccaaatataactaacttctggccaactctctgcctgtatgactctaggtaccttggagccagtgccagg

SEQ ID NO: 210729 - DNA, 1415 bp, Homo sapiens
ggatcacttgaggccaggagtttgagaccagcagggctaatatggtgaaaccctgtctccactaaaaatacaaaaattaacagggtgtcgtggcgggcacctgtagtctcagctactggggaggctgaggcaggatatattgcttgaacccgggaggttgaggttgtagtgagctgagattgtagcaccacactacagcctgggctgcagagtgagactgcgtctcaaaaaaaaaaaaaaaagaaaagaaagaaattgtacattgtatttattcaaatttgaaaattatgtccaaatgagaaatgttatagttttgatttgaaaagattataacaagtttggctaaatgatcaggtgaaaacatgctgaagtccaacatgaaaaagtacaaagttggaaggaaaaaaatagatgatcaaaatgtgatataattggcaaggcacaatttggcagaatagtaatttattagtgctgaatgatttcgcgttatagcatttatgttgctttttaaatcttaccactattaatatagctttcttgtaagatgactgaacctttgttgaagtataatgttgcgtgttttaagctcccttgttttaaaaagtatatagatttaaagctgtgacaccaaaacctattatctagctgttgataaatggctctaactactggttacaagcatacagttatgatctattaggaaaatatgtgggaatttaagttatgtcagatagaaaatacagtttttaactgttgtctgtttcctcaatctagaaccatctatccgaaagagattaatgtaaacatgtgggagacactccctggcagagttttttaaaaaatggttacttaagcaacagattaataagtctttttatgaaaaatttaaaaattgcaaatagggccatcctagatcccgtaccaaaggtaaccgctgtttttttatttgaaatgtgtatcttttcagacttttctgacagggttttaaactctcattttaagttgtaagactaggcttgtttatttgttgaaaaatatctgagcacctattatgtgccagcctaagctagagactagagaaacaacaaagaacaagacaccgtgtgggaggcaaagtggctggagcatggttgtgtttagcggggaggtttgggcagtgggcaggcaatctcaagactgtgttttagtgtcttgtagatgatttaaaaacttgacctcaaggcccagcgcagtggctcttgcctgtaatctcagcactttgggaggccgaggtgggcggatcacttgaggtcaggagttcaagaccagcctggccaacatggttaacccccgtctctactaaaaatgcgaaaattagccaggccaggcgtggtggctcaagcctgtaatcccagcactttgggaggccaaggcgg

SEQ ID NO: 210730 - DNA, 301 bp, Homo sapiens
tataatagaataccataaactgggcagattgagcaaccaatgtgtatttctcacagttctgaaaggctggaactctgaaatcagggtgccaacatggttagagttttgttgtcagcccatctcctggtccacagatagctgtcacttcattgtatcctcacatggcagagaacaaagaggaaaagcaagttctttcctgtctcttcttctaagagctctgtgacggttaatattaagtgtcaacatgattgcattgaaggatgcaaagtattgtttctgggtgtgtctgtgagggtgttgc

SEQ ID NO: 210731 - DNA, 626 bp, Homo sapiens
tcttggcttactgcaacttcgacttcccgggttcaagcgattctcctgcctcagcctcctaagtaactgggactacaggttccagccaccatgcctggctaatttttgtatttttagtagagacagggtttcaccatattggccaggctggtctggaactcctgacctcaagtgatccacctgcctcagcctcctaaagtcctgggattacaggtgtgatccaccgtgtctggctacagacaaaacactttctaaattgaagagttctgtgcaaatgtaaaagccagtttttaaaagtctaattttgttcaatcagattgtaataagattctcagtgtgtacatatatcagtctatcaatttcctttactagaagaggtctggtggtcgtcatttcatacttcccaattttaaaactgtaggagtgctcagtagcccaggtagatacatagtctaatgtaaaagatgaaaggaggcactattttgtaccttcaacatagtaaacttggaatggctccagacatgaattattcatcagtttatccttccttttacaaaaacctgtgttggtaaatgaatagtggggactgtagtgcacttacacaccaaaacctcaattcctttgtg

SEQ ID NO: 210732 - DNA, 203 bp, Homo sapiens
aatagaccagtggaagagcatatacactctagtaagactcacctgatttatatcaaaagtgttctataatccaatggtttaagggcaatttttttttcaaaaaatggggccaaatcaattgaatatcctatgttttattttaaaaattcctggtttttacctcacatcattcattataagataatttgaaatgcatcatagag

SEQ ID NO: 210733 - DNA, 479 bp, Homo sapiens
attttcacctattgttgcctctgtgagaagagagagagctatggtagagaaaagaagaagtatacaagatgttgcagcaatgtggacgtagttggaggccattcattatcctaggcaaactaatgcaggaacagaaaaccaaatactgcatgttgttacttataagcaggagctaaacactgagtacacatggacacaaagatgggaaccatagaccccggggactacttaaggggggatggtgggagggggcaagggttgaaacactatcccatattgtgcttgctgcatgggtgatgaggttattcgaatgccaaactttagtgacacgtaatctacccatgtaacaaatctgcacatgtacccctgaacctaaaacaaaagtcggaaaaaaaagaaatatacaagataacaagtttattactaaatggtaaagaatgacaatttcattattaaaactttaaaaaattaaaaaactc

SEQ ID NO: 210734 - DNA, 1741 bp, Homo sapiens
aagatgttccagtcaggattcaatccttgatacacagcaaagcattcctatggtaaaaaggccccataactgtaattcacatggagaagatgccacacaaaattctgagttaattaaaactcaaagaatgtttgtaggaaagaagatctatgaatgtaaccagtgcagcaaaaccttcagtcagagctcatcccttcttaagcaccagaggattcatactggggagaaaccctataagtgtaatgtatgtgggaaacacttcattgaacgatcctcccttactgtacatcaaagaattcatactggagagaaaccctataaatgtaatgaatgtgggaaagcctttagtcagagcatgaatcttactgtccatcaacgaactcacaccggagagaaaccctatcagtgtaaagagtgtggcaaagccttccataagaattcatctcttattcagcatgaaaggattcatactggagagaaaccctacaaatgtaatgaatgtggtaaagcttttacccaaagcatgaatttgacagttcatcagagaactcatacaggagaaaaaccctatgaatgtaatgaatgtggaaaagccttcagtcaaagcatgcatcttattgtacatcagagaagccatactggagaaaaaccctatgagtgtagtcagtgtggaaaagcctttagtaagagctcaactcttaccctacatcagcgaaatcacactggagaaaaaccttacaaatgtaacaaatgcgggaaatcctttagccaaagtacatatcttatagaacatcagagacttcattctggagtaaaaccttttgaatgtaacgagtgtggaaaagctttcagtaagaattcatctctaactcaacatcggagaattcacactggagagaaaccttatgagtgtatggtgtgtggaaaacatttcactggacgatcatcccttaccgtgcatcaggtcattcacactggagagaaaccttatgagtgcaatgaatgtggaaaggcattcagccagagtgcttaccttattgaacatcaaagaattcatactggtgagaaaccctatgaatgtgatcagtgtggaaaagccttcattaagaattcatcccttacagtgcatcagagaactcatacaggagagaaaccctatcagtgtaatgaatgcggaaaagccttcagccggagtacaaaccttacacgacatcaaagaactcatacgtgaggaatgttttcactggcccttacctcatgattaactcttcagtaataatcatatgagacatacaatgtagaaacctaataaatgtaatgattgtgggaatctttcagttgaagtacaatatgtcatatcagataataccactgcagagaatccatctaaaagtagagaaatcttgattcagaatgtataatttcctttatatcagaaggtttaaatagctaatataaacaatgaagagtcatgctgaagataagttctgttatatcataccgcacattctcctttggctatcagagactctacactggagagaaaaatgtgagagtgtttaactggacagcccagagacctggtatgtagtcctaatctgccactgccttggacaacttgcctacttccaccaggttatggttctttatttggtaaatgaatgattttggagttagaaatcttgtaggagctctgttagctctaaaatgctacaactctataaatataatgaatgctggg

SEQ ID NO: 210735 - DNA, 1508 bp, Homo sapiens
  misc_feature (1452)..(1452): n is a, c, g, or t
  misc_feature (1469)..(1469): n is a, c, g, or t
  misc_feature (1495)..(1495): n is a, c, g, or t
  misc_feature (1506)..(1507): n is a, c, g, or t
aagatgttccagtcaggattcaatccttgatacacagcaaagcattcctatggtaaaaaggccccataactgtaattcacatggagaagatgccacacaaaattctgagttaattaaaactcaaagaatgtttgtaggaaagaagatctatgaatgtaaccagtgcagcaaaaccttcagtcagagctcatcccttcttaagcaccagaggattcatactggggagaaaccctataagtgtaatgtatgtgggaaacacttcattgaacgatcctcccttactgtacatcaaagaattcatactggagagaaaccctataaatgtaatgaatgtgggaaagcctttagtcagagcatgaatcttactgtccatcaacgaactcacaccggagagaaaccctatcagtgtaaagagtgtggcaaagccttccataagaattcatctcttattcagcatgaaaggattcatactggagagaaaccctacaaatgtaatgaatgtggtaaagcttttacccaaagcatgaatttgacagttcatcagagaactcatacaggagaaaaaccctatgaatgtaatgaatgtggaaaagccttcagtcaaagcatgcatcttattgtacatcagagaagccatactggagaaaaaccctatgagtgtagtcagtgtggaaaagcctttagtaagagctcaactcttaccctacatcagcgaaatcacactggagaaaaaccttacaaatgtaacaaatgcgggaaatcctttagccaaagtacatatcttatagaacatcagagacttcattctggagtaaaaccttttgaatgtaacgagtgtggaaaagctttcagtaagaattcatctctaactcaacatcggagaattcacactggagagaaaccttatgagtgtatggtgtgtggaaaacatttcactggacgatcatcccttaccgtgcatcaggtcattcacactggagagaaaccttatgagtgcaatgaatgtggaaaggcattcagccagagtgcttaccttattgaacatcaaagaattcatactggtgagaaaccctatgaatgtgatcagtgtggaaaagccttcattaagaattcatcccttacagtgcatcagagaactcatacaggagagaaaccctatcagtgtaatgaatgcggaaaagccttcagccggagtacaaaccttacacgacatcaaagaactcatacgtgaggaatgttttcactggcccttacctcatgattaactcttcagtaataatcatatgagacatacaatgtagaaacctaataaatgtaatgattgtgggaatctttcagttgaagtacaatatgtcatatcagataataccactgcagagaatccatctaaaagtagagaaatcttgattcagaatgtataatttcctttatatcagaaggtttattctgggngaggggatcctaaagantcggggtggtgcaaaggattgcaaanaaaagggaaanna

SEQ ID NO: 210736 - DNA, 355 bp, Homo sapiens
ttttcagactgctccctggtttctcttttttagggtttaaattatcttgtttgacaggtcttccacctgtctctcatagtggtggttttccatgagtgcagaaatttgtttgcaaactcatcttgcataggagggttttttctccttatttgcccctcactagcagctgaaataatgattgagccttgaccaataggatatacaactctgaacaaggttccaaagtaagcttttaggattttctctagaacggacaacaaaacataagatatgtgtgtgctgcacagttgtaggtcctattctcacacctatctctgcttccttcctgggccatgggagagctacctgccacaaa

SEQ ID NO: 210737 - DNA, 378 bp, Homo sapiens
ttaacacccctttcttggtcctgaatcttgaattaatgattaagaacagaaagaatgattggaggccactatctcagtagcaacagggtaactaggcattccctgctatagccctgtggctatgtttcctctgaaatactactagttcctacccctttcaaagtctggtacttcaagtcttttgtctccctcatatggcttccaataaaagtcattttgtataagctggacagcaacccctaaccaaaacatgattccccaaatgttaatacccatataaatgaacgaaagaggaaggcctcagaaatctagcttcttaatgccaccagtaaaacagtgtacagggtgactctccaagagtgagttaggatgtggggt

SEQ ID NO: 210738 - DNA, 655 bp, Homo sapiens
catgagagattctgaaaagaatatctgggctttagaaaactgtagttggtagctgaaataaaaagataaataaaaaataaaatttagtatcctctctctcatctctgcctcactctctactcagcacctctgaaccaacccacccactccccagcttcaggaggaccggggtgcccatgctctgtgtctcatgatcttctgcctacaggaagcctatcccatcccctacccgaagttggttaacttgtgttttttctttccaagctagttctagtttcacttccttctggtagccaatggtgagagttttgattctgcctgagtttgctcctttctccattggtggagtcttcaagccaataggccaatgaatgatgattcctcactggactcctctcttggtggtcctgctcctatggacaggagccctcaggccatgctttgaaagatggccactacacatgccggatgtccactctgttcagatgatgcttgagactcaacctgaatctggcttttcctggactggcaaggtgttgagggagcaagttgttgaggaatccacacaagggaatgatggctgacctgggagggtccagtacagctgcagtgagccacatctgccttgagtgaaattattcctagataatgagag

SEQ ID NO: 210739 - DNA, 634 bp, Homo sapiens
  misc_feature (583)..(583): n is a, c, g, or t
  misc_feature (619)..(619): n is a, c, g, or t
  misc_feature (634)..(634): n is a, c, g, or t
catgagagattctgaaaagaatatctgggctttagaaaactgtagttggtagctgaaataaaaagataaataaaaaataaaatttagtatcctctctctcatctctgcctcactctctactcagcacctctgaaccaacccacccactccccagcttcaggaggaccggggtgcccatgctctgtgtctcatgatcttctgcctacaggaagcctatcccatcccctacccgaagttggttaacttgtgttttttctttccaagctagttctagtttcacttccttctggtagccaatggtgagagttttgattctgcctgagtttgctcctttctccattggtggagtcttcaagccaataggccaatgaatgatgattcctcactggactcctctcttggtggtcctgctcctatggacaggagccctcaggccatgctttgaaagatggccactacacatgccggatgtccactctgttcagatgatgcttgagactcaacctgaatctggcttttcctggactggcaaggtgttgagggagcaagttgttgaggaggacctaccttgttctttggcctnctggagggtgggcatctgccatttgtgaagctgtcntcccctagcttttgn

SEQ ID NO: 210740 - DNA, 358 bp, Homo sapiens
  misc_feature (332)..(332): n is a, c, g, or t
tttttttttttgagagacagggtcttgctttatagcccaagctggagtgcagtggtgccttcacagctctttgcagccttgaactctgggctcaattgatcctcctgcctcggccatctgagtagttgggacaacaggtatgcactaccatgcccagtgaatttaaaaaaacaaacaaacaaaacactttttgtagagagagggtcttgctatgttggtgaggctggtctcaaactcatgccctcaagtgatcctcctgctgtagtcctagcactttgggaggctaaggcaggcggattgcttgagctcaggagtttgagaccagcctggcnagcatggtgaaaccctatctctttac

SEQ ID NO: 210741 - DNA, 357 bp, Homo sapiens
tggatgtcagtgcatcatcgtctcaacttctttttaatgtccatgggcacccatccaacaggtaggaaaacctggcccaacaaaggcagtctttaattttgctcactggtggtaagagccggagtgcgagtgttggacatcttggaaaatttccccaggcggcacatgagatgatatttggatacttgcaaagaactttctagaatctccacagcaaagagttaaagaagtgtagattgtccctcactgtaatgattacggggtcttgtttttatttaacatggagcattttgtctgagcttctcatctccaaatgcataaccccagaaggcttctccacccttgccccttcactga

SEQ ID NO: 210742 - DNA, 816 bp, Homo sapiens
aaatgaacagaatgaatgtaaatgcagggtgatggatttcaacgcatacaatagaagtttctaaaaattacaagagtctaaatgtgaaatgggctgtctcagggagcagtgagtttctgctaaagtgcttaatcagaggctgcatacccgtcatcagcatgttcttctaagtgtccggttagggtgaactctaagccctcttcacctctaaagattctgtggttttgaatcttgatccccacctaaatgacctcctcatttagtccacagacaatagtatgcatattccaaaggagcaagacatgtctttgggagtccccctgaatttcttttctccgtagacctctcttttgagttgcccttgactatctaaaacagcctcattgttaaacccttgtcagaaagagcttttctttttttctctttctccaactagaataggcttgttagcaacccatcctttcaggatcttggtctttggtcaagatctaataatctaatttaccctgataataccaaaagactaagggttcccaggttaaaaaaaaaatatgcattttacaagaagccttttggcggcccaaaccttgatggaaaggtgcattaatgataggaatttaaggatccctgtaaatctctccctaccttttctatctccttagcctgatgtcagatttccctttctacctgtagcaaacaccagaaaacttgtccttctgatacccttctaagctggggtctccagaaagcctaaaatgttataggccaccaagtcctagaagggttcactcatcacccccaagtaggccctatctg

SEQ ID NO: 210743 - DNA, 329 bp, Homo sapiens
atgtgcttagtaaatattgatggaattgaatgggagagtaaagaatagaggtaacagatctattgtcttttttaaataaggactgaaggtcattgctatgttttatagaaggaccatatagtcccagcaaatagaggatatgcttaacagctaggaaaacctgagaaccaaatccagctttaccacttaacaacctttgtggccttgggaaagttactaactttcctgaactgtaattttcttttctgtaaataccgtctactttacagagattttatgcggattaaattagacaatgtacatatagagtcaggcacacaacgaacacc

SEQ ID NO: 210744 - DNA, 478 bp, Homo sapiens
aatactacagaaaagatatttatagattgtgatgactgacatcaagggaataaagaaggtgatgtataataatggagtgtatttgagggtgaagaaagttctctctgtggatgttatttaagctgaggtctggaaaatgagaatgagccagctaagagaagaggaagaatattccttatagaagtagagtaattgagctaagtgtggtggctcacatctgtaatcccagaattttgggatggcaaggctcaagggctgcttgaggccaggagtttgagaccagcctgggcaacacagcaagactctgtctctacaaaataaaaaatgagccattatggtggcacgtgtctgtaatcccagctactctggaggctgaggtgggaggatcacttgagcccaggagttctaggctgcagtgagccatcacaccacagcactccagcctaaataacagtgagaccctgtctcaaaaaaaaaa

SEQ ID NO: 210745 - DNA, 539 bp, Homo sapiens
tgctgggattatagcatgagccactgtgcccagccacatattagattatctgagaaaacatttaagccattgggagttcctaacttggagcaggagcagaaagctgaaaatagaagtgccagcgagggtctgtgtacatcagagatggaattagatgtgtagcatttgccgttataaaaaataaaataaaaagttgagggtaggtggaggttccctcaacaagtcaatgtcttgaaacaagtgggggtggatattccagattaaaaacagatgaaagagacattatttgacaaatggagcatctgaaccatgattgcatatcagtttggaaaaaacagccatgaaagactttttggagacaaatggaaaatctgaatatggactgcatggcagatgttaaggaattggtgttaattttcttacatgtgattatggtactgtgattgtgtaggggaatatccttattcttagcaaagcttaagtgcaactacatgcaagtgggtcagcaaaaaataataatagtaagtgtgtgggtacac

SEQ ID NO: 210746 - DNA, 337 bp, Homo sapiens
atgagtatttgataacaaccagaactgtacattctgggccaggtacggtggctcggcctcccaaagtgctgggattacaggcgtgagccaccgcgcccggcctacatcgtgctttcttggtcatcacagaatcctcagcagtcaataaactttgaataagtgaaagtgtgggtattgggagagtaaggattaagttgatgcaacatttttagcctgactggttgggcacatggcagtggcatttgctgagatttgaagcaaagccagaagaaagggctgagcttgattttgtgttttaaatatgcaagggagaagatgctaagtgcggttgtagata

SEQ ID NO: 210747 - DNA, 207 bp, Homo sapiens
taaactctaaaagaaaaggactttgggccttatatctgccacccattctttcaatggaggtgacacccctcatttctatatttccagtcatctctcaatgaaaaggaacatgcaggctggctggcctttggagagcaccccacacagttttgaggagctctgcagctctgcttgccctttctgcatcacagcagatccaaaaggtga

SEQ ID NO: 210748 - DNA, 332 bp, Homo sapiens
cttcaaagacattttgaatgaagtttcaaaagctagcattcctaaaccaaatcatgccaatgcagtctacaatgaggcaggtctacgttcccagactcctcaaggctcacgcgtaggtctggggcaggcacatcttagaagcacatccgtttcatatcatcaagacactccacacctgggcaccactcacagctgaactaaggccccggacacaaggtataggggcctggctccttcgccccaaagcaagacagctcctggagcgaggggtgcagacaccaccacccagcctcctccccttcacccacaggtctcacaccagggcgcactaa

SEQ ID NO: 210749 - DNA, 390 bp, Homo sapiens
taacccaaatagcactttgactattgaataaattcaaatttttgtttaaaactttcccagtagaaaacaccaggcccagatggcttcactggtaaatcctacccaaatatttcagaaagaaataataccaaatttttccagaaaatagaagaggtgggagtgtttctccacatattcaataaaccagcacaatcttgataataaaactagattactacaagacaggaaaactatagaacaacatgatcataaatgcttacataatcataaatgcaaaatttctttaaaattttttagcaaatcaaatctaataacaaatataaaggattttctccttggaataacagattggtttaatttttgaaaatcactacagttcattatattaac

SEQ ID NO: 210750 - DNA, 485 bp, Homo sapiens
tggttggttttgtccttacgttggtctacctgccaaagatggcattaatctggggtgtacttggggagcaaagcaaaggatgcttgagtcgcaaaaaaaaatctcaatccctaattctcagcccaaaatcaaataattccaatttagagcaataactctgattagcagtgaatctctctctgaaatatcccaagatgagcaaatgttattgaaactgtaaggctgggggcctgggaagagatgaaaaatcaccaaggatttaagaaaagctttggctggcctccaatttctaacaatgctatgatgtgttcctctagcttctccctccctgagcttcctgtcatcacacagcactgaggcagaggtccaacaggcagcatcagctacaaacaggcagcaaggagccagagcactggaattcaactacaaagttcaggggacaagctcaaggtaggattgattcagttcctccaacggttagagac

SEQ ID NO: 210751 - DNA, 456 bp, Homo sapiens
aaggaagggaggaaaggaggaagggagggaaggaggaatttactagaagcaaattaacttctgtaatcctaagtacttgttaaggcagaaaaacgcagataagaaaatcgaagttgagggcaaggagctcatctttcacggtcatagacctcagttgcaacatctggaaaaagagctggttgggcatgccgggcaggcttttgtgacaatgtaagagcaagtgaagattgcatctcagtatgagacaccgtaagagcttgataaatggtggaccctctgatgttgacaacatgatgtcaaagatggtgtttgctgttgtttcaaatgtcttatttcaaattcccaattagtttcttcatgccataagggcaaaatccacatctcatactttttcaggatctgctctcacttccccaaacatgtaataccaccctggtcttcaagtccactctcaaa

SEQ ID NO: 210752 - DNA, 489 bp, Homo sapiens
aactatcaaatttttaaataaaggcacatccaaaagaagttgcaagtgagctaaagttaatttaaaaatatttaaaatcatcacttgttcaagaaaaaattctcaaacatgacaatgttctcaactgaaaacaaaacaagaagtagactttgaaggttttactaatgagtgttcttccatcaaagccaggaaagtaacattctaataaattcttgggctttgtttgtttgtttgtttggtataagtaaaataatttaaacttaatataaagttttaatgtacctacttttcaactttccaactttttttatgctacctcaatgttctggaaaaaattaaccgattaaaatacatcaaggccaggtgtatgtttcacacctgtaatccgaggcactttgggaggccgaggcgggagtatctcttgagcccaggattcaaggctagcctgggcaacataacaagaacctgtttttatatttttttaaagta

SEQ ID NO: 210753 - DNA, 547 bp, Homo sapiens
tccacccataacaacagagtctttactgattcagaagaacttgcaagtgctttggattttaaaaaacacattgaagttcttcattacttactccaactctggccaggtaaatgattctatggaaatgtttttcactttcaatgatagggtatttgaattaactaatcattaaatatgctcatatatgattgaagaaactcttctagattttgctttttcaaaatgttgtgaattgatacctgccctttagatttttttcatttaaatgttttctgcctttgctgatgacattgtaggcacgtagattaatgtgcacatgttagacttggtcagatctagatttaaatcctggttgtgccacttattagcaatctgaccttgggttggtttcttaacgtcttagagccttgtatcatcttttgtcatatggatttaataatatgtttatagatttttattaggatttttaaaaattgtgtatgtagtgtgctcagtgtagctcttgacatgtaatagagactcaataaacactaatttatttactctt

SEQ ID NO: 210754 - DNA, 967 bp, Homo sapiens
taaagttccagggtgcaagtgcaggatatgcaggcttgttacataggtaaacgtgtgccatgtgtgttgctgctcagatcaggctatcacctaggtatgaagcccagcatccattagctatttttcctgatgctctccctcctcccacacctccaacaggtcccagtgtgtgttgctccccaccatgtgtccatgtgttttcacatgtgttttcaccgttcagctctcccacttgtaagtgagaacatgtggtgtttgattttctgttcctgcgttagtttgctaaggataacagcttccagctccatccatgtccccacaaaggacgtgattcgttcctttttaaggctgcatagcattatggactggataaagaaaatgtggtacaaactcccttcttaagcctgtttcccatgcaggattgtccaagggctgattccttcccactcagcccattttcgttcatcttctgctcaccccctcacaaggaaatccagccctcagccagcctcatccctccaggagttttcacctaccctgcatctgtcagcacctccaagtgtttatccccatcccagccttttcctggccctgagctgtggattaatttcctgttgctgcggcaacaaatcacagatttagtgacttaaaacaacgcaagtttattgtcttacatttgttgagtcagaagtctgaaatgagtattaaggggctaaaaccaaggtgttgacaggaccacattctttgtggagacttttaggagacaatctgttaccgaccattgccagcttctggaagctgcccatgttccttggctcgtggccccttccctgcatcactccagcctctgctgctgccatcacatctcttcctctgactctggccttcctgcctgtccttataaggacccctgtgattatactgggcacacctggataatcctggataaactctccatctcaagatc

SEQ ID NO: 210755 - DNA, 930 bp, Homo sapiens
taccaggactaaattttgataaaatgacttttgctgttcctttcatatctaagattcttgaggagaattaaatatagtagtctagagtttcaacctttgaacataacgaccgtgggcgtataccttgtaaaggggtaacactggtgagccataaactaatccaaaaattcacaccttttcttttgttcttacaggtaggtaatccataatttcattgtcggtggtggtatgttcaattaagtactgtttgctaatatttaccttctaagtgcactagtaagggttgctaaaaattactttgaaaaagccaacattgacatattactagtttactgaagaccaaaagtcagtattttcactagaagtctgcactctagacactacatatataacctatcactctctacataatagattatttgcaattatttagttattttatctaattctaattataaccctatggaatttttatgttactgttactacattttacagaggagaagacagaggtagcagaaaactaagctaatttcccaaggtaactcaactagcagaagatagaaccacatgtggagatcaggctccagagaaatccttttaacatctacactatatttcatcttagcacctgtagagttgtcgagcttgagcggcacgtgagaaggcaggcataagtgggctgtggttgaacaaaaaatgtcagagataaatgatcatcagtctagaggtgaagacaatgtgggattagagtgaggaagaaggtacctgcttggaatgagagatgtagttgctttgagtgactggagtctggatggcgtagtagcaacaaggagagagagggccaggcgtggtggctcatgcctgtaatcccagcactttagggggccgaggcaggtggatcacaaggtcaggaattcaagaccagcc

SEQ ID NO: 210756 - DNA, 969 bp, Homo sapiens
  misc_feature (223)..(223): n is a, c, g, or t
  misc_feature (259)..(259): n is a, c, g, or t
  misc_feature (265)..(265): n is a, c, g, or t
  misc_feature (480)..(480): n is a, c, g, or t
  misc_feature (485)..(485): n is a, c, g, or t
  misc_feature (507)..(507): n is a, c, g, or t
  misc_feature (571)..(571): n is a, c, g, or t
  misc_feature (818)..(818): n is a, c, g, or t
  misc_feature (850)..(850): n is a, c, g, or t
  misc_feature (960)..(960): n is a, c, g, or t
ctgagccagcggctgctaggaggctgtgtccgcaagccagcggggcgaggcgcctgggccctgcgcgtcaggtcccggcctggggcaccggggctgccagcgtcggaggaggcctgagacctgggaggaagctggagaaaagatgccctctgaatctttgtgtttggctgcccaggctcgccttgacaccgaatggttgaaaacagatatacagatggtagtntcgaaccaagtggaacaaagaaagaagatctgaatnacaaanagaaaaaaaatgaagacgaaactcctgcacctgtatatagggccaagtcaattctggagacctgggtgtgggtcaagcaaccagatactcgggagactgaggcaggagaatcgcttgaacctgggatgcagaggttgcagttagccgagatcgcaccattgcactccagcctgggcgacagaacgaaactgtgtctcataaaacaaatataactnaaatngtaatgtgtttctttaaaactnaagaaaatgtgcaaggtggatgtcttcctgtcacttcgcacagcctactgccatagcacctganccccagaccctaaactcactgtcctgctcggggaccccagaccacactggccattgaaggcaccccaagtactctcctatcctcacctcgctcctgcagtaaatggctaaatgaataactcagaagtgaagccaaaaaagaaaaagaaaatgcacatggggaacaggagaggcgagcagaggccagtctggaagcctgggctgatacgctgtgaagagatgtctccgggtgctgcctgcggggcgcntctgccattcagaacacacctagagaagtctnaaccttaaagagcacacattcctgagttccctgcctgcccacaaaactttccttgaaacaccctaacctctgagcctttgggggggctgatttcagtgataactccagtncttccatgt

SEQ ID NO: 210757 - DNA, 517 bp, Homo sapiens
  misc_feature (223)..(223): n is a, c, g, or t
  misc_feature (259)..(259): n is a, c, g, or t
  misc_feature (265)..(265): n is a, c, g, or t
ctgagccagcggctgctaggaggctgtgtccgcaagccagcggggcgaggcgcctgggccctgcgcgtcaggtcccggcctggggcaccggggctgccagcgtcggaggaggcctgagacctgggaggaagctggagaaaagatgccctctgaatctttgtgtttggctgcccaggctcgccttgacaccgaatggttgaaaacagatatacagatggtagtntcgaaccaagtggaacaaagaaagaagatctgaatnacaaanagaaaaaaaatgaagacgaaactcctgcacctgtatatagggccaagtcaattctggagacctgggtgtgggtcaagcaaccaggtaatctgagttttggcactttggaaagcttgatctgacgctccttttctaaataacttggatggattattcgtattttttggtaacaattttaaaaaatgtaattaaaaaaatttaaatatcgtggtaaaatatacataccgtaaaacttgccattttaaaaaaaaa

SEQ ID NO: 210758 - DNA, 499 bp, Homo sapiens
  misc_feature (16)..(16): n is a, c, g, or t
  misc_feature (22)..(22): n is a, c, g, or t
  misc_feature (31)..(31): n is a, c, g, or t
tttcaactctttgccngcaccncgactcttnaggatcccccatcccagaataaaccttgcggaaaagaaatgttggcagagaaaaaaaaaaaaaaaaaaaaaaaaaatgggggggggggtgaaggaaggattgttctcaagactaaagagacataatcactaaatgtaatgcatgaaacagctgaagccatgttcaaaaaggtaagtttgaaggcagctacagaaatttgaatatggactgaacattaagcattgagaaatgtctttagatgctataatggtattgtgactactttggaaagtgtcctgacagatgcatgctgtaacttttaggggtgaaatatgtctgcaactcactattcagcctaagtgttcacacctacacatttacataaaaaatatggtaaaatgttaattgttgaatctaggtggtaggaatacatgtatacacagtatttttttcaggatatgcttgaatattttccaaaaaaaaaagaag

SEQ ID NO: 210759 - DNA, 526 bp, Homo sapiens
tctgaatgtttaacttaagacaccctgctgaacatagcattctcactctaactccgtgaagtgcacaataatatacatttgaaggtaaggattgaaatatttatagtactaggttttcccatacagtaatatgaattcaggatacatacataaaagacaacaaatgtttttcattttcttcatttgagctttgcactttaataacaaatttagtaatttgttattaaaaaatagtataaactctaaattaccttaagaacaaccaaagcatacaaatcgtactttaaaatgttaaattttggccaggcacggtggctcatgcctgtaatcccagcactttgggaggccgaggcgggcagatcacgaggtcaggagatcgagaccaccctggctaacacggtgaaacctcgtctctactaaaaatacaaaaaaattagctgggcttggtggcgggtgcctgtagtcccagctacttgggaggctgaggcagaagaatggcatgaacctggaaggcagagcttgcagt

SEQ ID NO: 210760 - DNA, 499 bp, Homo sapiens
cagtgtgtaggatgctggaaatggtggagatgggcctgcgaagagagtgctgggaagtgatgacccaggagcagcagccgggcacctaacaatgggtcagcaccgtgggcgtggagacaagggccgggattgatcaatacccaagaagtacaatgtacaggacttgggctccatttggatggagtgggtgagggaggagtcagaaatggcttccggtttccagcttgggcctggggattggagatgtccccactgagagtagggcacaagtgaggaaatggtttggagaggaagatgataagttacatcatggatgtgctgagtctgagttgcctatgggacttggaatggggggtggcaaaaggtgtgtgatcttgagcaagatattcaactcttctgggccttgggcttctcatttgtaaaacggtgataagaatattacttcccatttgtgttgctgtgaatattaaatgcgctaccacatgtaaaatgttgagaa

SEQ ID NO: 210761 - DNA, 411 bp, Homo sapiens
agattgcgccactgcactccagcctgggcgacagagtgagactccgtctcaaaaaagaaaaaaagaatgatttgctaattaattatgcaggcagctgatccagtgctgtgtaaccttgggggccaccagatgccaatcaatcagtagaatgggagagaaggatggaggaagtgaggacaaggggcaaggaggaaggtctgtccacctgtctcttctgtgcaggaggtgtccaagcaggaggagcacgtcacatccccactgaaaaagcccacagaaaatgaaaagcccacatgcttgtccattgctgcaggatgggggcaagtggagggggagaggtgtcggcgctcccaccttactcccagtcatggctgactcctccctttccttcgttcttgttcctaatctgtcacc

SEQ ID NO: 210762 - DNA, 153 bp, Homo sapiens
acaaaaaacctttcaatccttcactatcttccttagcaactaccatcctccccctttccttaacctctacacgaagttcatcctcatcatatctacttccttgccactcacattcagtcctctggtctctgtaattagagttttgcccctaca

SEQ ID NO: 210763 - DNA, 422 bp, Homo sapiens
tactgcactgattggcacacacacgtgtgcacacacacacgtgcactctttcccatacacgatcaaactcacactcatttactcacgcacacttggtctcccccacacactttcttcctctctctctcttgcgcttccacacacacacttgcattctctctcactccctcagccaacatgccgctttctggacccaggctgaaatgtctggtgtgcagcgtgtcaaacctcattgttagggtctctagttacagcacatgcttcaaacatcaggtggcaatccttttcctaactcatcaggctgtgggcctgagctgctgacgccagctcctagcttggaaatgcttcttcctatttgtaaactcggaggagaagctcttgctaaagcgtcctgttctgatcattatgacttactgtaaaga

SEQ ID NO: 210764 - DNA, 525 bp, Homo sapiens
taggctggagtacagtggcgcgatttcagctcactgcagtttccgcctcccgggctcaagcagtcgtcccacctcagcctcccgagcagctgggactacaggcacacgccaccatgcccagctaatttttgtatttttttgtaaagatggggtttcaccatgttgcccaggctggtctccaactcctgggctcaagcagtcagtataatccctccggcagtgctgggattacaagcatgagcaaccacacctggctgtcctcagagttaaactttaaaattagtagcatgttgttaactttatttctttccaaagcagatttgaaagagctaaaaacattcagaagtacagaataattaattgaagaattgggctgaagagaaagtaagtctagaaaataagctctggccaggcacagtggctcacgcctgtaatcccagcactttgggaggccaaggcgggcagatcacctgaggtcaggagttcgagatcagcctggccaacatggtgaaaccccgtctctac

SEQ ID NO: 210765 - DNA, 615 bp, Homo sapiens
tgaagcaggaggatcacttgaggccaggagttcaaggcctcagtgtgctatgatcacatctgtgaatagctacagcccaggcaacatagcaagatcctgtttctaaaaataataataaaatagaaaatattatattatagagaagatatacaataatacataataaataatatataaaatagaatcataatggcaacatcgtatgtatatgccagtacctatgactaatttagaagaacgccagtttttaataccacaaatatcaatcctgtaaacatttttatatagaaatggatgtacaaatttcttatttccttagcataaattctcaaagttgagctatatcaaaaggtatattattattatttactatgaatagagcttgccagattatccatctggaattgtttagcagtttatgatagtgtgtttctatctcctcttcaatattggatattattttttaggcaacgaagttggtagataacaaatggcatctcacttttattttatttatttaactttattttgtgattttatttagaacataatatcaaagttgtttattagttagtagtattagttctttattggtacgtttccttattgctacat

SEQ ID NO: 210766 - DNA, 353 bp, Homo sapiens
cctggaaggcgtctttaatcaggatttggtagtacacaagctctccggattgtctgcattaacatacagggacttaaaaaggcacaaaatccctcgcacagcgacgcgtgacggcggggcgccccctccccgcccgtgcgcggccgtgtgcgcgtgggtgcgtgtccgtgtcccacccccgtggcggcgccgcgcgtgtgcgtgtcggtttcaagtgttggatttgtacagtactcgcagtctaggggcagggggctcagtgcatgcttttctacccgggcctggggccaccccccgacgccgctatgtacactaaggaggacgcaccccggagagagagaggaagaaaaaaa

SEQ ID NO: 210767 - DNA, 278 bp, Homo sapiens
aaaaaagatccaaagaaagggtggtagacaaaggtctagctcctaggctgagggcctcagggcagaatgcggcttcatcctgagtcaatgatcttctcaggtagttgcttcatatatacccccttcccaacaccagagctgctcttagactgaggtcaagtgtgagccagagatggctggagatatgagaacaagagcaaagcggacaggaaagggctaggagggatcgcaccaacacactccagcctgggcgacagagcaagcctctgtctcaaaaa

SEQ ID NO: 210768 - DNA, 315 bp, Homo sapiens
tttttaattagttgacaccaataactagtttagaagaggctgtgtcatgcccagtgtggtggctcacgcctgtagtcctagcacttggaggctgaggtggtcggatcacgaggtcaggggttcaagaccagcctgaccaacggtgaaaccccatctctactaaaaattcaaaaattagccaggcgtggtggcacacacctgtaatccaagctactcaggagggtgaggcaggagaatcacttgaacctgggaggcagagattgcagtgagccgagcgccactccagtctgagcaacagagcaagagtccatcttc

SEQ ID NO: 210769 - DNA, 280 bp, Homo sapiens
tagcacacccaaaaaagttttaagaaaaaattccaatagactaagaaaaaatagtctatatttactgacaacctacaagtctagtatgcactagaatttacatcgacaagtttttgaaatgacaagtcttagacaaataattgatactatcttcacacccctcagtggaggtcatttcagtagaaagagccggaagtggcgacgtgatcctagacacgctctttcttctctccctgggacccatttccttatctgtaaaacgaaaaggctggactagatg

SEQ ID NO: 210770 - DNA, 1037 bp, Homo sapiens
tgggcctatggctatgcagctggagaggaagggatagtgtggggagcttggacttggccgtttgggacagggggatgggagaggcagaggtcctgcctcaggcctccataggagtgacatttgctggtgtcagaagcttggcaagaggggaggatgatcagaccctgcatggacagttcgaattggagctctctgcagagtccaggaagagaggtctggatgggagggaagccatggggtggaaaagatagcttccaatggaaggcagtgaaaactcgccataagtgaaggagaagaaggaggccaaggagagggggcaggaatggcagccggcagccaggcggtcagtggagcaggtgctcaggaggcccacaggagagcttcgtggaaggagtggacagtgtctgaggcaaggggcaaaaggcatctgctggagctggtgaccccagcttggtgccccccaaagccagagtacgaggctgagaggatgcaggtgtcctcctaggaggtttgagtcagaaggcacgaggcagaagcagtgggggaggactccctcagtagagcgaggaggaggcccctcatccaagaggaggttggagcacaggggggtctaggtttgcagtttcgggaccggtagctgaggggtcccagggcctttcttctgtgaaggagaatgtgtccaccgtggggagggggtcgggagagagagatacttcagagtggacagggctgagaaagctttatgggccgcgaaaggcagagtagttgttggtggatgagggtggctgtggcaggtggcgtttcaggtgagacagctcggggcccagaaagacactgggaggaggagagctctgctctccagagaaacaggagcagagaggaaaacagagccgcagcgagcggcttgtggtctggggatgaagcccaggttgacagcatcctctgcttcgctggtggaggtgggggcatcattctcacacctgtgctgggtcctgtccctgccagccaagggagaccaggaccctgccactgttgcg

SEQ ID NO: 210771 - DNA, 363 bp, Homo sapiens
  misc_feature (318)..(318): n is a, c, g, or t
  misc_feature (349)..(350): n is a, c, g, or t
  misc_feature (353)..(353): n is a, c, g, or t
  misc_feature (358)..(358): n is a, c, g, or t
tgggcctatggctatgcagctggagaggaagggatagtgtggggagcttggacttggccgtttgggacagggggatgggagaggcagaggtcctgcctcaggcctccataggagtgacatttgctggtgtcagaagcttggcaagaggggaggatgatcagaccctgcatggacagttcgaattggagctctctgcagagtccaggaagagaggtctggatgggagggaagccatggggtggaaaagatagcttccaatggaaggcagtgaaaactcgccataagtgaaggagaagaaggaggccaaatcggcaaagncaggaattggcggggatcctctagagcgacnncanggcancaatg

SEQ ID NO: 210772 - DNA, 586 bp, Homo sapiens
aaagcttcatttctatacacttactgtcctttaaatagttactataccccacttccagtgaaacttgttatactactgtgtgaaaaaaatggacttttctctatccttcatttccacaacttcagttagtatggacactgtgtgtcctccactagagagagggttctctcaggtcaaggacatctataatgtttttattttttgagacagggtctcaactctgttgcccaagctggagtgcagaggtgtgatcacagcacactgtaacctcaaactcctgggctcaagttatcctccacttcagcctcctaagtagttgctaggactacaggtctaccacagcagcctaatttttttttaattttcatttttgtagagatggggtctcacttgatattgccccagatggccttaaatcctggctttaagtgatccttctgccttggcctcccaaagtgctggaattacagatatgaacgaccatacctggcccccatgaaatgtttaagcttggagggaacaaatgtaggctaattagctcatcttttcagctaaggatggctagaaagtggctgattcatccaaa

SEQ ID NO: 210773 - DNA, 561 bp, Homo sapiens
gcatactcaaagagcttttgaacagtatcagaacattcatgatatgtagtttttgcatctttgaatcatatgccaacaatgtactctttggaaacttatacatccatatattgatcaatttcataaaaaggaaatcaagttcattctgagtaaaagatgtgggataaacctcaaatttaacagcagattgttggaatcaatgaggatggaagctgaaggtgacaagcacagttacctcatggtgttctgagcaagttcatcaagtatcaacattaaattgatacaaagactgtatttcatcggccacaccagcacattctcgcaggattcagggctaaaatacaactgtcagcataagaaacaaaaaagcccatttcttagacaacttgttaaaatgctatctttctttataactttctctaacttggtacatatcaatatcaatcaatgtcacaatgatttaagtattgacaatagaggttttggaaagcaagtgaataaagaaaaggatgaatgattttgtgtttgtatgtgtgaataatcaatttcattcttattgta

SEQ ID NO: 210774 - DNA, 503 bp, Homo sapiens
ctctctcttcccaaacagtgcctttactaattgaattgatcagcatgatgacttgccacctcctgaccagtcctagaatgcctagtttagcccactcgtgggatggccaccttcaaacagcaagtgtatgatgctgagacaggactggggcagaaagtcaggtaagccacccaacaggtgggccagaggaatggtgtcctctgagactggttagcatcctgtctgcatggtggatgggattagctgcaggacacacttctcacttctacaaggggatcatgatcatgacactttctgatgtctctaaagtgactgcaggtggatgatgaccctcaaaaagctgcaaaaattctgagtggatggtaagcagaacacacaagaagatccttaggggacagatgagtttcaggtgtcaaatgcacaaatccctgattctttaagtatcaatccgataggtcaatacaaatatttggaagcaggtttgcaaagaaactaaaaaaaga

SEQ ID NO: 210775 - DNA, 564 bp, Homo sapiens
gcaacagaaaattagttactgtcacctacaccatgggcttctttccaacatttttccaaaaatgatgctttgattctgagggtgacatctctgcctaacttgagaatggacatttgttctgatacttagttttcacagttatcataatttcttttttgaacaagatattttaactcttttcactgcacatatttattttcccaactgttctcatttgccaaactaaagctttaaaaagtatctcagaatttgtaatggctaacacttttaaaaatgaatttggttttataagtcaagctgacacaacacaatttttcggacaaattaagtccccaactttgctgttgcctgaataatttgtgccccaagttacagagctattgacatcattctcctttggaccatcacccaaaaaacagagtgtttctattctagttctcctccttcagggcaagacacatgtcactttttccagacaaattgacacccaggcaaatttcaaacattgttgtataactactttagaatcagagacttcaaacctttgactagtaatatgtaaaa

SEQ ID NO: 210776 - DNA, 1019 bp, Homo sapiens
cagaggtcaaggctgcagtgagccgtgatcatgcctctgcactccagcctggacgatagagcaagactttatctcaaaaaacaaaaatttaaaaagatatcaggtagctcatagaattgttgagagggctgtaaaaccaggcttgaacttaaacagcaacgataaaccacccacagaacggacatgatgaagaagttggcaaatgttaccaactgtcctggtttttttggtgactgtagtttccaaggattcagatccttccatgccaaaatctgaaaaatgctgggcaaagtatgactgacaatgtggtaatcttacagctagcactagagacatcaagcactagacaacacaatttgccctttggccacttatacaatgggaactcacgcttgcagtaacctctattgccactaggagagagaaacacagaaggaggaagggagaagggagagagaggaaaaaaactgttgcttgtctccttagctgtgagtcaaaggtctaacacagatgtctggctgaaaagcctaggtcacatgcctgcaccccagagaaagtatgtgacatcttctgcttccattatgggaaacagcctttgcttgtcacgaagatttacatggtgagacatatcctaaatatagggaagctgttgaagtggcccaaataatgaccaatttctactaatttgtactaatatccaaattacttttaattatctaatattacttagatacagtgaggcaaccattcgttggatatataatggtttctttgatttcaaaaatctttttttatgtaatatatgtctgaagaccatcaaaataaattcttaaagtcagattaataggatgttacttataatattattgtaattatttgaccacataatagtttatgcccattatatactatgtaattgtatgatggaaataatgctgtactttgtttgtaaaagtttaattatcctgacctttgttcatcataaagaattgctccatttctattatttatcgaggaaa

SEQ ID NO: 210777 - DNA, 521 bp, Homo sapiens
gagatggagtcccgctcttgttgcccaggctggagtgcaatggcacaatcccggctcactgcacttcagcctggtgacagagtgagactccgtctcaaaataaataaataaaaataaaaaaaaataataattccttacatttgcacaaccctccatggtttgtagaattttcccctgctacctcttttaattattacatccccgtctgaggacaggttggcactactgctgcactgagcaagtaagaaaactatatgatcaaagagatcatgtagctgtccagatctcctaattctcatgatagttggcccactgtttccccatcatactacaatcacttcacacttttaaatcataggtaactgtttttaaaaggacttttggtttggtgcccccatgaatgaacctgctccactgaatctgctaaacaaatctggcatgtggcttagggtgtggagaacctggtgagtacagtcgaggctatatccagtggaaaatgtaaagatatacaaaagtggagt

SEQ ID NO: 210778 - DNA, 561 bp, Homo sapiens
ccaaaggggtagattctttctgtgactctcacactgcaaagacctgtcctgccccaactgcttataactatatatacacatagttgttttttcccctctcttttacacagaggaaatactttatatattttgttgttgtttcaaaaattgtatggaaattaacatttcttgtctcgggatggtgcgaggcacagaacaagaacatcatttcatttccttatgatcttctgtctcctggcggggcacccggcacctctcctttggcttatagggtggagtttagacaggacctaacgaccaccaactctacttaatgacaggtgttgggtaaaagtttgccatgtgaataaatgaatgtattcatccttaaggtcccctcattttcccctagagtagcccagagcctcatttcaacctgatagcctcagtgcagactgtgatgtgccccgttggagccccagctggcatgcagggcagtgggctcaaagtgaggtgcgagaagggggtattaattctttgtacctacttataaaaaatttattaaaactattcctgtattaa

SEQ ID NO: 210779 - DNA, 258 bp, Homo sapiens
aggagtaatcccgggataaagggaagtaggatgagatttttttacagcaagaggctaaggacaggaatattttaagaagggaagactggaagcaaggatgcctgtaagaggccatcaggagtaatcccgggataaagggaagtaggatggtgcaatgaagaatttaaggtggcaaatatgagactgtagagtagactggggttgatctaattaagaattaaaattcagagatgatttaaacattaaagagataatatt

SEQ ID NO: 210780 - DNA, 192 bp, Homo sapiens
aagcatacatgaaagtagaacaaatgctatgatgaaatccagtatttccattcctcagtttcctgttattgatactttataatttcatgtttaaagaggggtctctttacctctctgtgccttccttcctgctggaatatccaatcatgaagtctgtcaatactttagaatgtatctcctagagaagaggtt

SEQ ID NO: 210781 - DNA, 447 bp, Homo sapiens
agcctgggtgatggagtgagactctatctcaaaaaagaaagagagaaagagagagagagagagggagggagggaggaaggaagggaaggagagaggggggaagaaatgcactgggctgagcgcggcggctcatgcctgtaatcccagcactttggatggcccaggtgggtggatcacttgagcccaaaaatttgagaccagcctgggcaacatggcaaaacctcgtgtctacaaaaaatacaaaaattagctgggcatgttggctcacacctgtagtcccagctacctgggaggctgaggtgggggcatcacttgagcccaggaagtcaaggctacagtgagccgtgatcacacgactgcattcctgcctgggtgacagagtgagtccctataaaaaaaaaaggaaggaaggaaaagggaaggaaggagaaagaaagagagagaaag

SEQ ID NO: 210782 - DNA, 108 bp, Homo sapiens
ttttgtggtgggggcctttgcctagagcaaggtcagtgtggaatatacagagaaggatggtgtctagcagcaactacctcctttctgctgccctcatctgtgcaaaac

SEQ ID NO: 210783 - DNA, 548 bp, Homo sapiens
caccacgtcgcgtcctaccaggcaatgtcaggaaggaggttgcctttgagcatcgctgttttctctaacgaggtgggacaggagcagtctccggttttgagagattatgaaatgctttcaaaatgctctactttccgaaaatatcttacactctgcttgaatcttcttcaggaggaagccattaaaacaggagcctggccaggctcttacctgtgaagatgcattatgcacattttgccctcttactctttttgaatctctgctcctggtctttccctgcccccgccccgcccagctcctaccgcccccgcctcggggctgaattgtgctttgatttttgggtgaaagataagtcacaatttaaaagcgaatttcttcaggcaaagacattaataatactttaattaaaatgcacttgtaggccaggcgcggtggctcatacctggcgctttaggaggcgcggaggccaaggccggggaggatcgcttcatcttaggagttcgacaccggccaccagcctgggcatcttagagagacgccgtctctac

SEQ ID NO: 210784 - DNA, 567 bp, Homo sapiens
agtagttatctgaggactggtgaggactggctgaccctttcttatacatgaggaagtatgagtaggactggggcgggggcttgaggctgttagaagtcaggggaagttcctaactgagaagctgcacagaagtgatggaagtctcatttggtagactcagatctattgggagatttggtcctgtattagtcccttctcacactgctataaagaaatacccgagactgggtaatttacaaaggaaagaagtttaatggactcacagttctgcatggctgtggaggcctcagggaacttacaatcatggcagaaggcaaaggagaagcaggcacctccttcacagggtggcaggatggagtgagtgcaagcaggggacatgtcagacacttataaaaccatcagatctcgtgagagtcactatcatgagaacagctccggggaaactgcccccatacctccacccttggtcctgcccttgacaagtggggattgtggggataattcaagatgagattttgggtggggacacagcctaaccatatcaggtcctcactttggggatcttgc

SEQ ID NO: 210785 - DNA, 296 bp, Homo sapiens
ctttctcatcaatacaattcactctacatactgctacctacctgataaaactctgctcagaactctttcaatagctctatatagtgaactcaatcaaattttaacccctatgcctaacttttaaggccaaatttatatcctccttatttatttatccaagctaatttcctacttcagatggacaccaaagaatcaaatcagccgtatcactgaacaatcacaaaatggcccatatatcaaccctcatgcttcctaacacagcatctgttggcttgaccttctgatggtgtcaatgc

SEQ ID NO: 210786 - DNA, 575 bp, Homo sapiens
gtgctggtattacaggtgtgagccaccccacctggcctctttgttatttttgtttttgtatttgtttttatttcttaaaatttctatgaattacaaaaattcttgcaagagtctatccttattttggatttattctgtctttgtaatctagttcttaatagccctctgttcttaaggatagcaaaacagattggttttaagaatgaatggtttgttgactgtcttaaaaaataacgcagggctcggtggctcatgcttgtaattcgagtactttgggaggccaaagctagaggatcctttgagccacggagttataccagcctgggcaacatagggaaaccctatctgggctcttaaaccttcataggtcctataattactatgtttgagcccataaatattaaagtatttcacataaggaaatgctgaattatataattaaagacagaaaagtagtataaagtacagttcttcactgttaattaaattgttttgtcaaaggtcctaaacttttttgctcttaccctggcacaatagtgttcaagattaaagagtaatttgtcctttattttcag

SEQ ID NO: 210787 - DNA, 157 bp, Homo sapiens
gtgtccaatgattaggtgggcatagacgtgcctgtaaaagggaagaaatggaacagagccatctgttcctgtgaaatcactttctttagtattaagtgtaggtacaaaaaaagtgtcttttgtaatgcatctctgtaacacagcatattttccctaa

SEQ ID NO: 210788 - DNA, 514 bp, Homo sapiens
gactatgctttttgccaattctttggtgagaagggattggtagttaattatagaaccactttctatattaattctagatattgtattctaatccttagaaagtaggctgtggaagaactaataattgccctcaaggacccattctcttcttctcataagagaatctatggttgcccaactaaagcttctatttcgcagcactcattgcagatagttatagctatggactcagttctggccagtggactctgaataaaggtactatgtacactgttggctgtgctcttaaagctaagggatgtgccatctcatcccctgtgctctctttgttggctgggaagctggcaggatgataggagttaagccagccattatggactttcagatggaaaccagctgttgaggatgagagagcgacaaaaagaagaccgtcaagattgtggggctaatttaccagcctgaattgccaacctgtgtttttgtattacaggcaaataaagtatgtgtttttaaa

SEQ ID NO: 210789 - DNA, 850 bp, Homo sapiens
cattaacttggggtgaatctgcttatctgaggcaatgttatatggaaaaatcaatgctcagatgtgaagcagagttcgtgttttatttattaattcatttttattaaatatagttaaagagggcctttctcacttaaagaatcatattaaaaccaaaattagattaatggaactaccatataggaacataatattgttaagatttttgataagtttaaagaaacatgccttttcattgagaagtagagaaaatatttaagctcttgtaaaagatggcagtaaataatttgtatgatatcatttattcaagtattatctgtacttgtagaaatgtttttgcaaggtatataaattttgtattgtctatggatgtaatgtaccatttagaattttatattttacattagaagtgtatgatgattcagaagaatatattactagaaccagtgttctctctattcttcattccatttctcaaaagtgttttgtactgtttgccctgttgctcactatgattttgtatattcatctaatggattcactgggaatttggtatagcatatttctcacagtgctgcctggcacactgtttcagttcctgatctcctttgaattattgcttgagtttgctaattttcttttaaatagatcaaagcagcctctttatgccataagtttagctccagtgacattgaatagtcattgtcaagtactggttgtttgttgaatattatgtttaatagcaataatacgaaataacatattactcatgcagattattaacttaatgttaaaagaagccaggattaaaatgtatcactcaaataaaacatcttgtcttactaacata

SEQ ID NO: 210790 - DNA, 381 bp, Homo sapiens
ttaaatcttcattcaggctttaacttgcacgcacaagtgtgtgaaccttcctctccatctccagggcctggctccaaacagcatttccatggtcatggaaatgatctgaagacttccacagatgcctcactacttttttttttttttgaaaaagggttctattttttcccccaggggggaggggcggggccaaaatattggttaatggaacctttaaccccagggccgaattgaggggccgggtacgggtttaattaaaacttcaacttttgggcccaaggcggtcttccggggttaagtttccaaaatggtgggataaaaaggcccccccaacattccccggttatttttggtttttttggaggacacaggtttttgttg

SEQ ID NO: 210791 - DNA, 172 bp, Homo sapiens
tgttattttggggcttatcaactgagaaaaagtagaaatgaaaggtatatcatcttaatgaaaaaagccatttgtgagtcttctttctttatctatttgttctgctttataacggtcaaaatccagaagaggcgcctgcgaaaagtgatatatattcaccatattctcctgc

SEQ ID NO: 210792 - DNA, 427 bp, Homo sapiens
actatatggaatctatgaagctgcaaaaatgtgatgaatccttaagcatttacacggaagtgtctctctttcccttgtgcatgtggatggacatgcatgcgtgtgcacaaacacacacacacacacacacacacactccttactttagttattccatactgagaagagcttcctacatagagcccttaccattccctctgaatatctccaccctcctcactgtaagaattcctgctcatccttcaagactaatttcagagtatcatctcactaagaaagcctttcctgactcctgtctgggtaggacttgcacttaatgtttgctgaatagaataaagaaaaaaaatctacattttctatattctaaaaattagcttgaaatgtcattctcgaattaattgttatctattctctttctctcaaattc

SEQ ID NO: 210793 - DNA, 468 bp, Homo sapiens
ccattaaaaacaaacaaacgaaagaattatttgactcagtaatcctcctctttctaatttatattctcaggaaataatccaaaagaaggaaacattaccttctttaacaaagatgtttgttgcaacattattcgtaatagagaaaaagtagaaacagcctagaggttcagaaacaaaggaatcattagttaagttgtagagtgttaaatataatgcatttatagaaaatgaggattataaagtattatagcacatggaaaatacttactgtataatatagggagaaaagcaggataccaaatagcatattcactatgagtgacatctacataagcatatattcataaggaaaagactgcagagaaaacacagaaatgatagtaattgtgatgatctgttagaattatctgtaacttttttcacatttttttggtactgtagtcatgttgctttggcaaaaaagtgata

SEQ ID NO: 210794 - DNA, 418 bp, Homo sapiens
ctatttctggatacttttctcctttataaaatctttcacataaatacaataagaaaaatttaagtcagttttaaaatagtttgcctcacttgtatgtattttaaatattagctagaattttggatgcacaaatatgtattgcaaaatcccttcttctactgagtggtatataagtttttttaaaatggaatgtggatgctttaataaatttcatattgcagtgaagacactgagcacttagagacaatgacatcaatacaatgaaaactgattccacagaacacttacaaatgcatacattttcctccaaagaaacatgtttttcacagatttaagtaacaaatgatttacataggattcttctgattccaaaatatgtacagaatttttgactgtcagaaactgattagcagtggtt

SEQ ID NO: 210795 - DNA, 312 bp, Homo sapiens
tacccctatttcttactatatacaaaaatcaacttgaagaataaagacttaaatgtaagaccccaaactataaaaccactaaaagaaaacacagaagaaacagtccaggacattggtctaggcaaacattttatggctaagacctcaaaagcacagatagcaaccaaaataaacaaatgagactatattaaactacaaagcttctacacaacaaatcaacagagtaaagagacaacagggaatatgagaaaatattaatatctgcaaactattcatccaaaaagggactaatatccagaatatacaaggaac

SEQ ID NO: 210796 - DNA, 143 bp, Homo sapiens
acttgtcacaggcaagaattatcaatggatgctacaacaggagggcaaaaagtgtaagaaggaggatacctatacagtctcaatgtatctctctacaagaaatatattagttatgaagggaaaaataataacttcactgacac

SEQ ID NO: 210797 - DNA, 403 bp, Homo sapiens
ccatatggcaaaactggagggattacaaaatctctgcagagatggagcttgcaatggctccatggtgataatgtcatttagaaccaaaggtctggagctgaggaatcaatcaggatgagggcaggcaaaaaagaacaggacatttttcccacccttggcaatatgaactgaggccaagtaggggagcagtagtgttgttgctccaccaaacaactatgactgtcctcagctgtccagtgaacagcaggcttgtcctgtctcatttgcagcatgtcttgggtgctcaaatacagactgggaggattgagttcagttcttggtatttaaaaggactcctaaaagcaataatagacaaagactttcatcctcactcccaccaactcctcccaatcagaattagaaa

SEQ ID NO: 210798 - DNA, 490 bp, Homo sapiens
aattagccgggcgtggtgacggacgcctgtaatcccagctactcaggaggctgaggcaagagtatcacttgaacccaggaggcggaggttgcagtgagccgagattgcaccattgcactccagcttgggcaacaagagcgaaactccgtctcaaaaaaaaagaaaaaagaaaatagaaaggccactaaacattaccgaaagacaaaaaccagaaatatgtgtctgggccaggtgcaagtggctcaggcctataatcccagccctttgggagggcaagaccagaagctaatcctcttgaggccaggagttgtaggctgcagtgagatatgattgcaccactgcactccagcctggacaacagagcaagaccctgcctctatatattaaaaagaaagaaaaccaaaaagaaatatgtgccttacaatggcaagacgtggcaaaaaaagagaagaaaaaaactcttcatctcaagtcatagttcaaacctcct

SEQ ID NO: 210799 - DNA, 1200 bp, Homo sapiens
  misc_feature (1)..(1): n is a, c, g, or t
  misc_feature (30)..(30): n is a, c, g, or t
  misc_feature (45)..(45): n is a, c, g, or t
ntagagtttcttacaaaatcgtcctatccngcatgcacttttggntactctttcaactcagaagtcaacataaagggtatggatgatgacgccactcacagattcaaagaaagggcaaactggcagagtgagtcattggatgttgctggcacagctataaagatccagtggcccaagttgtgtacctgaattcaagcagtgggacaaatgagggtttggcatgcagctcgtcatcttaagagttactatcttcttgccctggtgtttcgccgttccagtgccccctgctgcagaccataaaggatgggactttgttgagggctatttccatcaatttttcctgaccaagaaggagtcgccactccttacccaggagacacaaacacagctcctgcaacaattccatcggaatgggacagacctacttgacatgcagatgcatgctctgctacaccagccccactgtggggtgcctgatgggtccgacacctccatctcgccaggaagatgcaagtggaataagcacactctaacttacaggattatcaattacccacatgatatgaagccatccgcagtgaaagacagtatatataatgcagtttccatctggagcaatgtgacccctttgatattccagcaagtgcagaatggagatgcagacatcaaggtttctttctggcagtgggcccatgaagatggttggccctttgatgggccaggtggtatcttaggccatgcctttttaccaaattctggaaatcctggagttgtccattttgacaagaatgaacactggtcagcttcagacactggatataatctgttcctggttgcaactcatgagattgggcattctttgggcctgcagcactctgggaatcagagctccataatgtaccccacttactggtatcacgaccctagaaccttccagctcagtgccgatgatatccaaaggatccagcatttgtatggagaaaaatgttcatctgacataccttaatgttagcacagaggacttattcaacctgtcctttcagggagtttattggaggatcaaagaactgaaagcactagagcagccttggggactgctaggatgaagccctaaagaatgcaacctagtcaggttagctgaaccgacactcaaaacgctactgagtcacaataaagattgttttaaaaagtaaaaaaaaa

SEQ ID NO: 210800 - DNA, 329 bp, Homo sapiens
ctatctaactctactaagtgaaaagatggttttcctctttaaaactgattacttttcaggtacacgatgaatagtccttgttcaaaatggcacagagaccagaagagttttggatttcagattttttcagattttggaatatttgcatatatctatgggatatcttggggctgggacccaagtctaaacacaaaattcatttatatttcaaatacattttatacagagcctgaaggtaatgttatacaacattttaaataattttgtgcatgaaacaaaattttaactgtgaacactcatgtaaggtcaggtgtgaaatttcccatttg

SEQ ID NO: 210801 - DNA, 672 bp, Homo sapiens
cagaccaggcctgtaatgatgacgtttctttacccctccaatagagggtgcactcttgtgaatggcttttgtggctagttacttcgtgggtgctttaccatggtcagtttgcaggcaatctgttttgtacaggccatgctatagagacttatttacttattcttcagctccctctgcaggagctcagtgagctaaaggtgctagagagctgtaatggctgcaaacacccattcttttttatggctaaataatacttcactgtgtgtatataccacatttttttcatctttttatgggttgtttccacctttcttctattgtcaataatgctgctgtgaatattggcatacaagtatctgtttgaatctctgttttcaattctttttggaacagaattgtcaggtcatatggtaattctatgtttacctttttgaagaaccaccaggctgttttccagaacagctgtacccttttacatttccatcaacagtgtatagatgttgcaggggtttttttacattcttgttatttattcattttattttatttatttttattttttgagatggagtctcactctgtcgcccaggctggagtgtggagttgcagtgagccaagatcatgccactgtattctccagcctgggcaacaacagagaaagaccctgtctca

SEQ ID NO: 210802 - DNA, 257 bp, Homo sapiens
cagactggtcttgaactcctgacctcaagtgatccacccgcctggcctcccaaagtgctgggattaaaggtgtgagccaccgcgcctggccctaaaaatttttaaatctgcagaaaatttgaatgactcacctagattcatcagtttattttttgttacattcactttgtctgtatataaatgtgtgtatatacatctatacacccacacatacttgttggttttggctgaactatttgaaagtatggagaaccact

SEQ ID NO: 210803 - DNA, 451 bp, Homo sapiens
ctttattctcctggagcatacaaggtagagttgcgcttgagaagtcagtggtttccttttgggaccaagtgggaaagacacaatccttcatatgtcaaccgtcacacaaaatgggaagacattcagggtagagtaactgctctatccctggaaaattgaagttaaactatagagatgacaagaatttctttaaaagtccctgggctggatacagtggctcaagaatcactcgaggccaggagtttgagaccagcctgggaaatatatagcaagatcctgtctctaccaaagaaaacaaaataaaattagctgggcatggtagcacatgcttgtagccctagctactcaggaggctaaggtgggaagattgcttgaattgcttgagcccaggaggttgaggctgcagtgagcaatgattcaatgattgcaccactgctctccaaaaaaaaaa

SEQ ID NO: 210804 - DNA, 432 bp, Homo sapiens
tcatattctccttcttgcctcactcatcccagggaggaagccagagatgccaaaagggaagaaggccaaggggaagaaggtggctccagctgctgctgtcgcgaagaagcaggaggccaggaaagtggtgaatcccgtgttggagaaaaggcctaagaatcttggcattggacagcacacccaacccaaaagggacctcactttgctttgtcaaatggccccactttatcaggttgcagaggcaaagagcgatcctctaaacatggctgaaagtgcctcctgcaacgaaccagttcacccaggccttggacccccaaagagctactcaactgtaatacataagctggcccactagtacagaccagagacaaagcaagagaagaagcagaggctgctggcctggactgagaagaaagctgccagcaaagggga

SEQ ID NO: 210805 - DNA, 651 bp, Homo sapiens
tcatattctccttcttgcctcactcatcccagggaggaagccagagtcattctgcccaagcctttgcacctacagaaacttgtaaagaaaatcgaaaactggctttttttcacgtctgtcttgtacagaaaagacagtcccgacagagtttcactcttgtcgcccaggctggagtgcaatggcgtgatctcagctcactgcaacctccgcctctcaggttcaagagagtctcctgcctcagcctccggagtagctgggattacagatgccaaaagggaagaaggccaaggggaagaaggtggctccagctgctgctgtcgcgaagaagcaggaggccaggaaagtggtgaatcccgtgttggagaaaaggcctaagaatcttggcattggacagcacacccaacccaaaagggacctcactttgctttgtcaaatggccccactttatcaggttgcagaggcaaagagcgatcctctaaacatggctgaaagtgcctcctgcaacgaaccagttcacccaggccttggacccccaaagagctactcaactgtaatacataagctggcccactagtacagaccagagacaaagcaagagaagaagcagaggctgctggcctggactgagaagaaagctgccagcaaagggga

SEQ ID NO: 210806 - DNA, 857 bp, Homo sapiens
aaaaagaaaaagagaaaaaaaagatgtcacataccattttctggccttggagataaatgagaggagagactgtggccattgtactacagtttttccgaggggatttgcctttcctctctcacccttccaccctgtttcaatcaagagtctgtagcaaggtagacctattcatacaggctccccctctgctctgtggtaccagattgttgctagttcccaggcatctgtggaggaggattttgggcgagggccctggctgaccatgaaatccacgctaggcctggatgagagagaccctagctgcttcctctgtacctacagcattgtcatggtgctgcgcaaggtaaggattctgggtgctgagacccaaaggaaagaccatttttctccctctctctgacctactgccctactccaccttaggaaggggctgtttgctccctcgtaccctatacaagtagcagcacgaagcccctttggttgtatcttccacttacctaccttttcactgtcatccataggattgggcccaggtggaaggagagagtgggttatggtatgcctctgcacttccaggccctgggtggggtggggtgagcacactgccaccctcaaatctccctagtggttaagggttgtgtgcagagacatgccagtacatgtgccaacatatccctgcctgtgactgttatgatggaacattgtgtaaacacatataaacaaaagaaagtgctggacacagtggctcacacctgtaatcccagcattttaggaggctgaggtggaaggatcacaaaggtcaggagttcgagaccagcctgggcaacaaagcgagaccctgtctctacaaaaaaata

SEQ ID NO: 210807 - DNA, 2392 bp, Homo sapiens
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagccagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccaggcagccctgaagcagcttcctaggaacaaggtccccaacatggcggtgatgatcaagtccctgactcggagcacaatggacgccagtgtggttttcaaggaccccacgggagagatgcaggggacggtgcacaggttgctgctggagacgtgccagaatgagctgaagcctggctcagtgctgctgctgaagcagattggagtgttttctccttcacttcgaaatcactacctcaacgtgacacccaacaacctggtccatatttacagcccggattctggggatgggagcttcctcaagccatctcagcccttccccaagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccagcatgattggagagtggacacagccggggggcttctgtggttgctcccaccctgggtgttttccctgagagccccctcatctctgcgctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgcttaaaa

SEQ ID NO: 210808 - DNA, 913 bp, Homo sapiens
  misc_feature (844)..(844): n is a, c, g, or t
  misc_feature (890)..(890): n is a, c, g, or t
  misc_feature (896)..(896): n is a, c, g, or t
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcagcaagttggtggctttgangggcctgaacaagacgaatttgataaagtcctggcaagcatggaanttggangaacctggcattgggaa

SEQ ID NO: 210809 - DNA, 2726 bp, Homo sapiens
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagccagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccagcagagtgggagaagtctggaggacatcatggtttccgcgccccaaactccaacccatggtgctctggctaaattccagacagagattgttgctagttcccaggcatctgtggaggaggattttgggcgagggccctggctgaccatgaaatccacgctaggcctggatgagagagaccctagctgcttcctctgtacctacagcattgtcatggtgctgcgcaaggcagccctgaagcagcttcctaggaacaaggtccccaacatggcggtgatgatcaagtccctgactcggagcacaatggacgccagtgtggttttcaaggaccccacgggagagatgcaggggacggtgcacaggttgctgctggagacgtgccagaatgagctgaagcctggctcagtgctgctgctgaagcagattggagtgttttctccttcacttcgaaatcactacctcaacgtgacacccaacaacctggtccatatttacagcccggattctggggatgggagcttcctcaagccatctcagcccttccccaaggattcagggagcttccagcatgatgtggctgcaaagcccgaggaaggcttcagaacagcacagaacctagaggcagaggcgtcccctgaggaagaactcccagaagcagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccagcatgattggagagtggacacagccggggggcttctgtggttgctcccaccctgggtgttttccctgagagccccctcatctctgcgctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgcttaaaa

SEQ ID NO: 210810 - DNA, 2620 bp, Homo sapiens
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagccagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccagcagagtgggagaagtctggaggacatcatggtttccgcgccccaaactccaacccatggtgctctggctaaattccagacagagattgttgctagttcccaggcatctgtggaggaggattttgggcgagggccctggctgaccatgaaatccacgctaggcctggatgagagagaccctagctgcttcctctgtacctacagcattgtcatggtgctgcgcaaggcagccctgaagcagcttcctaggaacaaggtccccaacatggcggtgatgatcaagtccctgactcggagcacaatggacgccagtgtggttttcaaggaccccacgggagagatgcaggggacggtgcacaggttgctgctggagacgtgccagaatgagctgaagcctggctcagtgctgctgctgaagcagattggagtgttttctccttcacttcgaaatcactacctcaacgtgacacccaacaacctggtccatatttacagcccggattctggggatgggagcttcctcaagccatctcagcccttccccaaggattcagggagcttccagcatgatgtggctgcaaagcccgaggaaggcttcagaacagcacagaacctagaggcagaggcgtcccctgaggaagaactcccagaagcagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgcttaaaa

SEQ ID NO: 210811 - DNA, 1864 bp, Homo sapiens
  misc_feature (1504)..(1504): n is a, c, g, or t
  misc_feature (1521)..(1521): n is a, c, g, or t
  misc_feature (1536)..(1536): n is a, c, g, or t
  misc_feature (1540)..(1540): n is a, c, g, or t
  misc_feature (1597)..(1597): n is a, c, g, or t
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagccagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccagggagaagtctgaggcatcatgttcgggccccccgccggggggncgccccccccccccccnacccaaaaaaaaaanaaantccctttcttcccccccaaaaaatacccccccccccaaacttagggggggtttgggntctttcccctcggggggcttataaaaatttcccagacagagattgttgctagttcccaggcatctgtggaggaggattttgggcgagggccctggctgaccatgaaatccacgctaggcctggatgagagagaccctagctgcttcctctgctttgtctcttcagacctgtggttgctctgctcatccatgcccaaggttcccaggtgcaggacagaggtgtggcctattgtaccttgttctgaaataaagcatctcctgcttaaaa

SEQ ID NO: 210812 - DNA, 2438 bp, Homo sapiens
aacatacacgccatgtgcctgaacagtaaaagcagaggggttcttgatttccagatgccaagacctaccatctctgcttccttgtaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagccagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccagattgttgctagttcccaggcatctgtggaggaggattttgggcgagggccctggctgaccatgaaatccacgctaggcctggatgagagagaccctagctgcttcctctgtacctacagcattgtcatggtgctgcgcaaggcagccctgaagcagcttcctaggaacaaggtccccaacatggcggtgatgatcaagtccctgactcggagcacaatggacgccagtgtggttttcaaggaccccacgggagagatgcaggggacggtgcacaggttgctgctggagacgtgccagaatgagctgaagcctggctcagtgctgctgctgaagcagattggagtgttttctccttcacttcgaaatcactacctcaacgtgacacccaacaacctggtccatatttacagcccggattctggggatgggagcttcctcaagccatctcagcccttccccaaggattcagggagcttccagcatgatgtggctgcaaagcccgaggaaggcttcagaacagcacagaacctagaggcagaggcgtcccctgaggaagaactcccagaagcagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccagcatgattggagagtggacacagccggggggcttctgtggttgctcccaccctgggtgttttccctgagagccccctcatctctgcgctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgcttaaaa

SEQ ID NO: 210813 - DNA, 2585 bp, Homo sapiens
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagccagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccagcagagtgggagaagtctggaggacatcatggtttccgcgccccaaactccaacccatggtgctctggctaaattccagacagaggcagccctgaagcagcttcctaggaacaaggtccccaacatggcggtgatgatcaagtccctgactcggagcacaatggacgccagtgtggttttcaaggaccccacgggagagatgcaggggacggtgcacaggttgctgctggagacgtgccagaatgagctgaagcctggctcagtgctgctgctgaagcagattggagtgttttctccttcacttcgaaatcactacctcaacgtgacacccaacaacctggtccatatttacagcccggattctggggatgggagcttcctcaagccatctcagcccttccccaaggattcagggagcttccagcatgatgtggctgcaaagcccgaggaaggcttcagaacagcacagaacctagaggcagaggcgtcccctgaggaagaactcccagaagcagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccagcatgattggagagtggacacagccggggggcttctgtggttgctcccaccctgggtgttttccctgagagccccctcatctctgcgctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgcttaaaa

SEQ ID NO: 210814 - DNA, 2200 bp, Homo sapiens
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagccagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccagcagagtgggagaagtctggaggacatcatggtttccgcgccccaaactccaacccatggtgctctggctaaattccagacagagattgttgctagttcccaggcatctgtggaggaggattttgggcgagggccctggctgaccatgaaatccacgctaggcctggatgagagagaccctagctgcttcctctgtacctacagcattgtcatggtgctgcgcaaggtaaggattctgggtgctgagacccaaaggaaagaccatttttctccctctctctgacctactgccctactccaccttaggaaggggctgtttgctccctcgtaccctatacaagtagcagcacgaagcccctttggttgtatcttccacttacctaccttttcactgtcatccataggattgggcccaggtggaaggagagagtgggttatggtatgcctctgcacttccaggccctgggtggggtggggtgagcacactgccaccctcaaatctccctagtggttaagggttgtgtgcagagacatgccagtacatgtgccaacatatccctgcctgtgactgttatgatggaacattgtgtaaacacatataaacaaaagaaagtgctggacacagtggctcacacctgtaatcccagcattttaggaggctgaggtggaaggatcacaaaggtcaggagttcgagaccagcctgggcaacaaagcgagaccctgtctctacaaaaaaata

SEQ ID NO: 210815 - DNA, 1263 bp, Homo sapiens
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagccagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgcttaaaa

SEQ ID NO: 210816 - DNA, 342 bp, Homo sapiens
aagagctggagagatgctgggggcaatctctgcatgatgactgcatgctggttatatccaacaaggctgcattgcaagggaggagtgattcaaaaggacccagcaccagctaatgactgttaccgaaatgagttcctgaaaccatggggaaatgaaatcaacagtccaccaagtccagaaacccggcccaaagggctagatctgttccttacttgctccgaagccatagcagctgccttttctgtaaaatggggacaatttctcagggttgttccatggattatataggacagcatttatgaaagaaagacatcgtaaattatataataatactcaactgca

SEQ ID NO: 210817 - DNA, 709 bp, Homo sapiens
ggcgggtggatcacgtgaggtcaggagttcaggaccagcctggccaaaatggtgaaaccccatctctactaaaaatacaaaaattagccatgcaccactgtgaccaatttgattttctatcgtcagctatttgtgtactttaattggaagactgagtaaagaatggttattttataagggaaatgcacattttgtttttattgaatagtactctgtagccatgtattgattgaaaataaggaaacccccattgagtgatgtcaactgggtactttctacaagtatatctggctttatttagggactaaaccggtagaaataattgggggaatttcctttcctaaatttgacaggtaaatttgcttttcatactttctgttttagttgcttatatttaaactattttgagaaggagaaggatcaattaaaatgtattttatttagtgctaattgaatagtaccatatttaaacttataccaatttccaaagtacttgatgtaactatatataattagtattgaatttcggacccggattgcatccggtacttagggtagtttctcggtaacagggtttaaaaccttagaagaacccttacaagtaacagggctccaaaaagcggacggacaaaggccattagggcacggggccaaaaccggggaatccacaattcggcccagggcacccaagataacgacatggcacccc

SEQ ID NO: 210818 - DNA, 493 bp, Homo sapiens
tgaaatatcaaataaatatctcaaatatcaatatcaaatatatttatcaaaaaatatctatacatacacacacgctaagtacatatttggttgatcctgaaatactgttgtctaacaaaatacaactttaatatacgtacatacaaaagagtaaaaaatatccctttaaatgacttcttaatttgatcaaggcatattagaaaagaaactgggccaggcgcagtggctcatgcctgtaatctcagcactttgggaggccaaggcaggtggatcacctgaggtcaggagttcgagagcagcctgaccaacatgccaaaaccccatctctactaaaaagacaaaaattagctgggcatggcagcaggcacctgtaatcccagctatgcaggaggctgaggcaagagaattgcttgaaccagggtggcggaggctgctgtgagccgagatcgtgccattgcactccagcctgggcgacagagcaagactccgtctc

SEQ ID NO: 210819 - DNA, 323 bp, Homo sapiens
ggattacaggcgtgagccaccgtgctgggctgacttttatttttagatattatttgaatttcatgacaaattatgtaatttccatgattgtcaataaaaaaaagaaaaaagaaaacactggtgattttccgtaactaagtggattcaatgaaactaaacttctatttagtgtgtccttgctaatattttcctttaaaaagtcacagtgctacaaaactgtcaccagctgctgcttattaggaatgtggttagcagatgtgggttttcatagtcatgctgtatgagatcgttagtccatttttgcgggtttcagatggttagtg

SEQ ID NO: 210820 - DNA, 288 bp, Homo sapiens
tcctcagtggcatatgtgcccattcatgttaaaataaatgaaaaaattcataacctcctcacaagagccatgctagaagttcccagttgccaaaagtctactcttaagagagcatctccattctcccagaatcacctgggaagcagctgctgtgagtctggcccaggttctgttctctgcacccacctaactcagtgcatttgcatcaaggctggaatctcaggttctcagatttatagatatagatgaattaatataagaatgtgatgattatgtgtatggtgtgtg

SEQ ID NO: 210821 - DNA, 227 bp, Homo sapiens
cacctgtaattctattaattaatattttcctgcccttctttctggtgtttttttcagtgtattcttgtttttgtagatgaggtcattcttaacatatacttttcgattctccttttttcatttaaccgtaggcgttcccatgttgttcctgactctttacaagcaccttttggaatgtgtgggcatcaggcttctcttagctgttgctctagtgttggatgttcgag

SEQ ID NO: 210822 - DNA, 738 bp, Homo sapiens
  misc_feature (15)..(15): n is a, c, g, or t
  misc_feature (22)..(22): n is a, c, g, or t
  misc_feature (64)..(64): n is a, c, g, or t
  misc_feature (82)..(82): n is a, c, g, or t
  misc_feature (92)..(92): n is a, c, g, or t
  misc_feature (98)..(98): n is a, c, g, or t
  misc_feature (191)..(191): n is a, c, g, or t
  misc_feature (195)..(195): n is a, c, g, or t
gttcggaggatcccntcttcgnccatcagatctttcttaccactctgactctgaagtcattatnggctccattacttggaangtatcacttnggtttntcaggtataaagtcccgcctcctcgaatagatcacaggttccgggtcttcttactctcttctctgtatcctagatagcacctagcatgtgccntggnatacaacagtctgatgggagcaagacgcggtcttctccagtcatcatgtagtacccccactcccaactcacaccctgtttgagtttcctcatcagtacccatgaaatgcttattctcacctgtggcatttgacccatgaactcttctgataatctatcccagacccttcgtgtgtaaatcaaagtgtaatattcatcacatatttatatagtctctcatgcttttcaaagcgctttatgtcactggagccccctaataattctttactgaaggtagttagggtgttaaacctttatctaatattattctaggccagcctgactttgtctacatttctctaagacctatagtcagtaccatttaccttaatgcgattatgtgttttatagtgctttgattttgattgtcttatacttatttgtctgactgtcccagactaagctggaagacccagatcaatcttccaaatattaagggagaattaccttgctacactgagacaggcactgtggaggagagctagtgatacggtttggatctgtg

SEQ ID NO: 210823 - DNA, 419 bp, Homo sapiens
tttttctttctccctttcaacccaggctcttctatcatccaagattccataaacatcacacccatgatgatgcagtggttaccccagggaggtgagcaaagattcaagtaagacagggattcatcagctggtcccgttctaggtgtgagaaaacaaatgtgaaatgaaatccagccactgtcagcgtgctttcacacagtcctgaactctaacacgcagtatgctgggatgcagacaggcttcttgggtaacaagatgctttctccctcttttggtttccagatcaaaaatggtttctggccgggtgtggtcgctcatgcctgtaatcccagcactttgggaggccgaggtgagtggatcacttgaggccaggagtttgagaccagcctgggcaacatagcaaaacactgtctctagta

SEQ ID NO: 210824 - DNA, 348 bp, Homo sapiens
ctaatttttgtatttttagtagagacggggtttcaccatgttagccaggatggtcttgatctcttgacctcgtgatccgctggtctcagcctcccgaagtgctgggattataggcgtgagccactgcgcccggccaaaacttttttttttttaatacacatttcacataccgtaagagtcacctcaagggaggtttttgacaatagttgacttatatgtaacaaattaagaagaataattccttagagtaacatttaggaggaataaggaccctacaaatatgtaaacctcctatttatccttaaactctgattttggtttgtacatccttttgagaatcttaaaaaa

SEQ ID NO: 210825 - DNA, 574 bp, Homo sapiens
cttgtccagttttatctttggaatcacttatttgacacttacactccttctgtcttgaactggtaattacatgatccatttgtgcttatcttcccaacacggctgttagagggcagtggcttcatgctattaacaaatcacctccatcagcattgagcatagtactatggcatagcacaaatgcagtgggggtgtctaattcttctgaaaatgtgacagctcttcgacctgacagcccttctgccctgactggtcacatgtgagggaatgtgtgtactgtctggtgactgctaaatgtggcccaggcattcacttacccagtgcacaagacccagcagcatcaccagcaagcttgtggagtaaatcagatgaacagtgtgtgagaattggaaaacgtgtcccaaagaataagcacaacagaatggcgtaccttctttcaacccagttcagtttaacacaagagacttcacacggttaattccatgtggaaaggacattttcttgctggaaacaaattttaatctttgtgagtctggaattcactaggaagaacacaagatatgataccaagaat

SEQ ID NO: 210826 - DNA, 465 bp, Homo sapiens
catatctcacatgctggcagagaagagagaatgagaatcaagtgaaaggggtttctcctcataaaaccatcagatctcatgagatttattcactaccaagagaacagtatgggggaaatcgcccccatgattcaattatctcccaccgagtccctcccacaacatgtgggaattatgggagctacaattcaagatgagattcgggtagggacgcagccaaactgtatcagtatccgccaaagaatacaaactattttgctaccgccaaaaggccccagcctcctctgcctgctgaaagctttcttctctaccttccttgtcaattaattgtcactcctagttggcatcattatgtcaactcctggctattcctcctcatccagaaaaaaattttttaaaagctgtttctaattagctatagactgggaaacttgataaaccaatatgttatgattgtgactaaac

SEQ ID NO: 210827 - DNA, 419 bp, Homo sapiens
aattaaaattagaacatcaggaaaagaattaaaatcctcaggttgcaaaaccaaaatgttaaccaaaacaaatactcatgagattcaactttgttcacctatagaatagtacttattaacaacataaaatctaccctgtgagattgtatggaaactcagagtgtggcttatgataaccatctgtttatgatatttcatataaaacaatcttgtgatccttgtagttcctaccattaattttgtaggaaggaatctctgacattcctatggagctagaaccacatctgtcaatgtttaagtacctaagcagaacttaagaggaaaatgcataaatatatttggaaattgtttcatttttttctatatgtaagaagaccctaaaaagagcctttcagtaaagtttgtgcttcagaactaca

SEQ ID NO: 210828 - DNA, 709 bp, Homo sapiens
cgcatcttgctcccatcagctaattgtcattaggtgatgggagcaagatgcgtgctcccatcagtagtgccctgcgggaccttttgaaaatctccccagtaaagacattcttgctttcatacaacctggctgctggagcacctggctgaattttatcttattgttcacctttgagttcgtggcaaatacttagcagtatttaatttttgctttctgatttaagtgtaatacgaaaaaaaatcatgcaaatcaattaccagtatctggtgtttgaaattgtaagatgctgaaaagaactgttaattatactctgtatctgccgggggaatgtaaactgactttaggattcgaagagaccttgctgatgggagaagatgccatcttctccacccccttttccctttttaccaggtaaggggttctcttatgttgaaaatcaactgaaggaaagatgaaggtgcctagaaaatttcgatacgccctaaagccaatgtcactagcctggagatcttggaggtgacttgaccattgtggagccgctcccctcaccccttcagaaggtctctagagaactaagtagtacagggctcccggtttcctaaccacaagctccagaatctagagaagggcttccttagacagtaggaagtatcgttctccctcagagatgggacaacaggggagtctgggacagaccttgggtggatag

SEQ ID NO: 210829 - DNA, 776 bp, Homo sapiens
aagaatcgggtggatctctgctgtggtgtctgcttttaatgggtttagaagaaaaagtcatcctccacaatttcagcaagaaagatgagttttctgatgggagcaagatggccatcttcggctcccatcagtagtgccctgcgggaccttttgaaaatctccccagtaaagacattcttgctttcatacaacctggctgctggagcacctggctgaattttatcttattgttcacctttgagttcgtggcaaatacttagcagtatttaatttttgctttctgatttaagtgtaatacgaaaaaaaatcatgcaaatcaattaccagtatctggtgtttgaaattgtaagatgctgaaaagaactgttaattatactctgtatctgccgggggaatgtaaactgactttaggattcgaagagaccttgctgatgggagaagatgccatcttctccacccccttttccctttttaccaggtaaggggttctcttatgttgaaaatcaactgaaggaaagatgaaggtgcctagaaaatttcgatacgccctaaagccaatgtcactagcctggagatcttggaggtgacttgaccattgtggagccgctcccctcaccccttcagaaggtctctagagaactaagtagtacagggctcccggtttcctaaccacaagctccagaatctagagaagggcttccttagacagtaggaagtatcgttctccctcagagatgggacaacaggggagtctgggacagaccttgggtggatag

SEQ ID NO: 210830 - DNA, 458 bp, Homo sapiens
ctttctattccgccatcctgctctgttgcacctctcgagctcagtcctttcaaccggaaacactagagaaaccctaaaccctaggccctaagtccataacgcaggtggtatggaggtattcccatttcagtgaaactgtgtaaacacttagaaggtcagccttggatttggtagcagtatgtgaaatgctcagagataaaactgatcagagtggggaggtgatgttacttctctgcctggctccacattggagaaaggaacatggggttaagggaggaggaaggaagacagcgttgaggctcattctgtcatccaggtgaggtttaatggatgattgttggccaaggagatgtcgctagaattgtgatttacatttggtaaaggagcagctagattttctaatgcggtcggtaaggacatgcaagagggtttcaggtatgacgctgggggttttttgt

SEQ ID NO: 210831 - DNA, 791 bp, Homo sapiens
catcttaagaaaaaaaatagcctggaacatttccccaggctttcagtcttctttataaatagtgtatctcttctatctctggattattcattatgtgatgccgtttggaatctgaatcctgggctcagatggctgatgtggttccttctgattttgtcattcagaattgtctctatcctcctaaagaaggtgaaagagacatgctgtttgtcattgggggcacagtaataggtgcaggctgtagtctgttttacagaattacatgcatgttgcttgaccttggtctgggaccccactgaccaaaacactgaactcagccttctggatcatgaagcctggtttttgcaattttgatttgaacaacagtgttttgaccaggtttgacaatcaactgatgtgtttggaaaagactgactgatgagccagaatactaaccacccatttacaaggaaagaggcacagacatttagggaagatcaagagctttgcagtcaaatctggcactcctgcttagtagtttgtgactttagatgagcttaactttatggaacttttatttcttcatctttaaaatgaagataattatgaagtgatttgcctgaggtcagtagtcactctgcatcatttcagcttagtttacagttttcaaaatctccatccaaacctctttctcaagagcatgcttattttcttggttaaatccatgtttcttctgtttatttaaaaatgctcaagaaccgatatttagctcaagagcttctcctttcagctgttagattctgttagaggca

SEQ ID NO: 210832 - DNA, 408 bp, Homo sapiens
aagtgatctgcccgccatggcctcccaaagtcctgggattataggcatgatgtttttttctattcaagtctttaggtctgtatttattgagttacttggtacatgccaggcacagctttcaggtagctctacgtacattatgtcactttatcctaataacacctatgaattatcctcacttgacagatgagggaattgaggtacacagaggtcaagcaatttgcccaaagttgcacagctaataagtggtggtgctgggaactgaatcaaccagtctagctccagaatctatgctataccttgtaactaactggctatggggtaaaatagggtggaaaatattctggttttaatcctgggttactaagagcttggttaggtcattaatagaaattttgaagtcagacg

SEQ ID NO: 210833 - DNA, 352 bp, Homo sapiens
taataatcattcaccccatggggaaagctatacttaatcttaagtcacttaggagttccagttgtgggtaggatggatcagggacactcttccctccaccactgaacagagctataaaacctagacagaatgcatgacgcagctatttgaaaactctacaaggaaaaaatagcaggtggattcagagagaagtaacactgaacagtggtgagtttactaatgtttctccctctggtcctcctcccaattgtaaccagatgcagaagcagtcaacaaggtgggcagcagaatgggcgccagctttctggtcaggcaacgaaacaggagaactccaggagagcagacagtgagt

SEQ ID NO: 210834 - DNA, 421 bp, Homo sapiens
gcatattggtgcaactgctgcagagagcagtttatcagtatctatgaaaattgcagtgtatttaccccatgactcaacaattacacttttaggaatgtgccctaccaatatgctcaaagttgtacaaagttgctcattgtagcattgactgattataatggcaagggagaaacaaacgtttatcagtaggttactggttaaataaattgtagttcctccataatttagaataacatccaactgaaaaatcagtgaaaatatgtaaagatctctaaaataactttagatgatgaacagaagattcagaaaaaatatgtttagcatgctagcattttgtaaaagggatgaaaataatatatctattggttatacacaaacattttataggaatctaagcaagaacttacgaataatacttacc

SEQ ID NO: 210835 - DNA, 799 bp, Homo sapiens
  misc_feature (26)..(26): n is a, c, g, or t
  misc_feature (35)..(35): n is a, c, g, or t
  misc_feature (38)..(38): n is a, c, g, or t
tcatacgccgctcttgaggatccacngacttgctnccngcacttactttagttctgcctcactggagtcaacaatttttcacttgcccttggtgatggcacattgggatttttttatagattataaaaagatttttataaatgtctcaaattgagttttctgctcaatatttttgtgcaacttctccatgttgaagagttattcactcattttcaccaatatattccactattcatttattcatactttggtcattgaattttaggttgtttccagttttcactattatgaataatgttgctataaacatctctgtacatgtctgttggtactctagtcaatacctagaagtggaatttctaaatcatacggtacaattatgtttcattttacctgataatgccaaattgttttccagaaagatgccagtttacttgccagtagtgtatatgagtttctgtagtgccatatcttcaccaatatttgggactgttagacttcttagattttgccaatctagtaggtctaatatagtattgatttatattttcctaatgaataatatggttgaaattttcatatgtttattagccattaggtatttttgctttattgtcatttaagcattttgtatcagatttctgttgtctttttacttgttgatctgtaagaactaattattcatatattctggctactaatctctacattttgcaaacattttctactcaatcgtgtcaattttctttctttcctttttttgttttttgagacagcatcttgttttgtcacccaggct

SEQ ID NO: 210836 - DNA, 404 bp, Homo sapiens
gaaagctgttttgtgggggaaactcagactgaccaaaagagccgaggaggtcctttgtggcctgtctgctccatgggaatagctccaggagagggaagaccagctgccttcatcaggaactcacaggtggcatttctatggggaatcagcacaagggaaaaggagacatttcatttccaagttatggtggcatcgcaattacaccattattgcatggactgaagtgcaagtggaggacaaggggttgggagaggaagtggctttggcaaattgtccttaagctggtaagaagcagatctccaagactttctactgggatatggagttttggggcaaaaaggagagtggagatcaacactaatatttatttattcatttttaaataatacactttcagatagaag

SEQ ID NO: 210837 - DNA, 468 bp, Homo sapiens
ataggaatggaatggagtgttctggaaagaggcaagatttgtgctgaaatcctggggtcatggtcttagaaagtcttagaaagctaagtgggttatatggctgggggcagatccctgaacctccctgggctatggattctttctacaaagtgctgatgtccctccctcctggttgtggtcatagaaattacatggaagcgtgcactgctgtgctcaggtcatgatcaagaacacaggtgctggtgactttcatgatctgttgatgtggatccagtggctcttctggtaggagggtcatcaccctgctggaagattacagcactgtaaccagagttcacagttcttttgttcactcgtgtacataaacgtaggtgctcctcaatttaaaatgggattatgtgccagtaagcctgtccacaactgaaaatatcataagttgaaaatgcatttaatacatctaacctagca

SEQ ID NO: 210838 - DNA, 427 bp, Homo sapiens
tggacccaaaccaagaagaaatccctgatttacctgaaaaagaattcaggagtttagttattaatctaatcagggaggcacaagagaaaggcaaagcccaatgtaaggaaataaaaaaaaagatacaagaagtgaagggagaaatattcaaagaaatagatagcagaaataaaaaccaatcatgccaggtgtggtgtctcgtgcctgtagtcctagaaccttgggaggctgagatgagcagatcacttgaggtcaggggtttgagaccagcctgaccaatgtggtaaaaccccatctctactaaaaatacaaaaatcagccagatgtggtggcacgtgtctataatccccactattccagaggctgaggcaagagaatcatctcaaaaaacaaagaaacaaagaaaccccgacaaatcccccccacc

SEQ ID NO: 210839 - DNA, 783 bp, Homo sapiens
attattatatccattttagagataaagaaattggagctcagaaaggttaagtaacctgcccaatgtcacacagctgctaagtggagccatgattgcaaatccagtcagttggtatccagagcccatgcttttaatcactttgctcttgtttctctcaacataaataccacttctccagaactctccagtccacatcccccctgactgtggcaaaccagggcgagaacagaaatcagtatttgcttacttttatgtcatagtctaaacctacatatacattccaatatctaacttgcttttcatggttttttttcccttctataaataaagaagggaaaaactggcctgtgtaaaacaaagtgaataagagaaagaagaaaagaaaaattgttggtaattctatcaatcagacataaccactggtaatatataggtatatagacatctagccatcatacatgtttctccaaatgcattatacttgaactttaaatgtaatagtctatcttggagagttttccagatcactagattttcttagcagcatcatttttaatgtccctccactatgacattttatttgtgtaagataatgtatgtattcatatattgttggactttggcgctgtgcaccatttttgttattcaaaatagctctgggatcataattgtgtaggtaaatctttatatccatccatgattatttcctgagaaaaaattcctagaatttgacacactaggtcaaagggcaaattatgtttacttaagaaattaaattaaaac

SEQ ID NO: 210840 - DNA, 926 bp, Homo sapiens
gtattttctaactcattttcaattctgtgactcttgtgatttcttccttgtgaaagagccaaactgttgggaaacggaatctcatacatacagtcttttaactcctactcagttgtttgagagtgggccttgggcctggaacacttcttttgaagagactaggagtccacagagcctgtgctgaacttaccaccccgtatagtaatatcttcctctgtttcagagtcaatgtgtagtcctttgccctgcttaagtgtgtgcatcatatggcatctgaccaaccccactgctctgtctcctgtgggggaggggatgggggtccttcagcacaagaggagtgtttgcaggccacctgccctgtgtcagctgccaagagggaccctctggtcatgggagactgaagtccactagggaagctgatcttgctctgtctcttctgtatgtgagtaatgtgtgttccacccagtgtttcactgcattgttttccttggcgactttgaaacaagatgcagtggacagaagtgctcagacttctgctcctgacaaataggcaacagatgccacttgctccacacaaacactttctgataaccaagttgtctttggagcaagaaagactcatagaaaattaactatagtgacactacctggttcatttttagcacaactgaaatgaaaactgaaggttttaattttgtcttgtcaacacaagaggttttatttgattgaaactagaattgtatgtgctcatgagcattctcaagtgttttcacagtgtctttgatttctaattatgtaacatttcttctagaccagggaaaaacttgcctattaaatgtgcttcatatgtgaaaatgttagccttcaaatggttaaaagtatacatgaacaagttccaaaagttctgaataaaagtctccttccta

SEQ ID NO: 210841 - DNA, 200 bp, Homo sapiens
aagtattgatatcagggatttcaatggatatgtgtatatcagtgttcacagcagcattattcacaatatctaaaagctagaaaccacccacatgtccatatgtggaagtatggataaataaaatgtggtagatacaggatgccttgttttattgtgctttgctgtattgtacttcacagatatttcattttttaccaatt

SEQ ID NO: 210842 - DNA, 2797 bp, Homo sapiens
gaagccctggcaggtcagtggcaggcactgtcacgctgagtcctatgctggcagcggggaaccttggggagaacacgggacaccgcggaagccgggaaatgattgtgcggctgtaaccggcacaggttcgcggtccgagtcactgcaccgagactccaaggcctgcagcagaaacagtttaatagggggagaggagagaagaccccagttccgcctccatgagaggtttggggatgggggtgtttaggggtctggacaggggcggctgaagtgtggggtcgctggttggtggggaagtgacaggcgaatcctgggacgggaggtgaagaaaccgcattctcctgctgagtgggttccctcgtggggttttcaccctgcttggcgccagcctttccgttggaattcaagatctgagaaagaacttgggcaactcgagcagctctccgagatcttatccccaggcacaatgcagaagccggcggtcagtgtcttctgtgacctgactctcaggaaggcggcccccgcgaggcagtggggctcaggtttccattccttggggacacacggctggtcagccagttgaatgattgtatttgggggagaagacagaagtgatctcttccttcctgactctcagactaatgaagagagaaaacaatatgattcagtagcctttgaggatgtggcggtgaacttcacccaggaagagtgggctttgctgggtccatcacagaagagtctgtacagagatgtgatgtgggaaaccattaggaacctggactgtataggaatgaaatgggaagacacaaacattgaagatcagcacagaaatcccaggaggagcctaagatgtcatatcatagagagatttagtgaaagtcgccagccagatagtactgtgaatgaaaaacctcctggagtagatccatgtaaaagcagtgtgtgtggagaaatcatgggttgttcattccttaattgctatatcacatttgatgctggacacaaaccagatgagtgtcaggaatatggagagaagccacatacacataaacaatgtgggacagccttcaattatcaccactcctttcaaacacaggaaagacctcacactggaaagaaacgctatgattgtaaggaatgtgggaaaaccttcagttcttcgggaaaccttcgaagacacataatagtacaacgtggaggtggaccttatatatgtaagttgtgtgggaaagcctttttttggcctagtttatttcgtatgcatgaaagaactcacactggagagaaaccgtatgaatgtaagcagtgttgtaaagccttccctatttacagttcctatctaagacatgaaagaacacacactggggagaaaccatatgaatgcaagcactgttccaaagccttccctgattacagttcctatgtaagacatgaaagaactcacactggggaaaaaccctataaatgtaaacgatgtggaagagccttcagtgtttccagttcccttcgaatacatgaaagaactcacactggagagaaaccctatgaatgcaagcaatgcgggaaagcatttcatcatctgggaagctttcaaagacacatgataaggcacactggagatggacctcataaatgtaagatatgtgggaaaggctttgattgtcctagttcactgcaaagtcatgaaagaactcacactggagagaaaccctatgaatgcaagcagtgtgggaaagcgttatctcatcactcaagctttcgaagtcatatgataatgcacactggagatggacctcacaaatgcaaggtatgtgggaaagccttcatttatcccagtgtatttcaaggacatgaaaggactcatactggtgagaaaccctatgaatgtaaagaatgtggtaaagccttccgtatttctagttcccttcgaagacatgaaacaactcacactggagagaaaccctataaatgtaaatgtgggaaagcctttattgatttctattcctttcaaaatcatgaaacaactcacactggagagaagccatatgagtgtaaggaatgtgggaaagcattcagttgtttcacatacctttctcaacatagaaggactcacatggctgaaaaaccttatgaatgtaaaacatgtaagaaagccttcagtcattttggtaacttaaaagtccatgaaaggattcacactggagagaagccatatgaatgtaaggaatgcaggaaagcattctcttggctcacttgccttctgcgacatgaaagaattcacactggaaagaaatcttatgaatgtcaacaatgtggtaaagccttcactcgttctcgtttccttcgaggacatgaaaaaactcacactggagagaagatgcatgaatgtaaggaatgtgggaaggcactgagttctctcagttccttgcatagacataaaaggactcactggagagatactctataaatgtggaaaagcattcattaattttatttcatttcagaaacgtgaaagaaatcacataggagataagcctcatgaatgcaaacacatggtaaagccttaagatgtttcttttgaatatggttatcccctaaccatatgcaggggattggttccagaccccctaagcatacctaaatccacagatgctgtgttccttttataaaaggacatttgcatgtaacctatccacatcctcctgcatcccataaatcatgcctagattacttaatttttcaccaacccaaagcttttgtaaaagtaaaaataaaaagtaggttactaaaatacctc

SEQ ID NO: 210843 - DNA, 2183 bp, Homo sapiens
gaagccctggcaggtcagtggcaggcactgtcacgctgagtcctatgctggcagcggggaaccttggggagaacacgggacaccgcggaagccgggaaatggattcagtagcctttgaggatgtggcggtgaacttcacccaggaagagtgggctttgctgggtccatcacagaagagtctgtacagagatgtgatgtgggaaaccattaggaacctggactgtataggaatgaaatgggaagacacaaacattgaagatcagcacagaaatcccaggaggagcctaagatgtcatatcatagagagatttagtgaaagtcgccagccagatagtactgtgaatgaaaaacctcctggagtagatccatgtaaatttgatgctggacacaaaccagatgagtgtcaggaatatggagagaagccacatacacataaacaatgtgggacagccttcaattatcaccactcctttcaaacacaggaaagacctcacactggaaagaaacgctatgattgtaaggaatgtgggaaaaccttcagttcttcgggaaaccttcgaagacacataatagtacaacgtggaggtggaccttatatatgtaagttgtgtgggaaagcctttttttggcctagtttatttcgtatgcatgaaagaactcacactggagagaaaccgtatgaatgtaagcagtgttgtaaagccttccctatttacagttcctatctaagacatgaaagaacacacactggggagaaaccatatgaatgcaagcactgttccaaagccttccctgattacagttcctatgtaagacatgaaagaactcacactggggaaaaaccctataaatgtaaacgatgtggaagagccttcagtgtttccagttcccttcgaatacatgaaagaactcacactggagagaaaccctatgaatgcaagcaatgcgggaaagcatttcatcatctgggaagctttcaaagacacatgataaggcacactggagatggacctcataaatgtaagatatgtgggaaaggctttgattgtcctagttcactgcaaagtcatgaaagaactcacactggagagaaaccctatgaatgcaagcagtgtgggaaagcgttatctcatcactcaagctttcgaagtcatatgataatgcacactggagatggacctcacaaatgcaaggtatgtgggaaagccttcatttatcccagtgtatttcaaggacatgaaaggactcatactggtgagaaaccctatgaatgtaaagaatgtggtaaagccttccgtatttctagttcccttcgaagacatgaaacaactcacactggagagaaaccctataaatgtaaatgtgggaaagcctttattgatttctattcctttcaaaatcatgaaacaactcacactggagagaagccatatgagtgtaaggaatgtgggaaagcattcagttgtttcacatacctttctcaacatagaaggactcacatggctgaaaaaccttatgaatgtaaaacatgtaagaaagccttcagtcattttggtaacttaaaagtccatgaaaggattcacactggagagaagccatatgaatgtaaggaatgcaggaaagcattctcttggctcacttgccttctgcgacatgaaagaattcacactggaaagaaatcttatgaatgtcaacaatgtggtaaagccttcactcgttctcgtttccttcgaggacatgaaaaaactcacactggagagaagatgcatgaatgtaaggaatgtgggaaggcactgagttctctcagttccttgcatagacataaaaggactcactggagagatactctataaatgtggaaaagcattcattaattttatttcatttcagaaacgtgaaagaaatcacataggagataagcctcatgaatgcaaacacatggtaaagccttaagatgtttcttttgaatatggttatcccctaaccatatgcaggggattggttccagaccccctaagcatacctaaatccacagatgctgtgttccttttataaaaggacatttgcatgtaacctatccacatcctcctgcatcccataaatcatgcctagattacttaatttttcaccaacccaaagcttttgtaaaagtaaaaataaaaagtaggttactaaaatacctc

SEQ ID NO: 210844 - DNA, 372 bp, Homo sapiens
aagcacttaatatacagccaacctgttaaaaaccatactttgagaggtaaaatgattactttttgatagcactttaatagtagaaatagaatatacaaacagggaagtagacactcaattgcagtactttgacatttgagtttcaaggagagaggctgcctgtgagagtgactttgtgatagtttgtctactttgttcgcttctcaggacctctttgccccaagaaagtaaagcaaaattttgctatagccctattagtgagggaacaaaacttctcttcctccttcttcctttgtctgcttctgccatttgtaacacttagttcagcttgcagttggcttgcactgtaataaaactgtaaatgtcaccatg

SEQ ID NO: 210845 - DNA, 602 bp, Homo sapiens
  misc_feature (410)..(410): n is a, c, g, or t
  misc_feature (511)..(511): n is a, c, g, or t
  misc_feature (515)..(515): n is a, c, g, or t
  misc_feature (546)..(546): n is a, c, g, or t
ctaatttcaaggtttcccaacagaaaaataattacgatagataagtatttcacttcaacagccttggatacatttctaagaccacagtggaagtgtggagtaggcagacaaatagcttgaagtattatcttacatattgctgctcacacaattaaaaagttaatttttttgtgtgttcttccctgaagatacctgataatacaaaaatatctttgtacaagggtattaactgctgcattatttgtaactacaaatattggaaacaacctaaatgcccacatataggagatgggttgaattcactgtcgcacatccacagatggagtactagaagctgttttaaaaaagagaataaggaaaattcctacaaacatggagtgacatccaggatatacagctaaatgaaaaanaaaaaaaggccaaaagaatgtatctagtttgctatcttttgtgagggaaaaaaagaaaatacccacctgcttttctttacaaaaagaaacacggaagatcnatcngaaattaatcgaaattggttgtctacagggnggttgggtcaggagtgagccggagcatctgggacggggatccctcttgagtcgacc

SEQ ID NO: 210846 - DNA, 366 bp, Homo sapiens
caggcatatgatttcttttggaaatgctgagaagacagtagttgcctgtttgatgaggacagactggttgaatttgaccacttttcctatgctacctttctgtacaaacatggattgcttttccatatcagaactctgccattcatctccagttaggaaaaaaaaaaaagcctgctggagagtgtaatatttcataagatgtttgaaaacttgagcccagtttcagtggcatgttaacataagttgggttttttgtttgtttatattagattttgatatgcttctgtgctcaagtgatttaagtatgtgatttcttttttttgcaaactttgaattaatgagaaaaggattcatgaggctagttgt

SEQ ID NO: 210847 - DNA, 255 bp, Homo sapiens
aatgataaatgactgacagatttctagattctttattgcctctgtatctcaattttctgtggtctattttaaaatgtagatgaataagctatcaagggataaaatggagtgccatgatttcagttttaatttcccactctgccactaactcactctttaatcttgggcaaaaatctctctggacctcagttttttaatctaataaatgggtatcttatgatttgttatattctttttgtctagggtattgacaac

SEQ ID NO: 210848 - DNA, 501 bp, Homo sapiens
atacctaggaatccagcttacaagggatgtgaaggacctcttcaaagagaactacaatccactgctcaaggaaataaaagaggacacaaacaaatggcaaaacattccatgctcatggataggaagaatcaatatcatgaaaatggccatactgcccaaagtaatccattttataataaccataatataataaaaacattcagatgtatattctcttatttagtagtcatctaattaagatttcttaaatatctgcccatgaatatgtaaggccttttactaggcagtagagatacatctgaataagaagtaatccctgttctgaagaagtttacatctttctaattttccgtttcaaactgcagaagacttaggaaaatgctacattacataaatttagtgttctccatagttttagatttttgtttttggtacagtacagctttgattctgactttccatattttagctcttcgtttttaaataaacagccagatgata

SEQ ID NO: 210849 - DNA, 331 bp, Homo sapiens
gggttctcttttctccactcccaacaagacttacttatctttcgtctttttggtaaaagccatcctgacaggtatgagatgatgtctcattgcggttttaacttgcattttcctaatcatcagtgatattgggcattttttcatatacctgttagccatttgtatgtcttctttcgagaaatgtctattcagatttcttaccatgttttaattgggttttttgttttcttgctgttgagttgtttgagctcctggatttgttcttagtgagtactaatataggctcctaatgaacaatacattattttctctcttgttgggagcttttttg

SEQ ID NO: 210850 - DNA, 291 bp, Homo sapiens
gacctgtcagtccattcaggctgctataacaaaataccatagactgtgaggcttacaaagaatcgacatctatttctcacagttctggagcctgggaagtctaaggttgaagtgacgtcagattcgatgtctggtgaggacccgtttcctcattcatatataactccttctctgctgtgtcctcaaatggcggaagtagtgaggggtctctatggggtctcttttataaggtcactgatctcattcacgagggctttgcccccatgacctaaccatctcccaaaggtccta

SEQ ID NO: 210851 - DNA, 288 bp, Homo sapiens
tcactttactcccatcatgcgtacagcctattcagagcatttggtagtcatcatttaccattgtaagttgctgttaggtttttccaactggcatgacatgctctcaaagtgtacggactgtatgtaacatgtgtttatatttcccatttttatgtaatctcgaataagtttttgctgtttgataagaaaagtgacctgactacattcagaccagctcccaagaatttaaaaagaactcctgacttttcaaaactacaaagcagtaaacaaactgaatttacactggaa

SEQ ID NO: 210852 - DNA, 433 bp, Homo sapiens
cagaacaggaattcaagcccacaaagctctttattgcttccccaatgacattgactttatccactctaattagtggacttaaaaacagcaaataagtgaaatacttaacaatatgagtcacgttttatatttcatttgcattgtccctcaaagcactattagtggagaagcatgatcacaaaattcctgacactcttaacaaatttatcaacttgcgagctagaaaatgtttctaaaaaatgaatgtaccaactaattagataattatataaaatactttgaagtcctaagtcacgcctgtaatccagcactttgagaggctgaggcaggcagatcacttgaggccatgagttcaagaccagcctggccaacatggcaaaaccctgtctctatactcaggaggctaaggcagaagaatcgcttgaaccgtggg

SEQ ID NO: 210853 - DNA, 405 bp, Homo sapiens
cagtcatatacagtgcaccatctactatatgtatcctacaggagagacgttccatttcaaataggcaaaaatgagaacctaattctctacttacagttttatattttttatgattggaagaatcttccactgactagtttgaggtttcctacattccaaacctggttcctcctccacttcccacatggttctagggactgatgctctaggcacatctgtgtcatgatctacaccctctagccttgcccactttgtgtcagaatgtctggtgagttagcacaggatgtctagtgcaggatgccagcactagaacagctagcaatcatttgatcatagacaaaagtgattgcaaaccacataaaaatcccattaaattcaaactaaatgtatgtgcaactagcttcc

SEQ ID NO: 210854 - DNA, 291 bp, Homo sapiens
tccccaaatggaatcctccccaaatggaagtcctcccaaatggaatccccccaagatgaatcctggatgagatcctgggacagagaaacttcattaggtgaaaactaaggaaatctaaataaagtagggaatttagttaacagtcacataacagtcattggttccttaattatgacaaactgtgtactaatgtaggaagttaattgggaaactggatgtgaagatatgagaactctctgttctaccttcagttattttagtaaatctaaaactgtcctgaaaaatagttta

SEQ ID NO: 210855 - DNA, 872 bp, Homo sapiens
tacaaagtgtgtgcatgcctatgtgtatcactaatatgtagtatatgcatactaaatatgcacatgggtatttcaaactctgttggcttgactctaaatgttcagctatcgatgttattcttggtatttagaggttttatttatatatttatctttcttgactttcccactgggaggtgtcttctgatatttcagcctctagcatctcagtcccatacattcagccctcactgggaagtttaattccaggttactaatttcagagcatcccaaagatgctgtttagctaggtagtgccttaatatatcttagaattaaaagaaaatactttctgtctctcagggcatttgaaagctcaaactctcctctttgaacttccctctctcattatattgccatcacaaatctttgtccatcactaggtggtacaactccccctcccctcacctgcctcacacacatatgacctacagtggaaaactgagctccagatggttcatggacttgcccaaagtcacctgtaccattgctgacttggaacttgaatgtccaagccttctaaatcctcatctgcatttttcacattagagaattttgatctctgacttccaacagttatttcaggagaggaaaatgcatggcttcactatccaatggactaaaaaattgagtaagggatagaacatattttacactccaacttgaaaacttgtcgtaatgatgctcttccagcatgaagaaattaaaattggccttcctcttcgttctcctgaattgttcactgtaactgagtggagatattttaggagggttcttactgtggcttctgaagacctttttcagaataaggtctttttttcaaaaacaccaca

SEQ ID NO: 210856 - DNA, 525 bp, Homo sapiens
attagctgggatggaagcattatggccatagcaaatggttctcttttagaggtctagacagagccagaggtgttcttgtcttccagaaggcagatgttttcatcgattgtcagtggaaagcaaagccatggtggtcctcatggaagacaaaagtcacatactccattttatcattggtttttgttgatcataggcttttggtaggaggaaactaacaggattatacttggaaggggtttgaaaggccttttaaaatggtgacaaagacaaataatagggtaaccatctatcctggtttgcctgggatagctgtggtttatacttacagtcctaattattaactatttattacagtcctaattattacaggcctaattattaacagttctccatcttttcttgtcaatgtcctagtttggatgatcaatggtatgataattctaagtaggagctataaagtgcaggtctgtcaatgcatgacacccctgtaaatcacacagggctggcctaatctatacaaggatg

SEQ ID NO: 210857 - DNA, 460 bp, Homo sapiens
atattccaacagttataaaggcaatatgttggtagtctgaggagagaagacaaaaaaaatcactgtatttcaaatgcttatgatttaggtaggagaggagataaaaatgaatcaatatataaatgactatactctgacatggaatgtaataaaagcaacaagaagaactgtgacaatatagagaaagaaaaaattacttctaagataatcaaaaagattcaattgtaggatgtagcatttgaactgttctttgaaggagagaaattggacatcagaaaaaaagtgcatagctttgaatgaagtattaaacagattgtctcaattgtgttgagtgcctccagaccaaggagtatatcatcaagactttgtccagtgcgaagagaccaagaaataaagctccccccccccactaatctgtacataatggcctcggtgattacatagatcaatgactaaaata

SEQ ID NO: 210858 - DNA, 195 bp, Homo sapiens
taacatgcagttcccaacgtgcacattaataacagttgttatttgtctcctggcctggaatttcgacttgtatgtaatctatattatctctggttactatttagaagcctgttagcttgctgtgtgtgacttctgcaagatgatgtgggataatttggtaactctgatgttcaagtgcataaagatgaaaatgtt

SEQ ID NO: 210859 - DNA, 214 bp, Homo sapiens
gcagggtgtggtggcacatgctcgtaatcctagcttctctgtggctgagacacaggaatcgcttgaacccaggaggaggggtttgtagtgaggcaagatctggtactgcctccagcctgtgctacagagcgagatcctgtctcactaaattaaattaaattaaaataagtattgattatctacttagtgctaagtatggtatgagcttgtggga

SEQ ID NO: 210860 - DNA, 433 bp, Homo sapiens
ctcttggtaagagtcccagcaaggcagtgggagaggcgggattcaatgcaagtctcctaatacccaaatggaacccctcttttctaccccacggcctcctcggtcctttttggcaatcctgtgggggaggcagaagagtgtagctatgaaggctgggtgcggtggctcacgcttgtaatgccagcactttgggaggccaaggcaggcggatcacctgaggtcgggagttcgagaccagcctgaccaacatggagaaaccctgtctctactaaaaatacaaaattagccaggcgtggtggtttatgcctgtaatcccagctgctcgggaggctgaggcaggagaatcactcaaacctgggaggcagaggttgtggtgagccaagatcatgccattgcattccagcctgggcaacaagagtgaaactctgtctca

SEQ ID NO: 210861 - DNA, 423 bp, Homo sapiens
tctctcgtgttgtatgagtctatgaagtactgagttggcaagtgctgcaaaatggtaatacagagttgggtgaggctgattataattagttgtagcaatgctcactaaagctttcactgagtcaatggttactaaagatttactctgtgctggctacagtttccagtgctaggaatataatgattaagatacagtaaccctatccttgaagaacttactgttaagaagaggaacagatattaaactgagaaagttgctataatagatgtttacatgaagttcagtgaggacacagacaattgtgtttcagtctaatattcctagaaagaaagaagcaaccatacttgatgaattctgcttcataatatttatcactagctggtagaataaagttgggcagtgatttaaaaaaaacaaaaattt

SEQ ID NO: 210862 - DNA, 319 bp, Homo sapiens
cagggcaccaacttagtatgctgaaaactgatacataaggaagaaaattcttccaccttgccattaaaaactgtggttccaggtaaccaaatagccctggcaggtaaagcaaagttcttctatagaagttaattccagacactctatggataagaaagaataagacacaatacacaataacatatggatatataataagaaaatccccattttgcagcccttaatggaataaagcaacagcaacggtcttcagcgaagggcaaaacctttagttttaagagacctccgtcccttgccccttcagccaagtgaggacata

SEQ ID NO: 210863 - DNA, 1177 bp, Homo sapiens
  misc_feature (958)..(958): n is a, c, g, or t
  misc_feature (968)..(968): n is a, c, g, or t
  misc_feature (1069)..(1069): n is a, c, g, or t
  misc_feature (1074)..(1074): n is a, c, g, or t
  misc_feature (1077)..(1077): n is a, c, g, or t
  misc_feature (1100)..(1100): n is a, c, g, or t
  misc_feature (1104)..(1104): n is a, c, g, or t
  misc_feature (1143)..(1143): n is a, c, g, or t
  misc_feature (1153)..(1153): n is a, c, g, or t
  misc_feature (1174)..(1174): n is a, c, g, or t
tatttgtattatcctcccacggctgagcattaattcacatatgacaaactttctctgtctccgtttattcctatcttcatcgtgatcaagtttctgagaagcggtctgcccagatactttggtcataatgctcatgtctttgaaactgtgatacacacccacaaaaatacctgtatttgtttgtttttttgtaatgtcttttactttttcaaagcatctttatgtctcatctttgtttgtcctcaaaactccatgaagtattacatagatattatttattttcctgctacttttgtagaaagtaaagccagaagagtaaatgatattttgacatctaacacctctttgtgtgtagtgtaaatttgcttatctagaattgctgtctaggtatgcttacagttcttatagatggtgaagcctgggctatgtcctcacagttcaaaaacctgggatcccttactctgagctgaaaatcagggcaaatcaaatctatagtgaatcacgaaacacaagaagcattccctttttaaaaagaaagatataaatacccccaccaactttttacttcattactctttcagttgctattctacaaatactgaacacctgctgtgtgccagggagtgttctagcttctggagctacaactgtggcaaaaacagataacaattcctgcccttaagaattatacctactaggcaggggtgacagcaggtagggcatcagacaataaagaaaataaataatgtgtatagtgtattaggagatgtaaacagagtcatcaaatacagttgtgcagattgctcactgcccaactctgtgtccagtaatgccaatggaggtcttggccttccaaagtgctgggattacaggtgtgagccactgaacccagcctaatttttcagattaaaaaaacaaagggacactggttagttcatagaatgtctggagggcctgncagcctgtgnttgtagcacccagctaccctatggggctgtctccaccggaaacacctctacctctgcttctacagccaggacactcaggacctaacatcatgaatgtggcngcttncanccctaaacaactacatagcttgncatngtggatggcaaaagaattgagttccctaattaaacttgntgctttttanaaatcaagtgcttgttaagcntta

SEQ ID NO: 210864 - DNA, 496 bp, Homo sapiens
tggttcacctcaggaggtggccttgggtgttcaatacaggacagggaagtgccaaaaatgatagagggtgtcttgggggatgggatgcagatagctgacatttcctattcttaatatctctcagcataaagcaaagaacatacaatgtcagtgggggctcacctgaggcctgttagttcagaagttctctgcatttttcagccggccacactctgataaccttcaggaaaggtattctcacatttgtacctacagttacctcctaggtaaagccaagctgggtcatgggttatttgctccctgcttacagctggaacgctcttccttcttccactggcctgtgatgggccaacatgacagaaccttaacactcattgggatacctagtgcagcacctagcacaggtgggcatttggggaatgtttgtggaatgaatgaatgaaacaaagggcaagagggaggatgaatgagagggaggaagagaagtaaaggaaag

SEQ ID NO: 210865 - DNA, 408 bp, Homo sapiens
tgtctcgctctcttgcttaaaactgggacatgaatcatccttttgtccaatgtatccacactgtatatgctaacttaattgttctattttgttattgttcatctcttgttcccagtttataaattaaactttatcataggtatgcatgtataggaaaaaaacagtaaatataggattggggctatctgcagtttcaggcagcagccgctggggggtcttggaacatttagctcatggataaggggagactattacattgcaccaagagaaaaacagtttcatatatttgtagtacattggagaatataagcttcatgagagcagaagcttccttgtgctctcagcacataatatgagtctggcataaaggctttttatgattgtttaataaatgattgaatgaataca

SEQ ID NO: 210866 - DNA, 388 bp, Homo sapiens
tgtttttgtcaaaagaattgtaaaaggttttagttatttattttatcttaattgttcatttccttttatataaaatcttcataaagaaacccctcaagattaattgctaaaaaaaattactagtttaaaatgaaaatgtcccctcttattagctaaaatgcaatttttataaaccgttgtatttattttatagatttgcctgttttgtgtttgcttggctgccagggagctcaacaacacttatccttaacttagagtgtcaggctagcatgggagtcagggcaatgtttttcaagcctgttgactctctcttgactttcattaatagatggacatattctaattctcttcccaataatatcaacatcccttataataagtatttctt

SEQ ID NO: 210867 - DNA, 439 bp, Homo sapiens
tgctttaaaagaccccttttcccctctatgtgtctaaaataatttcttaataatttcttaataacttctataacgatagtacacaatattgtgaaaatgtgagtgctttctatgtgcaaagccttgtgctagaattatagacagagtaccctctaagaaataaggttggaaaggagggtgggagtaaactgggaaggaaagtaaatgctgtgctgtggagttgggacttcatccagagggccagtacttctcagactttagtgggcattacaatacctggtgagataataaaacctgctttgctgggctccatttcctgagtttctgattcagtaggtctcaggtggtgcttgagaatttgcatttataatgagtgctatggactgaattatgttcccccaaattcctgtgttaaacccctaacacccaatgtgactat

SEQ ID NO: 210868 - DNA, 713 bp, Homo sapiens
ttctgttcagaagaaacagtaagtacaaaggccagagagaaccaggtgtgttggaagccagcatagctacaacagaatacgtgagggatagtggtgggagatgaggttagagaggtaagggcttggggaccagacagagaagggccttgtaagccactgtaatgactttggctcttactctgcagggggtggaattgctgttagaaggtttttaaaaagcaaagtaggaacagtctatcttgtcttttaaagggccctctttggctgttatgttaaaaacagatggtagagcagcaaggagacccatggaagaccattgtaggaatcccagtgaggggtgatggaggcttggaaaatttttcattctatgtccatttggtggtaatataaaatctacaagaagacaaaggaggaaacagaatagaaatatttcatcacactagcccctctatctaccttttagaatactttttaaaacaactatcaccaattatcccattgtagcttcctgcttggttcaaatagcccctatctattatttataatatagaaatggacactgtagaatattgctgctcccccaaaatataatgtgaactacatacataatttaaatttttctaatagccacattttaaaactaaaaagtaataggtgaaattaattttaagaatgtatttaatttaatcttgtgtctgaaatatcaccatttt

SEQ ID NO: 210869 - DNA, 185 bp, Homo sapiens
caagtaaaggcatctttacaagcacagcgtgttcaaagccctcaacaaatagtacatcccttccttcagatggaaggtcatgttattcaaagcaatggtgatcattctcagcagcaactccatcctcaaaattctgaagttatgaaaatggacctctctgagtcttcaaaaccattacaacaaca

SEQ ID NO: 210870 - DNA, 337 bp, Homo sapiens
tgttgatcaaagatggaactctgattggatattataacttgaggggcaggtaaaggagatcctcatgctggaaaaaggaagaacagtcagaggggtaagaaagccaagagagagtagtgataaatgctaaaaaagaaagaaaggagtggtcagcagtaaacatcagttgcgcaataagaagaccaaaaagtgcccagtttggtcaagcggtcactggtgaacttacagcagtttcagcagagggagcagtaagcacagaagacgactaaaatgttgccaaataagcagacaatgggaagcagtgaaacagtagactgctgctcaggaaaaaaaaaaa

SEQ ID NO: 210871 - DNA, 512 bp, Homo sapiens
tgcactccagcctgggtgacagagcaaaactccatttcaaaaaaaaaaaaaagttcccttcctcttctagtcacaatgttcttagaactcgtaccaaaaatttagtaattatctactactgccttgatcatattcaaaggatgtcacgtggctgctcaatcattatagccaggtaatgagccccttgggcctctcccttataattactataaaaatcattattctaataaaaccaggcatggtgttaagtattccacaagcattatctcatttaatccccataatgactctatgaggtaggtgctaacattttcctcattctaatgaggctcagaatgattaggttacttgtcaaagaccacagctacaaaaagctgtctcatgtattgcctagtcataccataggcttgctatggttataggtccatggtggatgctcagtagactgtggtggttacccatatgacacgcggcagagaaggtctgcccaaaaaagtagctaaagaaacatt

SEQ ID NO: 210872 - DNA, 707 bp, Homo sapiens
atgcttcacggcatgacagcagactgacgaggggcaaagggcatttccagaaggaggagcggtcagttctatcaaagggtgctgaggaggaaataaatatgcagaactgaaggaggtatcagaggaactcagcgttactgttggcccctttttcttgcaaaaatagagcagatgtaagagatgccaggaggagtgagtgatgtgcttcgtgtgggcagagctggggggaaatccctggaagaatgttaacaacactgtgagactagtaagtgaaggaccattccatatatagggaagttttattgtagtggcaggtataagcaaagtaggttgtcaaaggcatttgggtaaaatgccccaatgtttacaggctgtgtttctgctaataattttaacaaaaataacagtaaataaaattaagcacttcctttgtgccaggcagtgctctgttattttgaattttcacaacattcttgtatagtgttttccccgtttaaataaaaggaataaataggaataaaggagatcttagactagttttagttaaggaatttgcaggtttcacagctttcagtgatggaattgtatgtctgattctattctgactccaaagctcattgccttacaacaagaaccattgtagcaccagtcatgtactgccagcttgctttagatgaatgactatccctaatggaacatagcatttt

SEQ ID NO: 210873 - DNA, 442 bp, Homo sapiens
ggcagggtaaaatatatctgaaacagttttttaataataggggcggctattattagattggttggggtgggagaaatgggggtgaagaacaaaaaagctagcaagagaaaaactcagagaattgaagtaggctgctttaaaacgttgcttaactgggaagcttgaagaagaatggaagagtctgccgacaggtcacatacatgctgttgttcattagaacctcattataaattttcatttttaaatagattttacatggatttaggcatactaatcaaatcacatccccttcataagaataacaagttttgccctttgaacaatctgtttatacttaatataaaattggcagctgggatggtgtggtaggtgtgcagcctctgataaatcttataaaatgagtattgtggaatgccataaagttgatttagtaaatgtcttt

SEQ ID NO: 210874 - DNA, 1293 bp, Homo sapiens
gtgtgagacgtgcctttcacctcctgccatgattctaaggactccccggccacgtggaactgcttccagggctgtggggccaaatgtgccctctcctgccctcatggcagcctcagttcctgagttctcatcatttcttccttgctacaatcagaactgagtctagcacccttcaggacaaatccagatccccaggagagacagcctgatgagttcagcttggaaagggtctgttcctgtcctatcagctgtggccagcgtgccagggtcacgtaccagtgcgactgccacagcacggcccatctgtccaggagtagttctcagtcaacgggctccagctgggactcaggctgaatagatgcccacaaggatgtctgctaccacatgtaaagtgccccaaagcaggacaagtgctcagcaagtgtggcccgtatgattaagggaattctgtgtctgtctgagaagaaagtggcgatgagcaataacaaggcctgtcgtccatctggaagaactccagccaccccccaaactttcaggtgcatagaaccacctggacataagacacaaacattgttaccccaaaaaggaaaaaaattatttggactatattaaaataaaatatttgtttatcaaaatacatcattaagagtaaaaaggcaagacagcaagttgaagaagatatttgcaatacacatagccaggaaaggacaagaacccagaatatataaagaactcctataaatcagtaagaaaaagacaatctgattaaaacattggcaaaagatctgaagaggcacttcacaaaagaggatgcccaaatggccaataaacataagaaaatgtgctcaacatcattagtcatcagggaaatgcaagttgaagcataaaatggtatcactccacacccacaagcatggctgggatgaaaagagagatgcgcccagtgctgacgaggatgtgcatcaactggaactctcagacactgcaggtgggtgtctaaattggtacagccactttggaaaattgttcagctgtatttgttaaacctgaacacaagcaaatcctatctgtgatgccacaattctgctgatcgacatatctccatcagaaatgtatacaaatgtccacagagatacatgtcatcgaattttcatggcagccctcttttgatatcccaaagctggaaacaacccaatgcccatcaacagcagaatgcatacaaattgtggtacaatcataggctggaatgctactcagcattgagaataaacaaaccacaactgcatataatgg

SEQ ID NO: 210875 - DNA, 414 bp, Homo sapiens
aagaaacttgtggactgtactttgtctttaatgatgttttaagggaaaattacacataaacacacatatgtatacagaatattttgagtaaatttaattgaactctttttaatgcagattcaaaacatcgtgttgtaaaactttgtggtattggttgttatgagagatagtatgtccagctgattgatgcgtcttaaagaaaatggaagtttggcatcagttgggttaataagttataattcacctcttattaggctgaaaaaaaaatctctgaggaatgaactgaaaacattctggggagacaagtgtctgtgccataagggtaactaggcatattttagtcactaaatattccttggatggacagatggatagatgaatgaatgagaataggtgaaatatgacaattctaaa

SEQ ID NO: 210876 - DNA, 591 bp, Homo sapiens
tctgaacctcactttccttctctatagaaaggagcttgttataaccacttcatatataggtattacatgatgctgtgaaaattgaaggtggtgactcatgcaatgtgccttgcccagaattgacactcagtgggcattttgtaaacatttacttgtaggccccttccctttcctcaacccccatccccagcctcagctttaccttgttttctttttactgggaaacatggtcctttttgtgaacactgtcaatagatatcttttgaacctcagaattctctcatctctactcccttcttttctttccttcctccctccctgaagtaagtatcccaactccttttgcttttcctgggccaaaacccttccaagggtgagaggtgagggaataggagatggccgagaaggtaaggatggcactgcagtcacagacacaacacacatcagtatttctccttatccagttcctctccaatcctcccaaatgggcgtgggaattccaggttcattatgactattctattagcattccccctggttgtcttctctttctttgatttactgaaaggagaaagagagtaagggtttttc

SEQ ID NO: 210877 - DNA, 200 bp, Homo sapiens
acacaaagatagagtgaattggtaacactgacacagaatgatacgtacacacagattatggtgtcactcacagtgttacgtgtagaccaaagtttctcagctttggaactattaacattttggggccaggggcagtggctcatgcctataatcccagcactttggaagaccaaagtgggaagatcacttgaggtcaggag

SEQ ID NO: 210878 - DNA, 1039 bp, Homo sapiens
ctgttacccaggctggagtgcaatggtgcgatctcggctctctgcaacctccgccccctgggttcaagcgattctcctgcctcagcctcccgagtagctgggattataggtgcccgtcaccacgcctgactaattttttttgtatttttagtagagacagggtttcgccatgtcggccaggctggtcttaaactcctgacttcaggtgatccacctgcctcggcctcccaaagtactgggattacagacgtgagccaccgtgcctggctaatgtctctctttttcgaggtgagaaacacatcttttgagctttcccaggggctcaactggcaaattccaaagttaattcaaggtcaaaagactgaatttagaatttgattttaggaagtttgtcaaaaatgtaaaaaaagatttaaaacacttgatgagtgcttgctttggcagcacatatactaaagttggaatgatgcagagaagattagcatggcccctgtgcaaggataactcacaaattcatgaggccttccatattttttgaaattaagaaaagaaaaaaggaaaaatttgattaataggatctcaggtaactattaatttaggtcactaataattagtctggttaccagagtgattattgaattatatagtgatctgggatcctatttaatcaactgttcattttataatcatttaatattttatgatttaagtatttaatgagcatttaatatttattaatattcatttcataatcaccagggtaattattaaaaggctttgaaggcaaataaagttatatagttgtaaaaatatatatattagttctcttaataggattttattttcttggaaagtaattgaaggcctgataaaagataacatgaaagagaaaattattttgataagacataattttttaaggcagattacttaaaaggtgaaaaagaaaatctttcactcttttttatcaatactacaagaaaatcttgcattttaaaagataatgccaaattctagttttgcatcaatgtacccttga

SEQ ID NO: 210879 - DNA, 866 bp, Homo sapiens
aggaggaagtgatgctgaggcatgtaggtgatggagtggccctgaaacatttgaagcatgggggcacttactggcaataaaatctggagtatatcgaggcactttataacaaggttcctgtgcattcagaataccctggttagaagttcagtagagttaattcatgtacctcacttctacctgttaaatgcaaaaaccactgctagaaattttctttaaaggtataggagttgatagaaatgataaatgaacatagctttttttttggcagtgaagaaaatatttcaaattatcctttaggaacttttttcaggtatggttcattagagtaggactctgttgggattatatggtttcttatgccatataggtgctgtcttttgctttggccaattccctagagatgtaacactttcatctttgcattcaaaatcgtaccttgttaaggagctatgtttctacaattgcttttacattgctgtttcattatttgcttttttttttgccctgaaagaaaagcaattctagaataaagattttctgtcttgatgatttaaaaaattagtgttttttgagattaaataaagatactgaacagaattttaagggtaaaacttgaacttaattttttttacattgtggaattgtacttggagaagccagcaggtggcagtatgatgtataaagtgaaaggtttcaaatgggtatgaaggctgcttttttcatcagaaaatgttacttgcatattaaataattcatatcactttattattcagcagaacttttttatcctgtccctttgttgaacacattgcaattatgattttatgggctattattttaaattatatatttagtactttttt

SEQ ID NO: 210880 - DNA, 204 bp, Homo sapiens
aagagttcctagagaaactcttcaaatacttttgtccactatcttggcttataacccaagagccaagagctgattaaaaaaagatgttggccgggtgcggtggctcacacctgtaatcccaacactttgggaggccgaggtgggcagatcacttgaggtcaggaatttgagaccaagcctggtcaacatggtgaaaccccatct

SEQ ID NO: 210881 - DNA, 128 bp, Homo sapiens
cccagcttcactgcgtactgacacggaacaggcccaggctggcccgagcttcaggccccctttctccgctgtgtcatgagccaccatgacaactgcagcccccagtgcccagcgcagagagaagtcat

SEQ ID NO: 210882 - DNA, 356 bp, Homo sapiens
agccagaccaggtgttttggttcctcattgctgaaaccataagtccagacttgggccatctactgtccttgggagcctgttggaagctggcttcctaaaaccatgataacattacctgtcattttattgagtacctgctctgtgccctgtgtgatgtagacactattttatttaatccacacaacagtccttcagagtggagatgactagccattatttattatctttattacagattaggaaacagaactagcaaggttaagtgacttgcagagtcacagacagcaaatgacagaactcaaacctccagccctctggcctcagagcctgtacatttctggccagccctccagaag

SEQ ID NO: 210883 - DNA, 284 bp, Homo sapiens
aaaaaaaaaaaaagagagagagagagagggagatttatataacatttaaattaactgcataaacctgggcaatgttcaaaactccatctctacaaaaaaacacaagaattagccaggcacggtggtgtgtgtctgtagtctcagctacttaggaggctgaggtgggaagattgctagagccaggaggtcgaggctgcactgagctgtgattgcgctactgtactccaccctgggtgatgaagccctaactcaataaataaataaataaataaataatacaaata

SEQ ID NO: 210884 - DNA, 443 bp, Homo sapiens
ggaactatttctaaaccctcctagctggaggcaatgtacaccagaccagtgggatgggagcaataaagaagaaatgcagtaaagaacaaattcttttcagattagctgattggcagttgtgaataatgcagctccagcactaaagcaagaaagagcagcctcaaccttggcactcattatttagctgtaagccttttttgctaggaacatttttctctttcaagtcttaaactaggttaactccttatgatccagctattcgtccaaaaaagtgaactctaaagaccctttgttgaaacttccaagtcctggatgtgaattgatagcaagaaaccacggcatcctcaagcaactttcttacctgcactgaaattatgacagaaaaaacttacccagtgagttaaatagcatgcgttctacatcagacctgacaggcattaaaa

SEQ ID NO: 210885 - DNA, 520 bp, Homo sapiens
actgtcagcataagtaatttctatagtccttctatctttaaccttttattgttctagatgttaactggttgtttaaattcgggacactggattccaaggaagcaaagcaagagctttaaacgcattcaccccaataaatatttaatgggttctctgcagctagctatacattttaagaactctcaacctagaaagggaatgggtagattggagtggtccttgaaaatgagcatcattggaaggagggtttggggctctcttgtgagcaggatctatcactgacatttgaagccaaatcccacctgctacacaattcacccagatgcctggaccaatcccaggggtactggagctcatttgttggggattatttctgtttcagttggtttttatttacctgtcttctgcagaagctcacagccattatttgaagtgattgtatcattttgtctcaaaagagtatcttttcccaaaatattagaaactataaaatcattatttagataaagaaaaataaaat

SEQ ID NO: 210886 - DNA, 455 bp, Homo sapiens
gcaaaaacaaacaagcaaacaaccaccacggcagcaaagcacatggcaggcaggggaaagacactgaccagcaggaacattcccatcaaggaaatgcacgagtgtttttggacaaagtgtacagagaaaatcaaagctattcattgttttaattaagagataaaactaaggtcactgtttcacttaatgttgagatataagttaaaagtatcatctacctctaggggtatgatatgactgctgaccaaggttacttaataagaaatccttgttctagttaaatacactgtttatctctatctcctgtccttcatccctccctttcttgccacccttccctccatttattccagtccagcagctgactggggatgcatttcttcttgggaaggcaaacaaagccatcattctggggcttaattaataaagctcctagtttcatagttttcatgctc

SEQ ID NO: 210887 - DNA, 302 bp, Homo sapiens
cgggtgctagtgtttaagtcaaaccagtgcagaaataacatgagcattgcaagccccttaacctgcgagttgaaagttagaggaattcaggctggcacagggcttactccttttgctagagggcctttctgttcagagtttttctttttcaagaaccacagacatttattttattgccactctattctgcagcacagtttttccttgggctaagaatggaattactaacattgcttgttccatactctgaaaatcgctgtcaggtgtgaattaaatgctttatttgaagatttaagctcctt

SEQ ID NO: 210888 - DNA, 791 bp, Homo sapiens
  misc_feature (753)..(754): n is a, c, g, or t
aaaaaaagaaagaacagagaatacaatactagcaaggatacataaaagtatgcatacaggatgcccactgtagcattatgtgtggtggcaaataaaagcacttactagaaaattaaaaaataataataataacagcacaatgccaaattggggaatgccccaataaaggtattaacaaaggactgtgtgagttcagagaaacataatggctagttttgacctgggacttgaaggaccagtccagtttcaacggacagatttggtgagaagatgggggtaatctaagcagagagaaatatatgaggaagtgtacagttaggaaaatgtaatttagaatgatacataaaagggggccatgagaaataaaactggaaagagaggtcaggggttaatcatggaggctctccaataccatgctagagaattaggaaacaggcctagcactgtggttcatgcctgtaatcccagcaacttgggaagccaaagtggaaagatcgcttgagcccaggagctcaaggctgcagtgaagcaggtcacccatgccccaaccgggcgaagaggagcccggcccaccacaacacagaaattgacttgggtggcattgaccgtacctggcaacaacacgatcgtttccagtacgagtggaaacaggtatgcacatgcacaaacatctcttaaagtgggagcaatccagacttgtcaccccacggctggtaccagtgtgccatcgggctttcaggattgataagtccnngggatgacgccacacagagatatgcagatatctgcgg

SEQ ID NO: 210889 - DNA, 553 bp, Homo sapiens
agtcatccatgattttattacccaaagacaaatattggtaatattttacttcatttcttcctagaattttgtctttgcatgtatatttgaatattaaagatgatgctacatgtacagatttataccttttcctcttcacaaatcatacacatcctcacaaattgttcacttagaagatatagtaagatgagttttatgtctgcctaacgtttatctaaaagtgatttaaagaatcaattaagacaattatgaaaacgattaaaaaatctattcatttgaagaggattttttatttacaggaattctatgtgaatcatctcatgtacttccttctacaaagatggagtttggcagaagaagtattattcccactttatagctaagacatgaaggtgttgggccacattctcttacaggcccatttgttctatgcaagatcatagtctgtggaaactttttctgtcattgaaaagattgaatcagatctgcccatctaaattatgtaattgttaaagggtatgagaccatttttataaaagtgtgttatatatat

SEQ ID NO: 210890 - DNA, 357 bp, Homo sapiens
tagttattattattatatatatttttcgagacagacaacaacaacaacaaaaacccatattccattgcggcatagagcaatagttaatccactggagattactatcaggttaacttctttgtagctctcagaatagaactatttctgagtatatgtgtacttcatacaaatctccatcaactaagaaggtggttgttctacactagcattttaaaaatagtctgtatttatacttatgtataattgtacagtgaagtataagactgtggagctgggggcagtggctcatgcctgtagtcccagctagtagggaggctggggccaccctggatgatacagctgggacccaacttgaaa

SEQ ID NO: 210891 - DNA, 519 bp, Homo sapiens
ccaggtgctatatcctgaggttactcaggagggaacaggagagctacaaatccagacacgtgttctccagctcctctaagttgaatttatcaaggagacaaaacaggacccaggatcactacctgcaactcccttaattgtaacctactttccgataaaaattacatgcttttgaaaccagcaataataaactgaaatgcacgaacagtcaacacaatgacaaaatgtactctgcagcgattgaggagacattgttacatcttttaaaatcaatctgtgatctgcctctacaggagatgaatgaaagtgcatagaagacaaaagaatgtgataataacagagataatactcagccccagtacatccaatcttttgttgggtcaataaccatttgaaaaggaactatggattttgtgcctaatagaaatgagaggacagctccaagataatttgaatatttctttcccttttttccttttccttcctatgctggaaataaaaaggttgatgtcaacatat

SEQ ID NO: 210892 - DNA, 465 bp, Homo sapiens
taaagtcttgctgctctaaactattcctataaagtccatcagagactgcacatcgttcaaggtcatgctgcaaacagattcggaatgggcaagatgcttttgtgatgaaagttattgcatcaaacaaaactcaaaatttattccaggtgggatccaccacccctccccatgctatcttaacatcaaacacaaaactgacacaaaacaattctgtcctcctgatatactgaactttgggcacaagtagagggtgcattacaaagacatggtttcatacttgagtacatgtgttggggaaaaagttttccacttaaatgtgatccatttaaggatagctaaatatatgctctcctgcttattatatttacaatcatttttatctcagcaaaagatgctgttatggtgaaaatatattacacatgtcctttgctgactgagagagttaaaatgaatagaacaataaag

SEQ ID NO: 210893 - DNA, 281 bp, Homo sapiens
tgccagttgtcaaatagcttctggaaggttgaactgaaatggtttgaatgctgcttttcacagaatgttaagtttagtcaggctctctgcaggtagctaaaccttggtaaatgttaaagagaaagccctctttaaaaatactctgtttaaaaactgcttgttgtagaaaatccaatgcagaaggaataaagaaagcaaaaatctccttaaattcttctaccaagattggctgatttgcctctctctttttctcttctctatcatctgggtacacaaataca

SEQ ID NO: 210894 - DNA, 397 bp, Homo sapiens
gaatgtggcattatgcagttaagaatactgacaaattgcgatgaacaactaatctcttgagctcctctctctgtccctcctgtgttctcattccagtctggtcatgtattgccccaagcctagacttagcagtggtctcctatctcctctccctgttgacaatctctcttctcccttgctccagagttgttttttccaaagcatcgcttttaacgggtcattcaccatcatgctctatcactacaagatgaattcttgaccaagagaaatggatttcaagacactttgcagccccgtccaatccaaatgcagcatctagtagcttctctagcatcttctacctcttattttttcttttaactgaattccagctacattcactccattgctgttctat

SEQ ID NO: 210895 - DNA, 304 bp, Homo sapiens
caaacttgaatgtgtatatgaattgtgtggggatgatgcaaaaatgcagattctgattttgtagggtagatggggcctgagactctgcatttctgaccacttcctagactatgtcaagactgctagcccttagtccacactttgaatcgcaaggctggtgtagctatgtctttctttatatatgagattttgtttgcaggtggcacctaacctagtagaaaatagtagaatcgtcacctcccaaaatataggtgtaatacttctattaacatagcccaacattgtattactttggggggaaaag

SEQ ID NO: 210896 - DNA, 774 bp, Homo sapiens
gaggacccaggggggagctgatgttctcctttgagtgctgtgcagctggagacccggggggagttgatgttccgtttgagggccgtgcagctggagacccaggtgggagctgatgttccggtttgagggtggtgcagctggcgacctgggcgggagctgatgttctagtttgaggactgtgcagctggagacccagcggggagctgatgttgcagtttgagggccatgcagctggagacccatgggggagctgatgttgttttgagagccgtgcagctggagatccgggggtgagctgatgttcccgtttgagggctgtgcagctggaggcctagcgaggagctaatgttcctgtttgaggtccttgcagctggagacctggggaggagctgatgttcttgtttgagggccttccagccggagacccggggatgtgctgatgttcccatttgagagctgtgcagctggagacccgtgggggagctgatgttccctttagaggaccgtgccactggagagcctgcggggatctgatgttccagtttcagggccatgcatcttgagactcggggaggtactgatgttcccgttggagagccgtgcagctggagacctggggaggagctgatgttcccgtttgagggccgtgcaggtggagacctggggaggagctgatgttgttctagtttgtgtgttgtgcagctgcagatccagggatgagatggtcctgcggttcaaatatgagggtcccggagctggagtctatgtgaggag

SEQ ID NO: 210897 - DNA, 529 bp, Homo sapiens
cagatcaactgtccaggttactgccgtgcagctggagatccgggggtgagctgatgttcccgtttgagggctgtgcagctggaggcctagcgaggagctaatgttcctgtttgaggtccttgcagctggagacctggggaggagctgatgttcttgtttgagggccttccagccggagacccggggatgtgctgatgttcccatttgagagctgtgcagctggagacccgtgggggagctgatgttccctttagaggaccgtgccactggagagcctgcggggatctgatgttccagtttcagggccatgcatcttgagactcggggaggtactgatgttcccgttggagagccgtgcagctggagacctggggaggagctgatgttcccgtttgagggccgtgcaggtggagacctggggaggagctgatgttgttctagtttgtgtgttgtgcagctgcagatccagggatgagatggtcctgcggttcaaatatgagggtcccggagctggagtctatgtgaggag

SEQ ID NO: 210898 - DNA, 620 bp, Homo sapiens
cctttcaagctgtaattcaggattcagaatgtatcgctgtattttctttacggtgatctcatctccttttaaagcttcaccttgcagagatagcaaagagataaagtgaccaagaaaataacatacatgggtgaatgggataaaatgcatattgtcgttctgtggcagaactggacagtgagcccacttactcatacaccagtgtcatcactggccaaagctatcacatgtgcagttttcgaaatccttcgctcatcagggaaaagtaatgagtggatttggctcacaagccccaagttttagacccctaatatttaggctgtgggctctcaaatttatatccttgagtccagacctctacgctttgctccagacctgatttttctgttcactgtcttcatttggatgtcttttagccacctaaaacttagtagtcccaaaactcctcttattatcccttccctcatgcacaaacttggcccttttttgttgtttttctttcacagtgaataactctgtcatctgcctatttgtacaaggcagaaaactaagcatcctcttattgttcatctttctacttccctaattatcttggatatttctcattcctttaatttgcc

SEQ ID NO: 210899 - DNA, 470 bp, Homo sapiens
gagcatgcatatgaatatgtgtgcgcatgtgcacagatgcacgtgcacaccacgcccaaccagccaacctccagcctgtctaaaaaggtattgtaaccttgtggaagggacagaaaggagccctacactggggaacttgtcaaatgtaatccagaaaagttggggctggcacctttgccaagcagcgcacagttggtggaaggaaagaaccaaggtgcagggtgccaggcaaaggcaccaggcagagaagtctcctggcctgaaaccatcaggcctagtctgctgagtgtgagggtgacctgtgatggttaccatcaccagtgcttgcatccagaggctccagccctgaccaagccttactgagtatccaaagatgggcctctgtttgctaaataatttgctccctcacctgctcaccccacaaagacaggtactactaataaaattaaagtcatcatcaccctcatcat

SEQ ID NO: 210900 - DNA, 388 bp, Homo sapiens
atatgggggtctcactttgttgcctaggctggagtgtaatggtgattctgacaaatgatcatagcacgctacaacctctacatcctgggctcaagagcttctcctgcctcagcgtcccaagtaactgggactacagatttcagtttaggtttatccgtggaaagatggaggaatgagagctagagaacaagagagcaagtgagagtaatggaaagtccaaaggaaaaagatggacaagacgaatgaagggaaacaagaaggaaaagagagaggcagagggagagggagacttatttgaggatttattttttaatcagtagttgatgttgattttttcaaataattcttaagtctttagctttttgtgttattaaaattttaaaatata

SEQ ID NO: 210901 - DNA, 269 bp, Homo sapiens
gcaattctggaagcaaggtttgtcaacattgcagaaagaagtccggtggatgtgagcaaaatccccctgccccgcttcaaactgaaatgtatcttctgtaagaagcggaggaaaagaactgctggctgctgtgtgcagtgttctcacggccgctgcccaactgccttccatgtgagctgcgcccaggctgccggtgtgatgatgcagcctgacgactggccttttgtggtcttcattacctgctttcggcacaagattcctaatttgga

SEQ ID NO: 210902 - DNA, 224 bp, Homo sapiens
agaaaaaggacactaagagaggggagggcacacacccaaggtcttacagctaaagccaggtaattcacactttctgcaaactagccttcatccaggagccatttgagttggatcctgagggatgtgtaggagtttgccatgcagaaagtttaaggatttattctgacactcaccgtccaacgctttgttgggtgttgctgggctcaagaggcatctaggggtgc

SEQ ID NO: 210903 - DNA, 725 bp, Homo sapiens
  misc_feature (1)..(1): n is a, c, g, or t
  misc_feature (15)..(15): n is a, c, g, or t
  misc_feature (17)..(17): n is a, c, g, or t
  misc_feature (34)..(34): n is a, c, g, or t
  misc_feature (41)..(41): n is a, c, g, or t
  misc_feature (90)..(90): n is a, c, g, or t
  misc_feature (112)..(112): n is a, c, g, or t
  misc_feature (164)..(164): n is a, c, g, or t
  misc_feature (169)..(169): n is a, c, g, or t
  misc_feature (174)..(175): n is a, c, g, or t
  misc_feature (189)..(189): n is a, c, g, or t
  misc_feature (198)..(198): n is a, c, g, or t
  misc_feature (224)..(224): n is a, c, g, or t
nagatggagtttctntntgttacccaggctggantccagtngtgtgatcccggctcactgcaagctccgcctcccgggttcacaccattntcctgcctcagcctcctgagtngctgggattacagatgccagccaccacgcctagctaatttttgtatttttancaganatggnntttcatcatgttgnccaggctgntctcgaacccctgacctcaggtgatncacctgtcttggcctcccaaagtgctgggattataggcgcgagctgctatatatttcttggcactttcagtaatagaggctgttaagccacaacacctcaagggctgggccagttcaaggaccgatgagaatgcagaaaggaactcagataagggtactgtactttcttgttggtttactatggaaccagcacacaggcagcagaaaggataaatatgagattaagaacacatgatgttaaaatagatgtggctactagggcctcccatttccctgacagaggcacacctcaaggctggggcctgtgcagtgagaaatccaccagcagaatgaagcctagaaccttggtccactgtcttttaggctaggggaagaggggagaagtgcctacattagtccatgcccaagtgtggggatcctattttcttgtcccaccacaatacatataacttccttgctaatacaatatttttctttcattgacattgggcctacttaaga

SEQ ID NO: 210904 - DNA, 249 bp, Homo sapiens
agccatcagtgtgttgggcaattgtatttaaagccacaggatgggcttacctagagaggacaatgtccacaggtgatgggagagatgctgagaaagggtggccagtgagtgaggaggaaaaccagaggagtgtgtatcctgggtgcctggggatgagtattgggtaggaggagagcagccagttgaccatgggctttgacagatgtagttggttgagaatgttctatgggatgagtcccacctggagta

SEQ ID NO: 210905 - DNA, 975 bp, Homo sapiens
gacggccgctcatccctgctccccgtgtgtccctcggtcctctctgcagctcccagccctcaactccttaccccagtttgggcaaccagctgccccgctgtttggcccaggcctgggccatgacggatgggtgggcgcccggggccgcgagaagggcggaacgctgtgcccagccggagactacgctgggtggcggcggcagcgccgggagtctgcagtgcgcgagggagaagtgagcgcacagcgcccagcgagcaggtgcctgcggcgcggagagcgcacacgctagccagcccgcagcggccgaaagtgaccactgttcctggaggatttgcattgctggagaagtgcattctaacagtggaattcaggcggcgagagtcggtcaattcaccgtaccatgtggactccccagtgtggagcagaatctgaggactgacttgctaagaatctctgggcaccctggatagaaccttccctttggctctgagcatggtggctcacacctgagatcccagcacttcggaaggccgaggtgggagaattgcttgaggccaggagttcgagaccagcctaggtaacgtaacgagaccttgtccctacaaaaaattaaaagaaaattacccaagtgtattagtccattttcacactgctatgaagaactgcctgagactgggtaatttataagaaaagaggtttaactgactcacagttcctcatggcaggaaaggcctcaggaaatttatgatcgtggcggaaggggaagcaggcacgtcttacgtggcggtaggtgagagaggatgtgtaggaagtgaaagggtaagagccccttataaaaccatcaaatctcatgagaaatcactctctatcatgaggacagcatgggggaaccacccccatgatccaaacacgtcccaccaggtctttccctcaacacctggggattacaatttaagatgagatttggtggggaca

SEQ ID NO: 210906 - DNA, 404 bp, Homo sapiens
ccagcactctgcctccagggcctctgttcctaatcaataaccaatgctaccctgcaaatatctgctgagatcctactatgtgccacccactattgcaggcacagggaatgagtgatcagatgacagtgggaatggggagaggaatcgaattatccacgtcatgactttctctgcacctggatgttctcatctacacaacggagttaactgtcccaccttgcagagctgttgtgacactcataaactccttggccccacagaaagcagtccatccatgtcactcctgatcagctactagcctcgaacccttcctctcaattattcgaagcctgaagacggacccaggtctcctcaattccaaggcaagcagcactggccccagcctctctgcaagccccacttcc

SEQ ID NO: 210907 - DNA, 87 bp, Homo sapiens
ctccctaagtgtatgatgcctgcatggagtgagcgttggaaggatggaagcaaggatgaaagaatgaattcctggaagatccctgac

SEQ ID NO: 210908 - DNA, 518 bp, Homo sapiens
acttattaaacaaattaatagattaaaacttcctaagtctagcaagagatttagacatccagatacagaaagcctagtgacccccaatcacatgcaatgtaaaaaggtttctccaccccacattatagtgaaattgcctaaagtcagtgacacatagaaaatcctaaaaattgtaagagaaaagcgtttagtcacctataaaagagccccatcagactaagagcagctttctcagtagaaaccttacaggtcagcagagaatgggaggatatatttaatgtgctcaaagacaaaaaccctgccagccaagcataccttatctagcaaaatgattcttcatgaaggaaggataaataaagtcttttccagacaagcaaatgctgagagaattcatcactactacacctatcttacaagaaatattcaagggagtcctaaacctagaagcaagcaaaagggtgacagttaccattatgaaaacacttgaaagtataaaactcactggtaaagcaacaaat

SEQ ID NO: 210909 - DNA, 498 bp, Homo sapiens
agaagatacaaagaaatggaaatgttagaactgaaaaatacaataagttaggggaaaaagaccactggatgggtcaatagcagaatgtaatggcaggaaaaaaatcagtgaacttgaagataaatcaatagaaatttttaaatctgaacattagagaagaaagaattttaaaaaattgaacagagccttaggatattatgggaaaataacaaagtgttagacatttaaacaagaaccaaaatttcataacaatatttttagacatccaggttgtaatccaaaatctaacatatgaagaaccaggaagatttcaactcacaatggaagaggtagtcaacatatagaaagaatgtagttttgagaaaatatttgaagaattaaatggctaaagacctcacaaatttattgaaagacacaaacatacagattcagagaatcagaaatggaataaatccaaataaatttatgcccagatatgtcataattaatctgaaaact

SEQ ID NO: 210910 - DNA, 391 bp, Homo sapiens
tgcaagaaatatcttctttcatacttacacttttaacatttttgtttatttaacagggatttttcatagcgtatattgacttttttatacagtgtggaaatcatggtgttttaattgtagtagtcagtctgttcctttcttacattcctactgatatatttgggtataaacctattgttttctatttgcactacctgttctatattctttatttccttttatcctcttttgggttgagttatattgttatttaatttttctactgttattaactggggattttctttcctgttcctttgatggtaacttcaaagattaaaacaagtattcttactaaagtttaacataaatgaacatgttaattttatttattcctcttctgacttaacaa

SEQ ID NO: 210911 - DNA, 255 bp, Homo sapiens
  misc_feature (140)..(140): n is a, c, g, or t
  misc_feature (169)..(169): n is a, c, g, or t
tagatttcggagcctatccacaaaaggtcaaaagctcaagaatgagtgacatcacccagggacaatgtggagtgagaagaggagagggaggaatttggaaatgtggggaatactaagatgaagtgtggtcagaacctgtngggagggtgccgggtcttggaaccaaggnccttcaggaacacgtgtccagaattggggtgatgctgagcagtgtcagttgcctaagagcatttcagttagatgaggactgaaaag

SEQ ID NO: 210912 - DNA, 360 bp, Homo sapiens
tgtctattccctttgtgtttcacaaactagcttattcagatgatgtgaataccggctaattattgcaacgatgtttgcttccaagcattaaaaaaattgccagtgttatgggcaaggacttcatgactacaacaccaaaagcaatggcaagaaaagccaaaatagacaaatgggatctaagtaaactaaagagcttctgcacagcaaaagaaactaccatcagagtgaacaggcaacctacagaatgggagaaaatttttgcaatctacccatctgacaaagggctaatatccagaacctacaaagaacttaaacaaatttacaagaaaaaatcaaacaaccccatcaaaaagtgggcga

SEQ ID NO: 210913 - DNA, 164 bp, Homo sapiens
taacagtccttaaaaggggagatttgtgtgtgtttctgtttaagttctcaccaacaggaaagaggacagaagtgctaaggcactctggtctcagagtgcaatctgctagaaaagatctaatgaaaaacctactggaggagcccaaatctcagggtgcctattca

SEQ ID NO: 210914 - DNA, 598 bp, Homo sapiens
aaagaaaaaagaaaaaagtcgtaagagaaaatatatttcctatttatgcagtggaagcggatcaccataaagagcttcatcctcatggccttcaccttgagtgggctgaggaggaggacgaggggctggtcttgttgtcttgggtagcaggggtggaagaaaatccacgtgtccgtgatcatacatagctcactcctgtgttgctgaagggtcacctgtcatagaagagggaagaattgtgtggcctgtgcggattctgcattcagccttgtgtgttgtgttacggttaaccagggacgtgtgccccactaataactctgattcctggaaggaatggcatggcagcctccgttgtcatggttcctggagggaatggcatggcagcctccgttgtcatggttcctggaaggaatggcatggcagcctccgttgtcatggttcctggaaggaatggcatggcagcctccgttgccatggcaaggcaaagccatggcagcttcctggttatcactcctggcatgtggtaggtgcttgtccagtgaaatcctagtcgttgctgcattggcaggtgccctggcgtgaggaagggcaggcagtc

SEQ ID NO: 210915 - DNA, 567 bp, Homo sapiens
acactgttgttgaagccagatcgttgccccagggcacttcagctcagaaagctgaactcattgctttaattcgggccttagaactcagtgaaggtgactcttaaatttgagaaacattggaatagtggattaattcggagtagcggtttttgtgatccacagatgaagcacagagaaaaggatagagatggagacacaaaaacattgatctcccaagctgtagagactgggtctcctttgggaatatctacaactaccaactgcacaacaaagtagtaagtgcagcttcgaatttgtcttgtggtaggccacgatcctgtgcccacaaggacagtgcacaggtcatccgagcacacggctgagcccggtaggcaaaggaaggaaggtccaggtcacagggcagcgaggcccagcacaatgaaggagaatggaaacacaccacacctcaattagaatgggatccaattcttttacaaaaatttttttctgattacaaaatttaagggaaaaagggaaagttcttccttcctacagactgacatgtaataaatggagatggaacacaca

SEQ ID NO: 210916 - DNA, 386 bp, Homo sapiens
ccagtcttaggtatgtctttatcaggagcttgaaaacggactactacgcacacgttaattatataattaaaattcatggcaataataactcaagacacagagattggctgggcgcggtggctcacgcctgcaatgccagcactttgagagggtgaggcgggaggattacaaggtcaggagattgagaccatcctggctaacacggtgaaaccccatctctactaaaaatacaaaaagttatccgggagtggtggcaggcccctgcagtcccagctactcagaaggctgaggcaggagaatggcgtgtacccgggaggcggagcttgcagtgagccgagatcatgccagggcactccagcccgggcgacagagcgagactccatctc

SEQ ID NO: 210917 - DNA, 260 bp, Homo sapiens
ctttttttccatgtaacattaaatacattgtgcatttttaattcaaatcaaatacatatatgactgtccattttacaaggctcttatgcagaaatttttattaaaaacaagcattaatgtcatatttatttataaagtttattatatttattagaattaaaataatgctataaatctctgctaatttaaaaattactaaaattttctttttagcacttattttcaaaggacctctcaaagattattgaaagtgaattaca

SEQ ID NO: 210918 - DNA, 900 bp, Homo sapiens
atggcacaatcacagctcgctgcaatgttgaactcccgggttcaagggatcctcccacctcagcctccagagtaatggagactacaggctcatgccaccatgcccagctatttttaaaactttgtagagatggggccttgctacattgcccaggctggtcttgaactcctgggctcaagtgatctgcctgcctttgcctcccaaagtgctgttattacaggtgtgagcccctgcgcctaaccttagcactgccattttgactgaaaacaggtgcccagcagcaggggctactcccagaattgccactgcatcaggcccgtgggttgttttcagctgccagtgataagtatgtgccctgggccacctctcggacaaggtgtctgaattggtgccgaccagcatcacatgtaattgccatctcgcaggtgctgctgagggtaattccgcacacctgtagctccgggaagagcctagtggggaggaggaaacgtggctctgaggtttatagggtcagacggtcagtatgttgggagctggcatgtggaggggcacagacaagggaagaatgggaggtggcatcagagcaagttttgatggaggaataggaattcaccaggtggaaagggcattcctggtggagggaacagcctggccttcaatagcttgtggtgttcagaaagcaggcagggaaagggaggcccagggagacaccagttaggggatgggggtggaggcagacgagggtggaggaagccatggctggagtctgcacggcctctgactggggtccctgctgtggtcagccctgtgctgggtgaggctggggtcacagctggttcaggccctgacaggaggggcccccagctgaggcccagcctctaatttggcagggcaggtgga

SEQ ID NO: 210919 - DNA, 699 bp, Homo sapiens
atggcacaatcacagctcgctgcaatgttgaactcccgggttcaagggatcctcccacctcagcctccagagtaatggagactacaggctcatgccaccatgcccagctatttttaaaactttgtagagatggggccttgctacattgcccaggctggtcttgaactcctgggctcaagtgatctgcctgcctttgcctcccaaagtgctgttattacaggtgtgagcccctgcgcctaaccttagcactgccattttgactgaaaacaggtgcccagcagcaggggctactcccagaattgccactgcatcaggcccgtgggttgttttcactggcatgtggaggggcacagacaagggaagaatgggaggtggcatcagagcaagttttgatggaggaataggaattcaccaggtggaaagggcattcctggtggagggaacagcctggccttcaatagcttgtggtgttcagaaagcaggcagggaaagggaggcccagggagacaccagttaggggatgggggtggaggcagacgagggtggaggaagccatggctggagtctgcacggcctctgactggggtccctgctgtggtcagccctgtgctgggtgaggctggggtcacagctggttcaggccctgacaggaggggcccccagctgaggcccagcctctaatttggcagggcaggtgga

SEQ ID NO: 210920 - DNA, 479 bp, Homo sapiens
gaggacttgggtcatggggcggcagccccaccatctcctcatccagcttcccagggttcagtccagggtccacctccacagaggatcgcagcccctccatgacactgcagtcccacacggccaatagtgggactgagatcactgttttaacttggtcaatcaagtcagcttcaactgaaattaaaccattaaagatactctgctacttctctgagaaccttgccctgggaatcttgttaaaatgcagattctgatttcctttctcagggaagaggcctgataacctgcatttctaagaagctccaaggtgctgccacagggctctgcctagtaaccatggattccacagccacaacagacaccagagaacaccccaccattctgcctgtactcaatcagcagtgggcatcctggattggttaattttatgatcacttagagggagaaatttgtaaataaaatctacttgtctcaaaaaa

SEQ ID NO: 210921 - DNA, 442 bp, Homo sapiens
cagagccttaaaaatggactttattaattattttctataattttgcttaattctttaaagtaaactcttattgacttggatctaaatagtttgtgaatacaaagtctgaggaaaaaagtgtttgctaaaaataaaaacaacacttgaatgatgtttgtaaggcagttttaatttcttagaaaagctgaacaaatggcacaatgcaaagagcagaagttttggaataaatagattgaagccattaaattattggataaaaatagtttcaggttgcttttggcctaggttctcccctccccccatcactatccacttcaggaataaacattctgaaagttaattttacccatatagtgagcacttatttctaagttgccttatcaaataccatctatgttatgtcatttaatctcgcagttacttgtgcatcagagattagcat

SEQ ID NO: 210922 - DNA, 633 bp, Homo sapiens
ccaaagcccagagtcactgttaatgtattaagaaattattatcattaatgtcacgtcaaagtgagtttgttaaggataagtctataacctgaagggttgaatgcagaatgcgtgggtgtgataccactagagaaaagtaaaatgagtttcttaaatgtgttgtgtgtgtgtgtgcatttgtgtacaattattatataatcatgaactaataagacaaagtctttcctacacaatgggaagggtacacacataaaatttggtattctgatatgtactcataggtatttttctctttgttatagttaagggattttcctgcacactcatttgtggaggctatgaaaataaaatccatccttagggctattgtgtaagatctataattcacaacttctgatatttttaactcttcaaaggcaaatgacttctggaattcatttcttaggttacagagtaggattgataggtggacaggtatcatgggaggagaaaatgcccagctcaaaagattgaatgagagttggcaataggaccagcacttatttaagcatatgggcctctgagtgaccttgagaattctgaatgactttttacaacatgatgatgacatttgaaatgctttccaagaaatgc

SEQ ID NO: 210923 - DNA, 905 bp, Homo sapiens
tacttgttagcttaaaggtgcaatattatctagcagcaacgctggttgctgctagttctgggagaagccctcagaactaacacttgaaaaatgaataagactttgtcactaatccaacttcaaatggatcaaatgattcaaaattacaaaaatactaatcattttaggctcaatctttagctggaaaatagagataattcacgtgtactgttcaacaagcaattattcatatagtctctcaagtactcaattctaaccaagaacatggtgtcctgtggtgtctacagtagaataaacagtaaagccttgtacttcaataatagatcctccaggggaaaaaattattctaagtggatttatgtgtagagatggttttaagtgatgttcctatctctttagcactaaatcagtggcagtaactattgaggaggaagcaagaaagaagccaagatccacagtggctgcttccaagttgcatatggactagttgcttgtggcagggagagacatgggttccgaaatccagtctgttctttggaggggcctgaccatggctgtgactccacggtgctattctagatagattaattcagactttgcttggttttgcatcctaagattgcgttatagaaagaggagaatgaaggccaggcacggtggttcacgcctgtaatcccggcacttgggaggccaaggcgggcggatcacaaggccaggagatggagaccatcctggctaacacggtgaaaccccgtctttttactaaaaatacaaaaaattagccaagcgttgtggcaggtgcctgtagtcccagctactcaggaggctaagtcaggagaatggcgtgaacctgggagtcagaggttgccgtgagccaagatcgcgccactgcactccagcctggg

SEQ ID NO: 210924 - DNA, 430 bp, Homo sapiens
tgattggggtgtgatggggaatgtacccaaattgcagatgtggaggagcaagccagggaaagaaagggagaaaggagtctcagcttgggggagcgggtatcacagctgagagggcagagagaatcttcatttatccagggactccaatttcactcatttcccggtgtcccttgggctccatacgggacccagtctgtccttagggagggagggctgtgtctgcccccgccctgctgtcatggggctccacttgtaatgaaggggagacagtcaagaaagtaaacctatggttgagatgatttctgggctgggcacggtagttcacacctctaatcccggcattttgggaggccgaggtgggaggatcacttgaggtcaggagttgttagagaccagcctgggcaacatagtgagatcctgcctctattga

SEQ ID NO: 210925 - DNA, 574 bp, Homo sapiens
ctgttcttattccgaggatcagggcaggtgctttcacagctcgcacacgtacttgtttttctgtggctcccctacttggtgtggggcatctgctgggcctgccactgctcccccttcctctagatgcttcttgggcttctctgactgctgggtcaggagtgtgtttagctccacgacgaaaggtaccctctttctgcaggacactcacaccatcaaggctgacgagggctgaccgggttccagagtccttgtgggtccgggttgatgctcatgagttctagttgagcttgtggtaggttgcttccctgtgctctccctccatgccttcttcccatggatctgtcccttcctaactctctgcccagtggacttctaactccagcatcagaagtgaagaaaacagcttcacacagtttaaccagctctacaattaagtaagctcaaatccctgtaaactgtgtgtgtatacatcatggttttgcttctctttgaaccctgacacagatagatagatataaacgggttgaaagcttgaatccaatgaaaacattacctttcattggtaaggtctcat

SEQ ID NO: 210926 - DNA, 516 bp, Homo sapiens
gaggtgctgactaagcggctgttcatcatagcaaggtgcgttatcagtcccagttcctcaagtaattaatcccccccatgaagcttttttgttcacagcgagtgttaactgtgaccgctcctccaccatccggacagtgaaacttactctcatttttctggagggtaaaacagaggcagagagagttgaaatgctttgcccagaagccctgcaagcagagagtgctggaactagaattcccagacctggactctcgagtttattgcttaccttctttaagtcatgttcttcttcccccatagctcaattaaaaacaaaataagacaaaacaaaaagcaatgtttcctgaacagaaaagcacagagccagttaggacaaaagtcgatttgttgtggctggattgggtttctcctgcctcagacggctcaaatgctttcacaaatggttttaaaataaattgggagataaggtaacaatagagtttctcaataatgatgacaataaaaagaaaacaag

SEQ ID NO: 210927 - DNA, 432 bp, Homo sapiens
aacataactctaaccatgacaaaatatgatctagccacattaagaaacattctattaaaaaaactagcctgcaatttccaaaagtatacaaatcattaaaatcatggaaaggctaaggaactattggagattgatggaaacttaaagagatctgacaacaaaatacaaagtaccattctgaactggaaccttgggttttaaaatatgttttgggggcaactggaaaatctctaatggtattcaaacattagatagcagtaatttatctatatcaaattttttgatgttgagtgttgtggttagtagagaatgtcctttttatagaaaatactgaaatattcagaatgggacggcatcatatcagcaatgtactctcaaaggttcaggaggaaaacgttagtttactggcatatcaactcttttgttagtctg

SEQ ID NO: 210928 - DNA, 532 bp, Homo sapiens
agttgctacctaatatgttagtttccccaaataaacacttatttaaaggttcatttgttaatcaagtatctggaacttgaaatacatttttatgaaaggaaatacattttaggtgatgattaggtttttatcaagagctgaagtttttaataatgaacagggagagatactgtggcaaaacagtaattgaataaaacatacattcaataaaatgatatgaaaaatcaatgtttcacatttatcctgagtcaaatatagagagaattaaattgaggacgacaaagtgtagtttctaatcattgttccaccactatttgaccttgagcaaattgcctggagaccatatttggtagacagatgaggatgtacactttcttttaaatacttgagaattagcttaagtgctctcatttgacaacttgctcagtatttcataaatgccaggaaattagctcaaatcctctgatgagctgcattttctgtgttcaatttgtataaattcaataaatatttattgagggtcttccatatg

SEQ ID NO: 210929 - DNA, 365 bp, Homo sapiens
ctcattttagcagaaattggcttacattataatagatgtgcctatttataattctgagagactccctaaggagaatcatattgaactagatggcatttttaccagacggaattcgtttccacagaaataaaagtgaatgttaatgtgtatgactccaatcatagtcacattaataatttcaaaacatttttaacaaacaataataaaaaatgtttacccatcttctcatgccgggtcaatagtaaatctagaaatctttcatcactgattcaaaatctttaatatgaaacagcatcaatgtggacaaaagtagaaattttcagcattgaaagtgctggtataaatgcaaacatcaaaatatagtt

SEQ ID NO: 210930 - DNA, 855 bp, Homo sapiens
agaaaagaaaatggaagaaggttactggagaatctcagagcgtggtcagggcaggcctttctaaggaagtgacagggacaggggcagaaagggctgcagacaccaaaggggcccagcctggaagtgtgagtgtgaattggtgggaagccttgcttttcaggccttctctcatatgtgccttccccccagctttcgtgccttttccagctcaaaatgctcctccagcctgcaggcaaccgcagcccccgctccgtcccagggactctcatcttagctccactgttctgagataagcctgaggctcctgggccaatcctgcccccaggggctcattcctcaaattcaggacacagctgccagggaaggaatcaggctcaaaagactagagacttagagatagcccagggtttctttgcctcattttctttcctctttttttttttggttgttgttgttttgagacagagtcttattctgtcacccatgttggagtgcagtggcgcgatctcggctcactgcaacctccacctctcagattcaagctattcttctgcctcagcctcccgagtagctgagctaacaggcacccgccactgcacccggctaatttttgtatttttagtagagatggggtttcgctatgttggccaggctggtctcgaactcctgacctcaagtgatctgccagcctcggcctcccaaagtgctgggattacaggcgtgaaccaccgcacctggctgctttgcctcattttctgattttccggtgttgttggacctctggcgcccctgctcaggactcagctgcctgggtctccctggggctgtcaagagctgccccagcgttcccctgcc

SEQ ID NO: 210931 - DNA, 181 bp, Homo sapiens
agaggtgtgtgcagatatgaggactcaaaatgcaaatgggacattttacctattcctcgattttatatgaaaatcttggaataaagagttaaagtatgcaaagatattattatctttagagaaacaacagatacagtgtgaaataggatataaaactggcatgcgttttcaactgagtgtg

SEQ ID NO: 210932 - DNA, 575 bp, Homo sapiens
tgatggcttcaggagctgtagtgtttatcagatttgctccatgggtggccaaagctgggtgatggggtctcaatggccaggactgggcgccccaggaacctcaggcctttctgcatcagcacagatgcttatccattgacttccagtcacttgtgacctcggggtaaaggaacatgaattaagaaaacctcaggctcagtttttccccaaagtatgttgcatggaatacagtttcatgggttgtcataggtcttctgcaaaaaataaaggagtttcgtgaacagacacgtttggaagcttgtgacttaaacagagttaagtgggcttcaccgctgagtgcaacgtggtctccccagcatctttacaatgctgtgttcattacaaatatgtatatgagaaaggggcatttcccaaaccggtgcttctgcagatgggtttgctatgctaggttacccacactggagcaacagcctttccaggggaggattgcttgagcccaggagttcgaggccacagtgacctgtggttgcaccattgtgccctagcctgggcaacagagacagacccggtctcga

SEQ ID NO: 210933 - DNA, 567 bp, Homo sapiens
cctggagaactggacaagtgtcaggcttgggcagctgcaagcctgcatgttccctgccagctctgctgtccccagccaggccatagcgacagtcctctttcgtctatacttcctttctacagctgtggaagtaaagcactgatagctgcctttaagggtttgtttgggtgggaggagggggttatgaaatgaaggtatttgtgaaccgtcctataaactttataaactctctggtatttggtagaggctcaataaatgtcatggtccccacccttcaccctccagcctttccacctatataaatgcaggatctcatttaatcctggttcttaaagtgtcctgtgaagcttagtgtgccagccggctattgctctggcctgacattctgcccccaaattgtgtgtgtgtttgtgtgtgtgagtgcacgtgtgtgtgtgtgtttagatcttttacaagggggaaagtgttcattatgtctaatataaaatacagaagctttgcagcagtggcagtatcgtagccaatgaggtctatccgaggcgcgattattgctaattgaaaaaaaaa

SEQ ID NO: 210934 - DNA, 360 bp, Homo sapiens
tgttgctggaggagtcctgaactccttagctcaagtgatcctcatgcctcagccttttacaaagtgctgtgattacaggtgtgagctaccgtaactggccagtaaatgaaatcttgtccttttatttatatgggtcctacgtttcctgttaaatttattcctagttattttatattttgtttttgattgttgtagtgaatagacttcttaaattgtatcttgtaactagtacttacttattatggaaaagctgttgggtttttcacatttattagtgggcttatgaagcccatttactgaattgcctgaaaatggaaccgatgttacttgcatttgttttgtgaacaaaggaaaaaaaaa

SEQ ID NO: 210935 - DNA, 520 bp, Homo sapiens
tatcgtggcaggcccgcggtggtggagagaggggcagctttctgcagacccaacagtctgttttgttctggagagagatcactatctgtacccagtccgcaaagaggtttgctgtgcaccatctatgggcaaaaggtgagatgtttagtgggtacaagaaagggcaagtcatggccatttaacaagacacaggaagttgtgtcattctgagagagcgccacccctgaccatggccaggtgcctggtttacgataccaaatggattgccccgctctgccacatgttatgggaggtcagagtaagacctgggggtatcataatgttccgtaatgagaggatgatcatccccttgcacaaagggaggaccaggattcattattttagaagtatgaggaagagtagggtgtaaagtgggtgtgacctgtatatcctattccaggcccttcccccatggagcagaaaaaccaaaccatcagggactggtttgccattttcagggccatgtaatgatgtgcttgct

SEQ ID NO: 210936 - DNA, 586 bp, Homo sapiens
agcctgggcaacatgacgaaactccatctctattttaaaaaatgaaaaagaaattttaaataagtaataaaaaataaaatttaaaaaaaaatggcctccagttccattcaagtagttgcaaaaggtattattttgtttttgtttatggctgagtagtattccatggtgtatatatatatttcttttatctactcatcacctggtgggcacttaggttagtgacacatctttgaaattgtgaattgtgctacagtaaacatatgcatgcaggtgtctttttgatataatgacttcttttcctttgggtagatatccagtagtgtaattgctggatcgaatggtaggtatacttttagttctctgagaaatctccatattccatacttgagaaatttttcatagagattatgctaatttacattcccacctgcagtgtataattgttcccttttcaccacattcacaccaacatatattgttttttgactttttaataatggccattctggctgggtaaggtggcagatatctcattgtggttttaatatgcatttacctgatgattagtgatgttgagcattttttc

SEQ ID NO: 210937 - DNA, 754 bp, Homo sapiens
cttcctcacagatggccatcttctcactctaacaaaacagcaaggaatctctcaggcctcttcaaaaatggcattaatccgtcaatcccattcatgagggctcctccccagtggcctaatcaccccccaattctccacctcctaaaaccatcaccttaaggaccaggatgtcagattgttttgttttagagacagagtcttgccctgtcacccagactggagtgcagtggcacagtcacagctcactgcagcctcaacctcctgggctcaaaggatcctcctgctcctgtgtgtaaatctcccacctgctgagagaagccagctccccaaaccacatgcacatcagactctatctccagattccatgtgaaatccaccaaacgtgggccacccaggcggtggagcaccgaaggagacacacatgaggaagacacaggaaggggctctgtgtcacctgggactggctctgggaggatgctgcagcattggctctcagggacacagagcaggcagggacaccctctgggacagggacaggacagttagagtgtggaaagatggggagggcagaggacacaccacacagaagtgtggtacaggcaaaggcatcgagagagaccctcccagggcaggaggggacagaaatggtccagacagaaagacagcctggagggagccagccacactgatgatgatggataacatctgtggaaggtttggaaacaggaaatgacaagagcaaaaaataaaaaat

SEQ ID NO: 210938 - DNA, 398 bp, Homo sapiens
agcgggacgatcctgcatctgcgtaatgtgcacagggccagcctcttaatgctactagagctttctgctctttaaaacacgcataaaagcaagctcttgtcccggggtcatggcaagagaatttgctttcggcttgaatcttctgagctgatggactgtggtggcagtaacagggcaaatacttatccttacataagtaacacactttcaaatagtatgtttttgtggaaagaatgcgtactgtttgccataataggaagtaattactctaagtagcgtggaaagaggaactcttggcttatataagagatgtctgaatattcagggcagttccttgttgtatagactgtgtctactaatgttctatcatcattatcattaccatgtctacagaaaag

SEQ ID NO: 210939 - DNA, 148 bp, Homo sapiens
atatccagtatgaccaaatttgttaaacataggttttcttctatgcataaagatattttgaaatggtattttaaaatgtaaaattaaagcaggaaattattccagttgatagttttcccaaaacagttttgcaacagcatattgagct

SEQ ID NO: 210940 - DNA, 322 bp, Homo sapiens
tgctcaaaaagttccaaattttggagcatcttggattaaggatactcatcctgtggtggtagtagtagtagtattgctgttggaaatgggagttggtggtttttggagattgcccttcagcctttcgtaagaaggagtttgcttttttttgagacggagtttcactcttgttgcccatgctggagtgcaatggtgcgatcttggcttactgcaacctctgcctcccaggttcaagcaattttccttcctcagcctggcgggagaagtttgttaaactttccgaaccccctagtgaaggacctctaaagaaatatgcaacagg

SEQ ID NO: 210941 - DNA, 334 bp, Homo sapiens
cataatgtcctcaaggttaatccatgttgttgtgtcaattttcttcctttgtaaggcaggataatatcccattgtgtgtatataccgcatcttgtttatccagtcatctgtcagggacactgggttgcttccaccttttggctcctgtgaatagtgctgccatgaacatggctatctcactgtctcttttagcatcatatcccatcagtcaccaaattctggtatatcctcctctctcccttgcactgctaaggctcgggccctcatcctttctcacctggactgtggcagaagcttcctaacaaccaccttactttcccttccagtctgtcac

SEQ ID NO: 210942 - DNA, 852 bp, Homo sapiens
atgggactggcaggaggtggctggggttacgctgtcttttctaacattcagcattggctcaggggccaggtcagggctcacagactgttgctataaagggctgggtggctttcttccccacagctactcagcctaatgccattgcagagcacatgtagccatggacaacacaaggggcgtatccgtgttccaggacagccatattgacaggaataggcaggaggccagatttggtcctcaggctgtaatttcttggccccttgtctagggagaggtaaacgaggggaggagagatcagtcaaggatgacgtgagggtttgctgggagcaccaggaatcctggagaaggtagtggcaagagggtgcagcaagctcagctgggcggggatcaagtctgaggacttaatgtctcctctgatctccagacccataagggagatgctgagtagacaactggggcttatgggtctggagttcagaggagagatcgggaaggtgtccatttggagtcatccacgcagagatgtgtgaaggctgctcaatgattttgaggtttaaagaaaaaaagagatgtgaaaccaggggccctgatgaggctgcccaggtggtaaggaagacagaagagaagccatgggacagctgagcccgggcaccctcaagccttggaggcatgaagtttggtggggatctggcaaagaacacctgggagcagccagcgggcagcagaccccagagtagcagggaagacaagcacttcaaagaggcagcgtcagccaggggcagtggctcagctgtaatcctagcactttgggaggccaaggatggcagatcacctgaggttaggggttcgaga

SEQ ID NO: 210943 - DNA, 818 bp, Homo sapiens
ctattgtcaaataaaaacaatacggagggctgggcgacctgcacattcagtcccttagaaccagaagcttgagcagcccagaggccagtgcagaccctgcttgcctggcgctttgctgtgacctctgcttgacaatgcttgctgccttggagctgacgggctctcgtccagctcagctggggcacaaaaccgtgtagctttgtctaattaagagccacagatgaagtgcaccttggatgtgtttcttattatttcggatgaaaggttggcctctccagaaatcacccccaagattactgtgcctcaaacctcgcttgttccagccgatagggaaatgacgttttaacgatcatgttaaatgaaactgtaagcttgaccttattagctgcctcttcttaattagctgcttatgcaagcattctttcccccctgtagatacaaatcaacaatttccaagccatctttgaaccaacccactcttctgtccccttgccaattccctagctccagggttaataaacttcacatatgctcaagagcaattgcgttaagaaatgttgcttccacgtaattactagcaaagtgcagcatcagcagccattcatccctcacacatgtgcaaatttactgcagggtacattcctaggagtgtgtgtcatggaggacggcttggcagctagcattctgtgtgctctcctcgctgttccttcaaaggctggaaggtgagccactgcttttcccgcttcccttgccgctagagttctaaatgtgaaatgggttatgcccggtggtcaatgtttaacaaccagctctcaaaa

SEQ ID NO: 210944 - DNA, 825 bp, Homo sapiens
gagtctatagagtcgatacagcacggtatggagggttgggagaggggacattcatataacttagagactggaggcttgagcagcccagaggccagtgcagaccctgcttgcctggcgctttgctgtgacctctgcttgacaatgcttgctgccttggagctgacgggctctcgtccagctcagctggggcacaaaaccgtgtagctttgtctaattaagagccacagatgaagtgcaccttggatgtgtttcttattatttcggatgaaaggttggcctctccagaaatcacccccaagattactgtgcctcaaacctcgcttgttccagccgatagggaaatgacgttttaacgatcatgttaaatgaaactgtaagcttgaccttattagctgcctcttcttaattagctgcttatgcaagcattctttcccccctgtagatacaaatcaacaatttccaagccatctttgaaccaacccactcttctgtccccttgccaattccctagctccagggttaataaacttcacatatgctcaagagcaattgcgttaagaaatgttgcttccacgtaattactagcaaagtgcagcatcagcagccattcatccctcacacatgtgcaaatttactgcagggtacattcctaggagtgtgtgtcatggaggacggcttggcagctagcattctgtgtgctctcctcgctgttccttcaaaggctggaaggtgagccactgcttttcccgcttcccttgccgctagagttctaaatgtgaaatgggttatgcccggtggtcaatgtttaacaaccagctctcaaaa

SEQ ID NO: 210945 - DNA, 370 bp, Homo sapiens
tgaatgttcacagctgtgttttttattaaagaaattcagtgagaagagttttaacgtcgcactatagttgagaatcttaaggtgtataacattggcaattccaaattagagctcccctggcaactgtcactctatgacatcacattttatctaatgaggcataaaaatgtacattgtgcactccgcagctccttaatgtgcatggggaatgagagtcaaggggagattgggagccatctctttgaattcttagctgtaatgtttcacctatgcagttttctttatttgcagctatattttccacttctcataattcagtaattccaaggcattgcagaccctataaatgccatgcagatattggttaatt

SEQ ID NO: 210946 - DNA, 542 bp, Homo sapiens
aggttaaagcataagtttgcttagctatgctgtgactataatcactcctgtctcttaaagacttgatttgtttcttctgtacttaatgtgctattcaattcacacagaatatctgtcacttattataataagtagttttagcctttaggactaaggctgagaattttgttaactgccaagagcatacgttagagaaaatagctcagtatctgctttctttaaaagaaaaaattactttgtatactcatttaaattgttacttataacttgttactaaaaataacaattataatgtacttaccataacatttataaatatctctagagttttgtaatgtcatagaagcaccaaaaaagaatgataaatagggtggatcaccaaacagtaaaggaaagccagagacaataaaacatattgacaaaaatgctggcaatattgcaagaagtgaaagaaataacagtaggaaagagtgatggaagtgctcaatgatgatgaaatatttctttcttatatttcaggaatgggatgtaaaaagatgaac

SEQ ID NO: 210947 - DNA, 417 bp, Homo sapiens
tggtgggaggaggagtattgaggagtgggcacaggtgaaaccccatcgcgacggccaccattacaacatcaccccttgaacccttaagttacattaatatctaagcctgacttggctttatagttaacaacattgagtatgtctgattacaaaagaacaaacaatttgggggcagatgttctctaactggtgtgagcagaagtttcacttgtagggatggatgggttacatgttcaaaatacagatctctaagccttcatccggaattttctgattcagaagatctagggtagtgatgctaagccaaggacgattttgcctaccaggggacattgggcagtatctggagacagtttgcattgtcacaacggaagcctgggatgttcctaaacatcctacattgaacaggacagcccc

SEQ ID NO: 210948 - DNA, 410 bp, Homo sapiens
tgcacaactattgaaatattgactatggttgccgtcatacatgttatattgctcacaacattgatttgactttggaacatgtttgtgtcccagggaacaggtctatgcctcctttggctttggctttctgcagccaaatctccatggccatagggttttcaggcctctgcttatatccttaagatagtctcaggctgagagccaaaaactttgtgggggaaagttaggtcattaactagcaggagttttgaaaacagttctcccaacctaagaaagtgtgattataaatactattctagaacagtttacatgcctgcatcctgatagagattaggcctttgtgtgtttttaagactacagtctcacttaatgatatatttgtttttaataaaactcggtaaatatattat

SEQ ID NO: 210949 - DNA, 536 bp, Homo sapiens
tgcacttgagttttctcatgttcgtttttgtggtatcgagtattttataatattcttaatttaattgcattctcttcagtcaatatagcaaagtccaaatacaatagcagaaattttgtttgttttacttgaggaaagggttgttctgtcttcaattttatgggtctattttgccttgcaggacactaaatatttcccctttttcttcttttacccttcaccactcagttgttaaagcatgcttctctcttcctttttgctttttctttcctctgcgtttcaacaaatgcttatttaacacttgtctttttaaattgcacctgctgtcttaaaccgtgccttctgctttaaattaaatgtactttaaaatctcttccctgtagtctgtgctctgatctgcccagatacttttccagtgttttcagatacggtgtggatttaatctttctgggagtcactccaaatcatttttagcccccttcactagcctttctcctctgtcttttctgcagtttttcttagtctgcctttgcttg

SEQ ID NO: 210950 - DNA, 328 bp, Homo sapiens
ctaaatggtgcaaatctcgcctttcatcagcagacatctgcagaggggcccctgcgtgctggatccaagccgagtgctgcaaggaccagagaaaccccagcacggcagctgcctgtgtgggctcccaggccagctcaggagcccgatgtgggccatgaacacttacgtcataaagcacaggttaaatggatgcttaatatcctacagaagcagggacagtgcacacgtgtctcatggcccaactgagagtacaaactgaagacattacagaaaaggggccgaagtcctgagctcggaggaccctgacggtgtccctctcagaggaagg

SEQ ID NO: 210951 - DNA, 152 bp, Homo sapiens
gaagctttgttgactgaggagcttctcccagacatatagatctgtaatactaaattgcttacttactgtcttctaatgttaatttgttttgcattagagctgtccacagtttggcaaagacaataacttgaattaaaaccaattttaaccta

SEQ ID NO: 210952 - DNA, 415 bp, Homo sapiens
tcatttttgcgggttttatatgaggtttctgtgacctattaaattaagaaagattagtgggggcagaacatatatttttgtgcagaaaaagaataaggaaatatttaaatggttttaaaaagtatattaggctgggtgtggtggctcacacctgtaatcccagcactttgggaggctgaggcaggcggatcacaaggttaggagattaagaccatcctggctaacacagtgaaaccccgtctctactaaaaatacaaaagaaaaattagccgggtgtggtggcgggcacctgtagtcccagctacttgggaggctgaggcaggagaatggtgtgaacccgggaggcagagcttgtagtgagccgagattgcgccactgcactccagcctggacgacagagcgagaccctgtctca

SEQ ID NO: 210953 - DNA, 242 bp, Homo sapiens
tgtttccctgggttctggagatgggtggagagcaggcactgtccctccaggggctgtggtccgtgtctttctgaacctgcaccagggaggtgcccgggagagcacggtgagctggaggctcctccatggggctgtttggaatccacagtactgggtctcagattacatgtgttaccctcagttctttctcagctgccagggagaaaggggaagtgggccgggcagggctgggtaccgagctc

SEQ ID NO: 210954 - DNA, 679 bp, Homo sapiens
cacacccacacacatacacacacacacgtgcgcatgcactccaagtgccagaagacaactgctaacatgtttggctgacaaaggaggaagagtccttcttggggatgtgtcagagcaggagtgaagctatttggggtcacgttctaaaagctgaatggatttctggatccgtgcttcctgtctattttcagccaaatgccaacccatttaaaatagcatgtttactcacaggttctcctctacactcaagtcaagaaaaacgtttaccccccacgcttcctcccccaactcattaagcacttctgcttttccctgccttcagaccgccaccacccgttcagcgtgacttccttctgaggcagtggttctcagacttcaaggcatactagaatcacctggaaagttttaatactctctaccctataccagttacatcagagcgtctagaagcaggactaaggcacctgtatttttcgaaacttcccaagggatcccaaggtgcagccactatgaaaagcatgctttggacctgccagggcagcaagagcttaaattaaagggatggttctcatccttctcaagctcaagagaaccactagggaagggacctggggcaatagaagcgtttctgcctccagcccagggatttggtatgcaagcctgaaagttggaaaggaag

SEQ ID NO: 210955 - DNA, 502 bp, Homo sapiens
cacttcccacagggcctttgaaccgtttacctaagtcaagtgtaatgagaaacataaccaaatgcaccatggggtttattgttagataataaaaggcttaaaaagcccctagaccctaaagatgcctgggatggatgatttatgttcatatgctacttgagcatgtagttttggagtgcatggtgaggcccatggctaatggcagtggtgctattcaacaagattctgggtctttagaatagttcaaagttttaccacttctctctggataagccatctttttgacctttgagtaaattataaacttcttttcagattgtgtccaaatggtcacaggtactttgacagtttttactgtaactgccaataagtaatactcatctttaaaaagacatcattctggcagggcatggtggctcacgcctgtaatgccagccctttgggaggccgaggcgggcggatcatttgaggtcaggagttcgagaccagcctggccaacatg

SEQ ID NO: 210956 - DNA, 933 bp, Homo sapiens
ggcctggttaccgggagtggggcgcccctcctccttatcccctcccctcttccctgtcccctttcacagctggctgtagctggccaaggagttctcgattaaagaggaaggggcagtgctcacatttctgggcagggccgggctcattagccctctgagtcctttgaaccctctgggcccaccgacgcccctgcctccacccccacccccacccccaggcctccccacctatgagcaggcgctggcagcctctggggtacacgacgcacctccacccccctacaccagcctcaggaggcctcactgaagagctgctttcgagacccggctctccgaaccgtgcccctgattcataccggattccggaagccgctaggcctcatagacgccgaagctggacttggagtggggaatggtgggagtaggggtcatccggcccgaggcctgccctggcacacgcgtttccgccgcgtatggatatacacatgttttcggcaacgtgttcccgtgtcctggcccctcacgggcccccacactctcctgaccgtgagggcactggtcagttccgcccccgtggtaggcagacgcgcggggaaattcggacccaggagcccagccccggctgtgccatcttgtgtatgggcagatatgacctgacagccccctccagtgccacagggtacgcacacgcagagccccgcctgtgcacacgcgtgtcttcgtgcactccccgtgcggtacaggggcacttcgtaacccagggaaagggcggggggcatatttgcaagcgcgctcggtgcgggcaggctcgcattgcacccagggagctggagttgagctgttcccctaaataaaaacccttcggaaaggagaccaaaaaaagcagaaataatgcaaaaaataataatgaaatgaactgcgatcccgggcgca

SEQ ID NO: 210957 - DNA, 1317 bp, Homo sapiens
ttgcggaagtgcctcgcctggcttgctcaagtcctctcttctctttctctctccggaaacctggctgtagctggccaaggagttctcgattaaagaggaaggggcagtgctcacatttctgggcaggtgtctggaaaatatgaggggccacccctctctgctgctgctatatatggcattaaccacctgcctggatacttcacccagtgaggagacagaccaagaagtcttcctgggtcccccagaggcccagagcttcctgagtagccatacccggattccaagagccaaccactgggacctggagctgctcacaccagggaacctggaacgggagtgtctggaagagaggtgttcctgggaagaggccagggagtattttgaggacaacactctcacggagcgcttttgggagagctacatctacaatggcaaaggagggcgtggacgagtggatgtggccagcctggctgtggggctgacaggtggcatcctgctcattgtcctggccggcctgggagccttttggtatctgcgctggcgacagcaccgaggccagcagccctgtccccaagaggccgggctcattagccctctgagtcctttgaaccctctgggcccaccgacgcccctgcctccacccccacccccacccccaggcctccccacctatgagcaggcgctggcagcctctggggtacacgacgcacctccacccccctacaccagcctcaggaggcctcactgaagagctgctttcgagacccggctctccgaaccgtgcccctgattcataccggattccggaagccgctaggcctcatagacgccgaagctggacttggagtggggaatggtgggagtaggggtcatccggcccgaggcctgccctggcacacgcgtttccgccgcgtatggatatacacatgttttcggcaacgtgttcccgtgtcctggcccctcacgggcccccacactctcctgaccgtgagggcactggtcagttccgcccccgtggtaggcagacgcgcggggaaattcggacccaggagcccagccccggctgtgccatcttgtgtatgggcagatatgacctgacagccccctccagtgccacagggtacgcacacgcagagccccgcctgtgcacacgcgtgtcttcgtgcactccccgtgcggtacaggggcacttcgtaacccagggaaagggcggggggcatatttgcaagcgcgctcggtgcgggcaggctcgcattgcacccagggagctggagttgagctgttcccctaaataaaaacccttcggaaaggagacca

SEQ ID NO: 210958 - DNA, 508 bp, Homo sapiens
tctatacctgtggggaggttgcaggggtaggttctggccttcagctccctcctccttggtgtctcagaaatcaggatgggctagtttgggggtgtgaacctcccagctgaattcctgctttttccccttcttttccactccttccccctcaaggagcgcttttgggagagctacatctacaatggcaaaggaggtgagtgaggggctgaagccatcttgttctgtgcagctaaggtagtcccttcccagcgaggccaaaccaacgtcctccaccccaaattaggtacaagaatcgtctgccccccaattctgtgctctctgaagctggctgctaaaggagttccctcccttaagaccccagcttgcctgaggagccccccacaccttattttatttttaaatatttatttttgctttttttttttttttgagacagagtctcgctctgttgcccaggccggagtgcaatggtgcgatctcggctcactgcaagctccgcctcccgggt

SEQ ID NO: 210959 - DNA, 857 bp, Homo sapiens
  misc_feature (824)..(824): n is a, c, g, or t
  misc_feature (827)..(827): n is a, c, g, or t
  misc_feature (857)..(857): n is a, c, g, or t
ggcctggttaccgggagtggggcgcccctcctccttatcccctcccctcttccctgtcccctttcacagctggctgtagctggccaaggagttctcgattaaagaggaaggggcagtgctcacatttctgggcaggtgtctggaaaatatgaggggccacccctctctgctgctgctatatatggcattaaccacctgcctggatacttcacccagtgaggagacagaccaaggtgagtgttgggggaagtggcatccagacacttggcgttggcctccccctgactcaggaatgtctctagtccttcctcttccaggagtccaggacccagccccttcctccttcagacccaggaatctggattcccagcccctgctccttcctccaggaccccactgctttccatccccctatgactccagccctagggaccctccatttttctgtccctcatgtctttgggtccagaagtcttcctgggtcccccagaggcccagagcttcctgagtagccatacccggattccaagagccaaccactgggacctggagctgctcacaccagggaacctggaacgggagtgtctggaagagaggtgttcctgggaagaggccagggagtattttgaggacaacactctcacggagcgcttttgggagagctacatctacaatggcaaaggagggcgtggacgagtggatgtggccagcctggctgtggggctgacaggtggcatcctgctcattgtcctggccggcctgggagccttttggtatctgcgctggcgacagcaccgaggccagcagccctgtccccaagagcnggntcatagcctctgagtctttgaccttctggn

SEQ ID NO: 210960 - DNA, 1374 bp, Homo sapiens
ttgcggaagtgcctcgcctggcttgctcaagtcctctcttctctttctctctccggaaacctggctgtagctggccaaggagttctcgattaaagaggaaggggcagtgctcacatttctgggcaggtgtctggaaaatatgaggggccacccctctctgctgctgctatatatggcattaaccacctgcctggatacttcacccagtgaggagacagaccaagaagtcttcctgggtcccccagaggcccagagcttcctgagtagccatacccggattccaagagccaaccactgggacctggagctgctcacaccagggaacctggaacgggagtgtctggaagagaggtgttcctgggaagaggccagggagtattttgaggacaacactctcacggagcgcttttgggagagctacatctacaatggcaaaggagggcgtggacgagtggatgtggccagcctggctgtggggctgacaggtggcatcctgctcattgtcctggccggcctgggagccttttggtatctgcgctggcgacagcaccgaggccagcagccctgtccccaagaggccgggctcattagccctctgagtcctttgaaccctctgggcccaccgacgcccctgcctccacccccacccccacccccaggcctccccacctatgagcaggcgctggcagcctctggggtacacgacgcacctccacccccctacaccagcctcaggaggcctcactgaagagctgctttcgagacccggctctccgaaccgtgcccctgattcataccggattccggaagccgctaggcctcatagacgccgaagctggacttggagtggggaatggtgggagtaggggtcatccggcccgaggcctgccctggcacacgcgtttccgccgcgtatggatatacacatgttttcggcaacgtgttcccgtgtcctggcccctcacgggcccccacactctcctgaccgtgagggcactggtcagttccgcccccgtggtaggcagacgcgcggggaaattcggacccaggagcccagccccggctgtgccatcttgtgtatgggcagatatgacctgacagccccctccagtgccacagggtacgcacacgcagagccccgcctgtgcacacgcgtgtcttcgtgcactccccgtgcggtacaggggcacttcgtaacccagggaaagggcggggggcatatttgcaagcgcgctcggtgcgggcaggctcgcattgcacccagggagctggagttgagctgttcccctaaataaaaacccttcggaaaggagaccaaaaaaagcagaaataatgcaaaaaataataatgaaatgaactgcgatcccgggcgca

SEQ ID NO: 210961 - DNA, 362 bp, Homo sapiens
tttcagactgagtctcactctgtcacccaggctggagtgtagtggcgcaatctcggctcactgcaacctctgcgttctgggttcaagcgattctcctgtacaggcacgccaccaccacacccggctaatttttgtatttttagtagagatgaagttttgccttgttggccaggctggtctcgaactcctgggctcaagcagtctgcctgccttggcctctcaaagtgctaggattacaagcttgagccactgtgcctggccagcatcataattttaatgcaggataatccaacaggctgagaaacaacagacattaacatgtagtttgtctaagaaataccaatctcaccataaacttacag

SEQ ID NO: 210962 - DNA, 407 bp, Homo sapiens
gtatgatcaccaggcagtgttaagggctcatttgaggctaaaggttctgagttaaaagtgaggccagtcagcttggttttgtgcttttttttctccagccaccttcactttaggagtaggagaatagttgaatttacccagcttgtggttctgcaaagtgagtatgtccaagtgagagaggagcaagtgattataatgatggaccatggaacttaagctggtaaggagggaagagaggacttcacagggtgagaaacagtgaaaagatagtttgaagataggctgggtgcggtggctcacgcctgtaattcccagcactttgggaggctgaggcaggcgggtcatgaggtcaggagatcaagaccatcctggccaacatggtgaaaccctgtctctactaaaaatac

SEQ ID NO: 210963 - DNA, 355 bp, Homo sapiens
tatttccttgtcacccaagaaaggaagtcaagaatggatgtcaccctttagaagaaattagaaatcatgacctaaatgttcatcaaccacttccttagaataaaggatactagagaatagaaatcacaaataaataagagtctagagtgaaaagtaaaattcatttttatcaattttatggtacgttactaagcacagccagtaataaacaaatactgagtagagcatgaataaatcttcaactgtagcatgtgagctgtttggttaccacagttccccagaacttcttcccttctttctcaggatctacttctcttcatgctttgacgttaggcaaagattcacatcccaaaga

SEQ ID NO: 210964 - DNA, 533 bp, Homo sapiens
cagtaacgagaattacaccccatcctggcaatgaggtcagataccatcaatgggaggagagcttggagaagcctcagcaggtctgctggcagaggagactgcagggactccaggcttacagcagtgcaggagaactttcaagcactttggatcttgccaataccttgcaaaaacttgtccctagttacacaggtggatctctgctggaggatcttgccagtggtctggagcactcctgccccatgccccaccttgcctgctcttcagatgcggtggagataattcctgcagagggagtgggtatctcgcagctcctctgcaaacaatttctggtcactgaggaagatatcaggaaacaggaagggaaagtgaagacagtcagagagagactcgcaatagcactgattgcggatggactcgctaatgaggcagagaaagtgagagaccaagaaggctgtcctgaaaaacgctaagaaaaaaagggaagatagtgcagatgaaataaagtgtaatcctttattaacatctcaaaa

SEQ ID NO: 210965 - DNA, 224 bp, Homo sapiens
tcatcctgtttattttcttcctagtaccttttactgtttgaaattatttatttattcattgacttactgtttttgtgttacattagggaggctctatgaaagcagggatcttgctgagtgttcactgcttcatcccctaagtctagtataaaaatacgcccaataaatgggaatcacttgttgacttcccatgtcaattagtgcaagccacaggaacttgcaaa

SEQ ID NO: 210966 - DNA, 421 bp, Homo sapiens
tcttctctgctctttaactggcatagaagtggtaggaaggaaacccaagcaggtgtctcattggcatgccattgtggagtagagagaggcagtgttcatagaagtacagcagctgtgtggacttctgtcatggggagcagggcccagcagtcaggatatccttggggactggttcctggcatgagcaaattcttgagtaactgtaattctagctagatttctaaagacaagatcttcatacacagagaagctgggaagcagactgtatttcacctcaggggcctgtggttatagacttgaggaaacatgaggaaccagggtaacagcaaatgggacttatccttggatgccagagtatttggccagtgctactcactggtctggttagggctggtctggaagtcatgggcagaccccaggg

SEQ ID NO: 210967 - DNA, 365 bp, Homo sapiens
aggattcttgttttcttcattttttgacagtctctcctccccatcccataccctctgtcttatctgcccttaccccagtcatctttggcccggacttcctgacagccttctgctttccttactttcattcttgcctctggctgatgacctgcttttgttcagcctgtgaactaagaatggcttttacatttttaaagattgttaaaaaacaaaaaaacaaaaaaacacacaaagactatgtgagagacagtacatgccatccacaaaccctaaaatatagactatttggccctttacggaaaaagcttagcaactcttgctttaaatatgcaaagtacctatctataaacactccttttgggcac

SEQ ID NO: 210968 - DNA, 272 bp, Homo sapiens
gacaaaggatgtcagagaattccttccttctttcctccctcccttccttcctcttcctttccttcctttccttcccttccccttccttcccccctcctctccgcttccctcccctcccctcctctccacttcccttcccttccctcccctccttctctgtcatccaggctggagtgcagtggtgtccctctggaataaaggacttagacctacaatcagacaaactatgtcagagaatttcttttctttccttttcttttattttcccctcc

SEQ ID NO: 210969 - DNA, 565 bp, Homo sapiens
aactctttttactattaatgtttttttgtttttgtatatctagaattgtttccaaataagtatagaatgaaagaataaggcaaatttcattggtaaagaagctttgcagtgtataacttgagtaaatatatctaaatttttttcgatatatcatctgaatgatgtttaaaatctgtcatagattcatgtcacaagccattcctacccagtacactgcagtagcttctggaagcctttttacacctccactctttcagagttgtcatatgcaattaatattttcataatgtagctttcaaattgtgactaaaatgcacatgattaaaacaaatcaatgactactaattgttttttatggaaagtaagctcctcctgtctcagcttcagccattcactagccttcatctctaaatgcattcatttggactcctatagaaatttactagatagtcctttcttacccctaaatactgtgtctttaagaatatttaggttaaaatttttgacaagatcttttggctttcttccatgataaacagattactttcacctttttacaccacat

SEQ ID NO: 210970 - DNA, 356 bp, Homo sapiens
tttagaaaagtgctcctacggttttctttttcaaatgttgcctaaatatttatcttacacccagcctcttaagtaaataagaacctagcatgccaagcatggcatgggaagctcaagattctgggcctttttttacactacaaacttctcctgagaggtgggctttggaatcagattacctgggtctggaccccatccatgaccttgagcaaggttcttaaacccaccaaggctcgtttcctcacttacctaccttacagggtcattgggtggattcaatgaaatacagatatgaaagtttctaccacagaaccttacacaaaatcatctttaataagtgttagtttctccttctg

SEQ ID NO: 210971 - DNA, 330 bp, Homo sapiens
ttgtattattgccataatttttatgtaggtctaagacgattctaaaattaaaatgtttatttttaaaactttgcataagacaggtctgcattacaccttagcctgttaacccagggtgtctccaggaagtagacggggtgggggtggggagctgccacttcgagcccctactgtgtgcagggttaggggctggagagattgaggagaatgaaaggcacacgcttgccctcacagcgtttagagtccagcagggaagggcttttgatacttctataatatttgaatttttctcccacggacatgacctactttcaaaatctgattttttat

SEQ ID NO: 210972 - DNA, 412 bp, Homo sapiens
catatcaaatctttaaatataaaatctgtagagatttacttcttaaatgtcttatcaaagctaattctgtttatatttcctgggcctatagcacctagactagtgaagaaagtattcccacagtctgctgcatgcaagccaggctggaattaacaactatgaatttctaaagtaggaacaatcaatagtttataaaattaatacaaatacatataatatataaaagcaacagactatgctacattagcaaaaataagaaacaaaattaggtgtgtaaaacaaaacctaatattcttgtataaacataccaggactgttattttatacagacaagtactgttacaagaccaaacacaaactgctaatggattaaaatttaattaaaatgtattagatatttaatatgacatag

SEQ ID NO: 210973 - DNA, 506 bp, Homo sapiens
ttctggtacccagtaaatatttcattacttaatatactctcccccctgctcctgcgaacctcactccatcctaagaacaatcttcgcatctgcctttctggactttctgctatgaactaaatatttattcaccagagaaactgctgtatactaggtgttatgaaatataattttttttatatcaaagacattgtataattacatgaagaccaatggagtaattcatcttaattctaagtattagaaaagctttgttttccttgaagaatggacatatttttttccttctaaaacaatgtaagcaaatgaccttctcattttggttgccagaatgctcagtttgtatccctaactgactgcctgtgtaggttatcataacttgtcctgatctcctagtgctcatttgtatgtgttgttttctattttactgtatcttgttcgccatcttgagtcatttttttacacacaatggagttataataaaatagctattgcctattatgata

SEQ ID NO: 210974 - DNA, 463 bp, Homo sapiens
aatattatgcacatttctgggtttgtgtttaaacacatatccagaacgtggtaaataggttagttgttgttttttcaggcagagtcttgctctgttgcccaggctggagtgcagcatcatgatctcgactcactgcaacctcaagcagtcttcccacctcagcctgctgagtagctgagactacaggtgtgccaccatgcctggctaattttttaatattttgcagagacaaggtctcactgtgttgcctaggttggtctcgaactcaaacttgtggactcaagcaatgcttctacctcagcctctcaaagtgctgggatgacaggtgtgaaccactgtgcctggctgtaattaggttttggagagtgtctagtaactgttatttgaacagtggtccaaaaacaataggcgtcttcaccttagtgtaaaagctgagagactttcaatcagatgaggtccacag

SEQ ID NO: 210975 - DNA, 435 bp, Homo sapiens
agctggaaaacttttgtattgagcacattttacactaatatttaatcattttccctgctatatcccttcttatttggtactctagattgcagtaatatccctcctatacatttttgttctttgttaggaattttgtagtaaagaatgaatctggccgggctcggtggctcacgcctataatcccagtactttgggaggccaggacgcgtggatcgtgtgaggccagaagtgcaagaccagcctgggcaacgtggggaaaccccatctctataaaaatacaaaaaattagcttggtatggtagtgcacacctgtaatccctgctacttgggaggctgaggtgagagaatagctggaacccgggaggtggaggttgcagtgtggagattgtgccactgcccttcagcctgggcaacagagcgagactgtctaaaaaa

SEQ ID NO: 210976 - DNA, 81 bp, Homo sapiens
aaagaggaataaatgaaaatgtgaaagttttagactcgccaattatttgaatggaattgcttcttacaagataggggaaaa

SEQ ID NO: 210977 - DNA, 312 bp, Homo sapiens
gcatgtttgttccccccaaaatttatatttgaaaccgtagccctaatgtaatggtattgggagagggagcatttgcgaagtaattatgtcaggaggttggagccttcattatgggattagtgttcttataagaagagctagcaccatcctccaccccctgctccaactctttgccatatgaggatacaatgagaagaccgccatctgcaaaccaggatgcaggccgtcacctgacaccagatcctccagcatattgatcttggacttcccaccctctagaactgcaataaataaatgtttgttttgaagcca

SEQ ID NO: 210978 - DNA, 359 bp, Homo sapiens
gctgaaagcccagctccgcaggagctacaggcgtgagacccaccgggacccgcgagcgggatcagggctgggggattagcagagccgcttgcgaggctgaccctctccaggatgccccatcattccttccttctgagtacggggcaggactctctctgggatggaggggtcttaggacctgcaagcaaacaagggggagatgcattagagtgcagtgatacgatcacagctcattgcagccttgacctcctgggctcaagcaatccttccacctcagcctcccaagtagcgccactgaaatctatgttcttactcagcccacctgcactgaggtgaaataaacagctttattgctcaaa

SEQ ID NO: 210979 - DNA, 321 bp, Homo sapiens
atctttttatcggattttcgtgattattagttgttatttattagtatttgtcaaatcatgattgaatgggagaaaaaaatctgaaccaaagggtaaacaaatccaaagagaaaacaaaaattagaaaattaaaaactggtttaaaaaaggttttccatctgtacagatgctgataatatattcccaaagtagtttcccattcattgcttaatttggttttctcaataagtgtcacaagtgtgcaaatgtacattttaaacatgtaagattaaggtattgttattactattatgtgtgaggcacatgcataggtcctgctcc

SEQ ID NO: 210980 - DNA, 298 bp, Homo sapiens
aaaaaatacttggagaggtaacaactgagaacttttcacagacaaactataaatataataaactgaaagaacaccagctgggaaccctacacaaatatacctagacacgtcatattcacactgtagaaaatcaaagacaaaatcttgaaagcagctggggcagctgtgggggaagaaagcatattacatatggaggaacaaagataagaattatagcagatttctcttcaggaagtatataagccagaagacaatgggacaatagctttaaagtgctagaaaggccaggtgcagtggc

SEQ ID NO: 210981 - DNA, 305 bp, Homo sapiens
aacctgacacataataattgctcaataaatatttgttgaatgaataaatgaataaaggatgcaccgagctgctcaaaaaaataagggctaaacaggtcacaaatatgtatgaggaactaatattactacatctaataaagttcagatgagagtggaaagcatttatgggaaaagataccacaatgtttctacagtttgctttaggaaaagttgctatccttgctcatttcacgtattttggaaagaatctgtcctttgccaaaggctctagcttccgaagagctgacaacaaactctgggagttg

SEQ ID NO: 210982 - DNA, 462 bp, Homo sapiens
aggtcaaactcgcaatgattcggtgtgttttgttccgtgcatcctggcatgtgaaagaagtgaggtaaagagtataatttacttccttgttttaaagctagcattgcccgtgccttccacgcgggactgttgtggatatttgaccactgcaagaaaactcacagaagcagaaacttagggcttgctttaaatgttatcagtgtgaattgagatggtgtcagcattatttttttaaagaccaaaacaacaatagtaacaaacacacacaagccactgttagattttacaaaactttaaaaagtaattatcttaaagatatctaagatagtgatctggttacatagattatcagagatacttttttttttgattatcagagatacttttaaaaaagcaactacaaggtaaggattatcctttaatttagtgtttttctattaaactcaatttgctttaaagttt

SEQ ID NO: 210983 - DNA, 498 bp, Homo sapiens
caggctggctgcccactcgctttctctcctcacaagactcgcttccccggccttcgaggatctcgaacggactatagtctggactcgctgggctggaggaaacttggccgctggccacccggaggagactgagaagcctttggtcaacagggcgcctttccttgaaccaaaacaaaactttccgaagccggaaaggaaacgcccagtgtcgcctgagagccctggagctgcgcgagacccaggcactgagtgcggcctcggcctctgacctctaacacgccgggaacaaaccagctggggcggcccgcaggcctgcgggagcggaatgtgacccgaaaccgacggacttcctgacccatagtccatagttctcttcagcaacttgaacattttggaaaaagaaacaagtcttaacatgccacgacctaatggaaaaactaaatccccttcctacaccttgctttccaaaagttaaaaaaaaatagttaaacgctatta

SEQ ID NO: 210984 - DNA, 716 bp, Homo sapiens
caattttatatttaagcagtgatttttactatattaatagcttattgaagataccatttactttgaagtttatagtacattgtctatcaaataggaaaagttttaatagttttagtataaaaaagatttattgaatttataacttgtctttgagactctcttatacattaaagttatttacacatatgctgcagataagataggtaatatatttggctttaaaagttcaagcaagctgttattttagttatcataagtaggttatatttttcagcataaaattgtgtatatatatatatatgtatacatgtcactgatatgttcagttttggatatcattaaatgtgaattaaattgattactaaaagtatagttatcctgattgactatagaaagaactggcactgtataatatttctgtcattcttagctacattatgaaaaccagggctctgagacacattagtacctgaaaatagtcgttgaccacattctatactccttcctcagctacactggttgcagaattaactcctataaatatgtactgaaaattaggccttacaatagatattcaggtttcattttattacagggttaataaacctattagaagttgctgtgcaaactgtgctctcaaaaagtatataagctatttgatgtaattcagaataaattatttttatattttttaaagttttttggtttattaaaaa

SEQ ID NO: 210985 - DNA, 109 bp, Homo sapiens
gtcatccctctgtctgtgtctgtgtcctcatctcatcttcttatgggatgtcttagtccatttcaggctgctatcacagaacaccatagactgggtggcttagaaacaa

SEQ ID NO: 210986 - DNA, 96 bp, Homo sapiens
cacttggtgaaagaggagatccaaacagccaatcaatatatgaaaaagtgctcactgcactccagcctgggtgacagagcgagactctgtctcaaa

SEQ ID NO: 210987 - DNA, 370 bp, Homo sapiens
agaaaatgctaaacgagaggtgatcctgtccccattgtaatgggtgcaaatgaagggccaactttattaaaatggaaaatccaggatttgtagttctcacattttaatgggcctaagcctcatctgaaggtgcctgctaaaaggcagatttctgggtgctggttccagaggttctgtgtggggccagagaatccgcattttaaatagcaccctcaggcattccacggcatgcagtttccagcaatccctctgagagcccagctctagattgcaataggggaccaccactcataattgggaattttttccttaaatatccagatttctagttctttcagagaatctgaagtgttggcaatcctgggcctgc

SEQ ID NO: 210988 - DNA, 265 bp, Homo sapiens
gaaactcttatttattgctggtgggaatgcaaaattgtacaaccactttgggaaacagtttggcagtttcttccaaagctaaacatagtcttaccatctgattcagagacttcactccttggtatttacacaaatgaattgaaaacatgtcctcacaaaaacctgcacatgaatatttacagcagctttattcataattgcccaaacttggaagcaaccaacgtgtttttctgtaggcaaattaataaataaattttggtacata

SEQ ID NO: 210989 - DNA, 418 bp, Homo sapiens
tttaatccacagccaaccccaggagatcaacagggtgtagactgtgaggcctagagaggtcaagggaccttcccagggtcccagagggtgttggtggcaggactggcccctaacccactgctgttctgcttctcccattcttgcatagagtaatggagttagtgaaaatgggctttcttttacaacacaaagtgttgctcttctttctcctagggagaaagtagtaagctctgtgggtgtaggaggaggaaaatagcaggagcttagccaaggagggtgctgcagcacatgtgggtcttcatagtccggaagggtgagtgacacccaaggggctgaggagctggcattccagagtggcatgcactctgccctcagagagggaggcattcacctgggaccttgccgtcctaggacctta

SEQ ID NO: 210990 - DNA, 418 bp, Homo sapiens
atgttggctcactgcaacatccacgtcccgggttcaagcgattcttctgcctcagcctcccaagtagctgggattacaggtgcctgtcgccacatccagctaattttttgtatttttagtagagacagggtttcaccgtgttccccaggctggtctcaaactcctgagctccggcaatccacccgcctcggcttcccaaagcgctaggattacaggcgtgagccaccgcacctggcccctatctcttaaaaatatatttttttgcccaacacacatttccaagttgccttgggggaaaaaaaataaatgaagctggcacaactgaaaaaataaaactggggccttggccaggcacagtggctcaggcctataatcccagcactttgggaagctgaggtgggaggatcacttgaggtca

SEQ ID NO: 210991 - DNA, 154 bp, Homo sapiens
actggagatccaatgatgatgtctttatacaatttataggtctttctataagtgtcaagataaatgtcatctctgtacctgcctatctttcagaggtaggcaagcttctatgtaaagtgctagatagtaaatattataaacttttcaggactca

SEQ ID NO: 210992 - DNA, 547 bp, Homo sapiens
atcttgggagactcagtacaagtagatcaacccatctcctctctacattttcagggaaatttggctcagagtccaaggctgaaccttgtgatgaggaaaccttgctggaagctgacctttactgtaggggccctgattcaatatcctatatccacaaaaaatgcacatacagggcagcgaggttctagccttcccctctgccatcttgatctgtgagggtctccttggaaaagtctatgtgtctcctacagtgccaagcaggggaggaatcagaattagtccaggtggcagcatccttttatgatatgatataaactcaacaaattaggtatagaaggaatgtaccacaacacaataaaggccatatatgacaagcccacaggtgatatcacacttaacattgaaaagttgaaagccttttcctgaagattaggaacaagacaatgaatgatgcccacccttgccatttctattcaacatagtactggaagtcccagcaagagcaattaggcaaggaaaataaataaaaaacatctacattggaaag

SEQ ID NO: 210993 - DNA, 224 bp, Homo sapiens
aaatatgggatgccatctgaaccagtgttagcacaatgtaaatattcagtaaatggtagctatgataataaacgtaatacattagttttcaataagcacattataaacagagatgtggctaagagatccaccacagctggtaaatggagagggtgcagagatcctgctgtcacatgctttgccatacattgacacattctggagtaactgactgcaaagctgaa

SEQ ID NO: 210994 - DNA, 225 bp, Homo sapiens
gtgcctgacaagcctgatatatttttttaaatgatcattagtatttgatctctactctttttctctcaagcacccaactcccggtttacggtcaggaagaattataaacagagatgtggctaagagatccaccacagctggtaaatggagagggtgcagagatcctgctgtcacatgctttgccatacattgacacattctggagtaactgactgcaaagctgaa

SEQ ID NO: 210995 - DNA, 154 bp, Homo sapiens
acgaaaagagaaaggaaattgatggtcttaaaatgcagtaataaaagccataattaaagaaacatgttcctaaactgaggaaaaacttctcttgggaagcgaagagggcatctttggcagtgtctcctggcgatctcttctggggccccgaaga

SEQ ID NO: 210996 - DNA, 533 bp, Homo sapiens
gaaatgaccaaggaggtccttgaggggttttctaggcttgtatgcctaggtggcattttcttaaaattcctacacatgttttataatgtaggtctgacatttttcagtctcataaagtcccccaaaagaatgctaaaaatgccacagtgggggcagttctcccttaaaggtccattttgaatattcaaatttcaactgaaattcttcattcactgtcctggacagagaggcagcctggccccctctgcccttgagggatatgcccttggtccttcctccgatgatgccccgtctttgtgtttgtaggcacctacatagggctgtttttaattcgtataaacatgaaagtgtttaagctctcccttaatggtggccgcctttaccagcccagaagtcccacatgtcagcatggactacacctcaggaaaccctctccatcctcagatgctttgggtggagtgcagacacagcagcttcccctgcaaaggcacccctgccaggtcagataattacttaggttggtagtctgtcac

SEQ ID NO: 210997 - DNA, 416 bp, Homo sapiens
agagcccatttccgccctgactgcagcacccagggccgctggggacccaggctgtctggatcccagccgatctattgccagtcctggcccaaggtcattttttccgggaagaaaggcagcttctcagtctagcatgtcccgccctccctggctgagctgggagctggggcgaggctgaaggatgtttctggtgaaagcagattacctcgtaagggggctggctgggtgggatggcactgtggtggcaggtccatcagatgtatctccatggggatgtttcctaggctgctggtgacaggcccccacctcaggctgtggaggaactgctgctgaggtggagacagtctggccccatgcctgggctcggcctgcctcctctgtggcctcacgggcaggggcccagcctctctgatgcc

SEQ ID NO: 210998 - DNA, 755 bp, Homo sapiens
agaagaggaaagcattacattttagctaagagaaaacaaaaggtttatggaatgagtgatactcacttcagatgattgttgatgcataaaatttcagaagacagacaagaggaaggtcattcaaagcagaggcaatatttgatttgtgtagagaaataatatttagaaggctatttaaagagtttgaaggacatattagaaatgcatttaggaaaatgcagcttgagagacattttttggaatttaggaataagaaagatgtaaagaggaaaagaattgagtcaaagtcaaatgttggtgaaatataaagcagagtggagactgagagcaatacattggatttgaacagatgagtagagaaagtcagtgtagtttcattagaattataagttcaggaaagtgcaggaagacaggaaagtggcagcaaatagtccaggctagtttggaaatgtttattggagaaagaaaacatatatgcaaaagtaacttagctcagtgctttgggaggcagagacggaaggactgcttgaggccaggacctcaagactagcctgggcaacatagtaagacccctgactctacaagaaaacaaaagcaaaacaattgtccaggtgtgatggtgcgtgcctgcaatcccagctacttgggaggctgaagccagaggatcacttgatcccaggtgtttgaggcttaggagagttgtgatcataccactgaactccagcctgggcaagagagaaagatccaatctctta

SEQ ID NO: 210999 - DNA, 223 bp, Homo sapiens
gactcttgctttccttatcagcaaaatgagatttgctgtacatgaaggtccccatgtcagtctggtctgaggagacaagctacaacacaaacaaaaatgggatttgctgtatgtgaaggtcgattagaacaaaggcctttttaatcttaaaggttaagtgcatggaaagaacctctgatggaaatcaaggagtactgacagcacgatgtggaaaataagagag

SEQ ID NO: 211000 - DNA, 629 bp, Homo sapiens
ggacaaatggagattattagggagaaagacttttccttatccttctgagcccttggttgtctatgggtactgttgcttgttttcatttttaaggatagtaaacatacttaacatttcccaaggaatctgtcttgacctgtgtatgtgtgtgtaaaagctgcattgtggactttttgaaaaagaacatataataaccagttcagttgaatgcaacgtgctctgtgagattaagggctcacaagaaactgctaatcacagttttaaaaagacaatcttttgatgtctcatatcttagtgttactatgagtttatagcctgttattttgtttagtgtttactctgtcttgcctttcttttttccttccttcctttccttttctttcttttcttttggaagggaacttaagtacatcttctggttctttctgcctgatctcttcctcttaattttagaaatgaagatgtagaagtccaaagaggatttacttgatgatttgactagaaaagctaggtttaaccaggtcttctatggaaatgaattatagctgtagtgaaaaaataagggaaatgtgctatgtttggattctagagacagttctctagaatagaaaatcttctaaacccaagac

SEQ ID NO: 211001 - DNA, 626 bp, Homo sapiens
aaattgtaggaaattacaatttgtacagcatagtttgtgtatcactcagattaatataagatgattaaatatggaaaggaagagaggctgaaagctcctgagggatatcattagggcaaattgccaaagaatgaaacatgagccagttaggagagtctggaagctgcaataatatcaggggacttgaatgttcgacagttggagcttcagtaatgtgtgaactgcgggttacggtatcaagagactctgttcactgacacatagaatgtcactattgaccagcaaactgcccaagcttgacagctgtactacaggaagccaagtatatcataatttcatatttaaactgttcattccagattaacattttgtttcctagctttatatcacaacagctgtaattacactgttgctattttaaaggtaattgccattttaattgttttgttttggtaagcagttaattaaacattttttagtacttaacaaaaggatatcacttttttctcccatcttctgaccctcatcagaattcttttaatgtgactttctttccattttaaattatatttctgtagatgtaaagtcatttttatgcataaagcaataattaaatcagcattctt

SEQ ID NO: 211002 - DNA, 209 bp, Homo sapiens
atgcttttgctaatttaataggacaaatatagtcattcactactgtttggtttgcatttttaaaattattagcagggccagatattttatcattttatttactggtgatctcttattctatctgtctgtccataccttctgcccatttatctactgaggtttaacaggtttttctatttatcaattttagcatttaaaaaaacattaat

SEQ ID NO: 211003 - DNA, 612 bp, Homo sapiens
gaatacaagagtgaaaaaagcctataagatttatggaacaccattaagtgaacaattaagaagagataaaaatggcatagaaaaccagtaacacctgaaaaattcccaagcctgggaagaaatatggacatctagatccaagaagctcaaaagttctcaaatagattagactcaaaaaggtcctccccaaggcaaacaaagtcaaattgtaaaaagtgaaagacagagacaattctaaaaacagcaagagaaaagcatcaagttacatataagggaatccccattagactaagaacagatttctcagcaaaaaccttataggccagtaaaaaatagatattttcaaagttctgaaattttgaaagaaaagaattgcctaccaaaaatactacacccagcaaagctatcctacagaaataatggagaaataaagtctctcctagacaaggagaaactgagggaattcatcaccactagaccaaacttacaagaaatgctcaggagagtcctgcatgtggaaacaaaaatgcaataatcaccatcatgaaaaaatgaaaaagtataaaactcactggcagaccagatacacatagtagaaataaaaaaaaaaat

SEQ ID NO: 211004 - DNA, 206 bp, Homo sapiens
  misc_feature (197)..(197): n is a, c, g, or t
tgccgatttggtaggattgtaatttttccgacaaattgtatgatcgctacacacgttatccttcccattgtgtgtgattttcccagtacccaagggtaaaggaactggaaagaaagactcactcaagtgcatcacataaatgggaatctaatagtaatggtgccaaatcggcaaagtgcaggaattggcggggatcntctagagtc

SEQ ID NO: 211005 - DNA, 125 bp, Homo sapiens
tgccaagtctgtctctgcctaactctatccaagagatattgcccactcccaaggttctaattagcatctaccagtcttcaagtacacatttccgaccctgacctctctctcttgagctccaggat

SEQ ID NO: 211006 - DNA, 468 bp, Homo sapiens
tccacagtgaatgagagcaagaactcccacgggcagagacggctgacggggtctcaacacagcccattaggaaacatccccagagccatctgataaaccgtccagtgtcagaatgagccatgtctctgggcaacttacccctgcccactgccgagaagataagaattcacccctgccgcacatagaatttattgcttttaatgacaaaatgctatggatgctgcttattggcttattacaattttatatttatccaaactttcttaggttaactcaggaacaatctaaaaagagacttcctcccccagagaagtgtgcaaacagagcaccgctgttttcagggcatattccatgtagtagtcagaaatcttttctgatatgtatttcctttctacctcctctctttctcctgaatcttactgagcatgaaactagagaaaacacctataaatataattatgaaaatca

SEQ ID NO: 211007 - DNA, 495 bp, Homo sapiens
atcatgaatgcataatatacacacatgcacgcacacacacacacccctcatcatatagaaaaggatcactgggttttggtcattgttatactaaaattgggtcataccatacacactttcatgcatcttacttttcccactcaataaatatcatatgtcagtacttcccctggcagagctctaatttatttcaagttttatttctttatgaacttaattatttatttatgtacttatttatttttgagacagagtcttgctctgccacccaggctggagtgcagtggtttaatctcggctcactgcaacctccaccatctgggttcaagcgattctcccacctcagcctctcgagtagcagggattacaggcgcccgccagcacgcccggttaatttttgtatttttggtagagacagggttgtgccatgttggccaggctggtctcaaacacctgacctcaggtgatccacctgccttggccttccaaagtgtt

SEQ ID NO: 211008 - DNA, 369 bp, Homo sapiens
gagtaggggaccagaagtgcctttgtcccaccccactcagacctcagtcctcccagatgtgatttccactctgctttccatacaccactccctgtgccacccttttgaattctagaaggatccaaatatggtttctaccgtggaatggaaatgaagattaaaaagccacttacaaatatgtttcttaagctcgaaatgtccattggaggaaagtctgcatagaccaacattgtattaaatcataattcctttatatcaacaagaacaagtggttaccactttggagaaagagtatgtatttcagaatatttcttgggttctatttacagttcattctcttgacaagctgagtaaattgcttgacctctg

SEQ ID NO: 211009 - DNA, 277 bp, Homo sapiens
aggagatgctgctcgtttcccaggctgaggtttgagctcatcaccattgccagccaatctgggcttcagggttttaccctttcagccttctcagaaagcagctgtctgccttccccatcgcagccttgcaatttattgccattaccattaggtagcagtgacattccagagcttttcctgaaagggactcctgaatataagctctggcagagcgagggggtgggggcaccccgcaccacccgccccacccaaaacacacaacccagaagcacgcacc

SEQ ID NO: 211010 - DNA, 580 bp, Homo sapiens
tcatcaaaattgtcataagtaggtcataagtatgtgggcttcatgttcactggtagcattcatgcagattgtaaatgagcactaacaatctcagcattttagggctagaatgtgtctaaagatcctcttattggccggcgcagtggctcacgcttgtaatcccagcactgtcggaggccgaggcaggtggatcacgaggtcaggagattgagaccatcctggctaacatggtgaaaacccgtctatactaaaaatacaaaaacattagctagggtggtggtgggcgcctgtagttccagccacttgggaggctgaggcgggagaatcgcttgaacccaggaggcggagcttgcagtgagccaagatcgtgccactgcactccagcctggtagacagagggagactctgtctgaaaaaaaaaagaaagaaaaaaagatcttcctatttaagcctttcttaatagctgaagaaacagatctggatagtttaatcaagatagtttgtggtagaatctagatgttttcctttaggccaatgggacttctagcttgtcgcatttgttctcttgggagtgggagta

SEQ ID NO: 211011 - DNA, 91 bp, Homo sapiens
aaaggaaacaaaatttcattgcctttcataatgaatttccttgttacaaaacttttataaacttcataatgtaaactttaaaaaaaaaaag

SEQ ID NO: 211012 - DNA, 167 bp, Homo sapiens
cagtcccagctcccaacaagagcgaaactccgtctctaaataaataaataaataaagttcgttctttggcatttgaaactgggctaggatttgaaaaactaatacatagtagcataagcttaaactaagtttgtcactaagcttagaataaatcttgttgggagctt

SEQ ID NO: 211013 - DNA, 616 bp, Homo sapiens
tttatctccgcaggatagaagcccaggcccagcacctcaggtggcctcatggtcagagacgggatggtgggtcatatgtgtcttgggggggtccgtgcgctgcagcgtctccttcccgttctccaggtatctgcggagccactccacgcacgtgccctccaggtaggctctctgctgctccgcctcatgggccgcctcccacttgcgctgggtgatctgagccgccatgtccgccgcggtccaagagctcaggtcctcgtttagggcgatgtaatccttgccctcgtaggcgaactggttatacccgccgaggaggcgcccctcgggcccccggtcgcagccatacatcctctggagggtgtgagaccccctctccaccgcttcccagctggtgcccctgggctacggtatccggaagctacagattcagtctgtggtggaggaccacagggtggggacagacttgctggaggaggagatcaccaaatcttcgaggagcacgtgccgagtgtcgatatcgcagctttcacacaacgatctgaagcctgacgtgtgtgtacgtgcgcgccgtgcgtgaggccctgcccccgattaaagactggacccccgtctccca

SEQ ID NO: 211014 - DNA, 263 bp, Homo sapiens
tttatctccgcaggatagaagcccaggcccagcacctcaggtggcctcatggtcagagacgggatggtgggtcatatgtgtcttgggggggtccgtgcgctgcagcgtctccttcccgttctccaggtatctgcggagccactccacgcacgtgccctccaggtaggctctctgctgctccgcctcatgggccgcctcccacttgcgctgggtgatctgagccgccatgtccgcggtagcacatataaaaactggagtttcag

SEQ ID NO: 211015 - DNA, 838 bp, Homo sapiens
gtgtactcttgtccttttgatggcatgataacagaaactaagggaacagtgttgataaagactgatgaagaattgatgaatttaagtaagggagaagaaaatctcatggatgcataagtcaaagctattgctgatactggtgcaaatgttgtagtaacaggtggcaaagtggcagacatggctcttcattatgcaaacaaatataatatgatgttagtgaagctaaactcaaaatgggatgtctgaagactctgtaaaacagttggtgctacagctcttcctagattgacacctcctgtccttgaagaaatgggacactgagacagtgtttacctctcagaagttggagatactcaggtggtggtttttaagcatgaaaaggaagatggcatcatttctaccatagtacttcagggctctacagacaatctgatggatgacatagaaagggcagtagatgatggtgttaatactttcaaagttcttacaagggataaacgtcttgtacccggaggtggagcaacagaaattgaattagccaaacagatcacatcatatggagagacatgtcctggacttgaacagtacgctattaagaagtttgctgaggcgtttgaagctattccccgtgcactggcagaaatactctggagaaaactctggagttaaggccaatgaagtaatctctaaactttatgcagtacctcaagaaggaaataaaaatgttggattagatactgaggctgtagtccctgctgtaacggacatgttggaagctggtgttctagatacttacctgggaaaacactggtctatcaaactcgctgctaatgctgca

SEQ ID NO: 211016 - DNA, 737 bp, Homo sapiens
ccaaccctaccaggtgctctgccctgtgttccctgctccttagctgaggacactactgagctccggtgaagaatataagttcctcatccccaatgcagtccttcctggtctccccgatttcatgttctcccacctggagtacctgaggactgccttccctcccccacagggatatggaggtggcacactaggttaccacaatgccagaagccaggattccctggggctagcaactctgccaggaatggtcagatgcactgtgatgtgctcaacccaaatataaactatgaccacagccccagaatagaaggctggaggaagaggggctgagaatagggcagagacagggacatcagagagctgagcaagggggagcagggcccctccttgcaggaaatgtcaacagctggttcctcccgtagtcctataagtgggtgccccagagtcacagacatgactcaggcctgtcttgctggccctctagagggaagaggtggcccagaaaccagggcatccctgtcccaagctgtagggcagaaataagaggaaggggttctttactcattgcttcgtcctatgtacagttgtccagcagaggacaggacacagccaagtggcctctgtcctcctctgggtactggccccgggtactggccctgatcatcccagcagatgacccccctccctggggatgtacagaggccagcctgctttctccctgggactccacccacaca

SEQ ID NO: 211017 - DNA, 362 bp, Homo sapiens
gagattccaaggattttaggacttgtatgccaggaaatggggagcaagactaaatatatatatttcacacatatttcacaatatcacagctagaacttgggagattttcttatcagtagatgaacttgcaaaagatcatgagaaagttttacatcaaaaagaaaaggttagcctgggcaatatggcaaaaccccatctgtacaaaaaatacaaaaattagtcgggcatagtggcaggtgcctgaagtcccagccacttggaggctgaggtgggcagattgcttgcacttggtaggtcaaggctgcagtgagctgtgatcctgacactgcattctgacagagcgagaccctgtctcagggggg

SEQ ID NO: 211018 - DNA, 489 bp, Homo sapiens
agcagttattagggctctcttattgaaagggtttaatgaataggttaaagtagtcattcgggtgagtgccatatgcacaacatggtctttattttgtgtttgcttgcagtgaattagtatgtactttacagttttcacacttcagagagaaactgcattgtacatttcaagttgagatgctactgaaatatagtgaaaatggcctctgtagacaggtttcactataaaattgtaaattatgcatacatatatccaaatttcttattttgaaatattgaatatatgaatatttaattggaatgttcctttagtatcttcatatgcttgccttaaaggaagtgttttcctttgatttatatacatggatttagaaatgtgtgtgtcatacatatctgtgtcttttctggagatgaacaaccacagatactattagatatggcattttctttttaaatgtgcttcagtaatgccaatgtggtcttcttttga

SEQ ID NO: 211019 - DNA, 295 bp, Homo sapiens
cataacgaattactgaacctagacactgaacagcatgactataaacaccagagacaaggaaataccatgtgcctcctcagggagagcacagcacccaccacctgtgaagtagttgggccaaaaaattgaacctaaattgaattaagtatatactaattaagtataaaccaccaatttacaggaaatagagagggcagaggaagatgttaagtacaccaggggaatacaactgaaaattcccagagagtggtataatactcccaggaaaaataatccaatttctggggctggacat

SEQ ID NO: 211020 - DNA, 435 bp, Homo sapiens
gctgatgaagagaagaatcagctactagttggtccttgctctgagggttccgcgtggtaaggcaggtttgtccacgcctgtcctctggggaagttgcatccatttattaaaatcacaggattttggtttgctgctgtttttcctattaattactttgctgagtagactgctaaggaatatagtatatgcataagctgatgtgacactttcagcataaaacatttaaaaaataggaagtcagctgggtgcggtggctcatgtctgtaatcccagcgctttgggagacccaggcaggaggatctctggaggccaggagttcaagaccagcctaggcaacatagtgagacctcgtctgtacaaaaacaaaattagcttgaggccaagagttcaagactagcctgggcaacatagtgagagcctgtctctactcaaaat

SEQ ID NO: 211021 - DNA, 265 bp, Homo sapiens
cccctagcttaccaccatgatcccaagcaaggtcctctcccctgtctggccctctttcaccatctgtgaagtagagatagaccaccaccaccaccgtctctactaaaaatacaaaaattagccgggcatagtggcacatgcctatgatcccagttacttgggaggctgaggcgggagaattgcttgaacctgggaggtggaggttgcagtgagccgagatggcgctactgcactccagctgggcatcagagtgagactccgtctc

SEQ ID NO: 211022 - DNA, 711 bp, Homo sapiens
cttactgacattttgtttaggatttttgcatctatgtgcatgagtgagattggtctgcagtttttattttattgtattaaccttgcctggtttggggatggcagtactggcctcacagaacaagtgtccactctcctgctagctccctggaagagtttgcagaagattcgaattatctgttctttgagtgtttggtggaactaacctgtaaaatcatccgggcttgggactttctttgtgggaagatcttaaatggcccattcaattaattaatggttatggcactctccagatatctatttcttctttaataaatttagtgagttataatttttaaaggaattttcccttttctgctttcaaatgttttgccataaagttatgcctgtttttttcattcctaatgttacttgtgacaactccctttcttcttggtcagtttcaccagaggtttaacgatgcttatagtttttttgaagaaaccaactcttggtttcattaatcctttttattgtatgttttaaaattttcttaattctgcccttaaacaatctctgggtttcttctattgttcttttttatgtttatcttgttatgttggatacctagttcattaatatttagcttttcttattttccaattagcctttagatggaggtcccctaagggttaagtttaactacacagagatctaccccttcgtctggggg

SEQ ID NO: 211023 - DNA, 410 bp, Homo sapiens
ccaatcacgccacgatgaagtcttctctgtgggcagaagacgctccaacattcaattccactgaagagtcagattgctggtttactatcttcaagtctgtgacttgcaagatataaaagaatgtaacactggtgctttgttttccatagaaagtaataaaaaatgtacttctctaacattctaagaaatctaatatagtgaccatctatttttctatcgtgtgtatcattttcacacgccactttaagaataaacccaaggcctaatttgggaatgttgccatagctgtaaaattaaatttaaaccaaaggattctatcaaaaagtaagtcttcaaactgtcaagaggctagctgaatacctgcagttgcttcagaattcttttccttcttcaatatgcttcaactcttg

SEQ ID NO: 211024 - DNA, 414 bp, Homo sapiens
aagaattcggcacgaggtgagccaccatgcccagccttcatggtttccctaggatcaccagctgtcatggactgatttgtgtctctccaaattcatatgttgaatacttaacctgccatgcgattgtgattggagataattcctttagggaagcaatgaaggttaaatgaggtcataggtgggagcttaatccaatgggactggggtccctacaagaagaggaagacaccagagctctctgtctccacacacagagaaaagaggctgtatgaggacacaagagaaggtaatagctgtctacaaaccaagaagagaagcctctccagaaaatgaaccctgctggaacttggtcttggactttccagcctccagaactgggagaaaataaagttcaaaataaagttctgttgtgta

SEQ ID NO: 211025 - DNA, 586 bp, Homo sapiens
gcctggcttctcttaatacttttttaaaaagaagtagacatttaaaaaagaaaatctagctatttgagtcttctgaatgggtgctcatgggtgttcagccaagactgggtagaacatagtgacctaattcaccaagatggtagtagaaaggcacaagtgtagggaagagatagagatgggtatgggagataaagtttgaacttgaccttctggtcaagaagggtcttgagaaaggacttataacctagcaggggctccctaagaagttgtccaaggtgggtccaagtttccctggttgggccagaacccaaggatggctcactgatgcgggtaccttcacttccagatgccaggggattcagggttggtcagtgccagccaagccttggcaagggatgaaaagacttcctgggtgctcttaaagtaaaagtgagacctctccctgccttacttcccagagccttttcacttgttttcatagagtatattcacattttgccttcacttagttacctgggtatatcattcctattccagatttgctgcttcttaggagctgggtaagctgggcacccctggggactta

SEQ ID NO: 211026 - DNA, 668 bp, Homo sapiens
catgagctgagtatcaacctggctgtattcatgggccagactcatatctggtatgtggatccgagtgcgccagtcagattacctgatagggagaacgagtcttgctgtccatcagctgtgtgatagtgtccacagaaagactggccctccatttacaaggcatctatgccgaataccaaggacagcacatatataaaccatgtcgtatccgtggacatgggtggggatcccttgatgggcaccttggcacatacctgagagcctggtgagaaagacagagaagctgaggaagaggaggaggaggaggaagaagaaggaggaggtgctgctcgcagagcagctgcaggctggggatgaggagagagcccctggggagggggttggggttgggcagcaaagctggacaggagctgccagatctcagcatccatccgtctctgagcctcgtccacctgggggaccaggagccgaagagcggcagaagggagcagagagggacagaaaggacgtccgtgaggcttcacctccccacgggcccagccagccacccgctctgcactgtctgctcacaagtgctgatacctggcactctggcccttgtacccactgccctcttgttcctcctgagctaggcggggatatcccgggatgggtttggctgcctatgg

SEQ ID NO: 211027 - DNA, 479 bp, Homo sapiens
atatagtttatttggaggtcagtcatcaacacttacactaaaacttttctcacctccctataattttgataactgacctttagtcagtaagatataagtatgtagaatatgtctttaaaacaactaattagactatattctgttattttgccttgagatcaggaggaaagatgtaagtaaagtcaaatctgaattaactcctccccatataccaatcagctgctagttctttgttacctaagaatgccttccacattgtatcaggatttcagagaaagtcccatgagggcagaggccaccttttcttgctcaccattgcatcctctgacctaacacagctcccgtcacccagtaagcacttagcacatattgggaggatgaatacagcatgagaccctcctcaaagcgatcttttctacattctaaaatcaaatctatattagcacccctcctctgacttaataaattatttatagaaa

SEQ ID NO: 211028 - DNA, 203 bp, Homo sapiens
gtttcacagttggttttgtgtttggcttcagtatttatctgttatgggttgaattgtgtctttctcaaatttatatgccgaagtcctcacctccagtatttcagaatgggactgtatttgaagattgggactgtaaagaagtagctaagataaaagactgtcagggtagcctcgatccaatctgactggtgtccttatttaaa

SEQ ID NO: 211029 - DNA, 571 bp, Homo sapiens
  misc_feature (554)..(554): n is a, c, g, or t
gctgaggtgatctagaggatccctccttctggccacgcccacgcatgttatattaatccactcatgtgacattcacctacaacaacataaagaaacaacagtttgagattccgcctcatttaaacggtatcatgtagtttggcaagagatggggaagaaaagagtgtttatcaacatgaacttttacagatttatgttttaaaccataagttaaaaattagtactagaataatttatatttgacaaatatttagactcagaggaggactgtggaaatgtctgggagaactgaggcttaaatcaacattttctaatactgcacattccaaattctggagtacagttggccctccatacccatgggttttgaaaccccaagggtacccgaatacccggggctgattgtattctacttttaggaaattgtttctaaattagaaatcaattagaatctaattgattctaaaatgttacttctgtcaaaggcagagcaaccagctggatctgacagcaggaaggtctgcactgcccccgcgtggccagaaggagggatnctcatagtacagccatg

SEQ ID NO: 211030 - DNA, 623 bp, Homo sapiens
ttttttaaggttaatgctaagttttcttgaaaattttaattcaggggatttttgatgggtttttttttaacctttaactgccttgtagaaagtgaaagtagggggtcctggcagggccaaagccagtgactgagagttgaaaccgtagtgcatggcagattcgcttgagcacaaaatgccccacttagatccacagcctttggactctggaaaaaaaaaaagtattaaattcttctccaagtggctaagattgagggagaaaatagatggcaaggggaatcaagtaagaggagtgtgtcctcttttgacttaaactggcttgcatgctactgacttgacaagaagccaagatcccagttgcagttcgacttgtgtgaagcaggcacctgctttgcttgcaaatgcacatacaaaagagagcttcattcacaggaaaaaaaaatagcgggttcactaatttagccttccagggccttcgtcccttgatctgtcagccccttagaattcaaaggcagcgtgtaaaggaatttcctatttacaacatgatgacttttttgatgtcctgaattcgaatataactcgagttgaagttgtctgctagggctattgctttgttgtttaat

SEQ ID NO: 211031 - DNA, 234 bp, Homo sapiens
ctgactgttctgaccctgttcctcatttctgtcagttaaaccaagtagctattcagataatatagaatcatgtttactctaccaaagttaatttgaataatcagtccgtcctggataaggaaatatctcgtcagtactctggtcgtgatgttatctgaaagcacatgtttaaaagggagatgttacagataattcagtctaatttctcaggctgatatgaaccagggaaaacct

SEQ ID NO: 211032 - DNA, 481 bp, Homo sapiens
ataagcctcaatcctagcactcatagatgatcattgttaactttctgatgtgtttcctttcagttacatagttatttaagctaataaatttggaatgctgtaactatagctttttatcctgtttttttaacctaacattataccatgagcatttcctcgtgtcttttgaaaccatgatattgaatgttccatgctctagttgtaccataattatttaatctgttattgtcaaatatttagacactggttttttgctattctgagtaatgccataaacaaacatctttaaatgtatctgtcactgtttccttagggtagatttctagagccggtgactgggtcaaagtgtttgaatattttgaggctcttgatatgtggtaaaagtgttgctttctacaataacagagtttcagaatatgttccactgcatttgtcttgggtgttaatacttagaaaatccaattgggtggccgggtgcggt

SEQ ID NO: 211033 - DNA, 405 bp, Homo sapiens
ctctctggaatttcccttgcgtgaatgtccatgatacattgacttctgcaaaggatgttgttcaatatgttgtctccactactggggaggccacagcaaatgcctgttctgtccgtgaccgggtgacaagacttttctttgtactctcttgtttatgtttcttcacttgcaccctattattgggcatcctgcctttgggtcctaccttcatttctctactctagtctctaacttttccagacttggacttggatggagctggctctgacaactatttgctctgtgactttgggaaagttactcaacatctctgagcttcagtttctttgctatgaaactgtaataataatacaaaactcataaaactattgtaaaaataaatgagactctaaaatccagtacctg

SEQ ID NO: 211034 - DNA, 809 bp, Homo sapiens
cataaatctattcacatcttcaagagtcacacgactgaggtggaatggaagagggggagaaaggcagcatgacagttccactccattcaacggccagggactacagacccttggactaaggctatagtttcgacactgtttccaggtgtccacattgaattaaggatctgaaacaaggcttcagaccacctctccaggaaagtgcacgtttgcaaaggcttgaccacaggttctgggggcccacagcccccacgggtgaaacaaaccccttctggctctgacagccagcaaaactctggggcctgtctctagggacatggcagaggccccacccctctgcccagttggccttgctcttgggactgcccaaccacaaacagatttgtggtctggtaacaaaaaaagaaaagacaaggaggccagcaaaagtgggaggctggagggtgggttaaaaagaggtggaaaggccaagaaagcaggctgaggggaagacttctgcctctgcagacactgtcccctcctctcctctgtgaaaggctcccctggaaaggtggttcttcagtaggtaaaccatccgctggatggagctgcaatgcctgagctgaaagggactgtttacgcgggcgtttcccaaaatggtctattggtcttttccatagttattttgcattaaaaaaagggtggggctaggcatggtgctcatgcttgtaatcccagcactatgggaggcagatgcaggtggattgcttgagcccagcagttcaagatcagcctgggcaatatggtgaaacaccatatgcaaaaaaaaa

SEQ ID NO: 211035 - DNA, 417 bp, Homo sapiens
ggacatgaatgaatccaagttgggcttctcatctttcacatgggctggcaagcaacttctctcctgttccttatgtgccctggggacaacagaactttttctaacttgtaatatgaagaatgctacttagagtaaagcaaaagtcagcttcctttcatcaaggctgagagatataaacggaagcttgtgatgataagattttttaaaagcctactaatattgctatgtttagtgtacagagaactgcttctggtaggcaattaggagttggtcagcagaccacgggggccccgtggagaaactgggagcatagcaattgactaaaatcactctcctttcccaagaagtccttagcaatacgtggggtgctatttctgttatggtacatatgtgcaaaaattcattcactctctcatt

SEQ ID NO: 211036 - DNA, 472 bp, Homo sapiens
gtcgtgatttcattcattatccatggcttttagaacgtctgagttgcctgttacttgtgaatcaatttttctagtcccggtaagtgaactgaggaaccatcttttcagttgcttattggacaactccctctgaatatcccagtgctaattactttccctctcagagctggttttcttcctatgttaccaattgacccagtcacttgagccaggggctgggagccatcctagatttctgtctcaccctccacatggagtgtcatgtggctgccttttttacacctgccctctcatctccattcacactgctgctgcttctgctacagttaatctgtagtttatctttcactaagactgtaagctccatgagatctggggccatgtgtgttttcttcatcactgtctgtaatgcttggtacattgcatgttatgtaagtaatatttgttgattgaataaatgaattcacaaatg

SEQ ID NO: 211037 - DNA, 413 bp, Homo sapiens
aatctcagacagttcctcagtttgtctttcataactgatacttttgaagagtactggtgggatattttgaggatgttcctcagtttggatttatttgatgtactcagatgccttgaggttttgcaattttgaagagaataccacagaaaatgcatcatatcaagaggtgcattctagtgtgtcatttcaagttccttattttggtgtatcagtcttaatcacttggttaaggtggtgtctgccaggtatctccactgcaaaattactgtttccctttgtagttaatatcttgggagagatacatgagacatgaaaattcttttctcctccaacttatgctaagttttgcattcattagtggatcttgtctgtaacagttaccgctgtggtgtttgcctaaaggtgattttctg

SEQ ID NO: 211038 - DNA, 322 bp, Homo sapiens
atccaataaaggcattgttcagagtggaaatgtgtagtacgaccaatgcagtccttttttacagctaaccaattatgggctaaaagaacaatgcgaagtctcttttccaattgttcgtaggagtgtgttcattccaagccattaccgcatgtgtctgtcagagggaatctctgcatcaggctgtaatgagtcacattagctttttttccgcaacaaagcattacatggcctggctctatgacagctcagagattatggttcagggagcagctttaaatctagctctctttctttctagaaaatccaacgaggctgcagttat

SEQ ID NO: 211039 - DNA, 282 bp, Homo sapiens
aaatttaaaaaaaaaaatgaatcctgctactgatgggtatatagcattaatctcccacccaaccccccaaaaaggacttgtctggcttcttgtaagagagggtgatatttcataccttaatcttgtgattaattccaagtattaagatctgtcttctgatcctaagtgttcgtaaagacatataaagcatttttatgaactcttatgccctcctatgtgtaaggaagaaagtcttactatgaagtatagttttaagtatactaaattaaaatgccttacata

SEQ ID NO: 211040 - DNA, 525 bp, Homo sapiens
cagtagtatgtcctccaggctctgggttgcagtgacagaaacccactcaaattaagtaaaaaagagaaatcgattattataaagacatgggagaatgtcacatcgttccaatgtaggcaaatggtggcagactcaccattgagtcatcgtggttcacagagctaaccagagaccacctgtagccaaggggtattgggtcatgcagaatagccgcgattggggaacccacttatgtgggtgggggcggtttcctggagaggaagagggctgaaaacacatgccaaaaaggagtctactccacttgagccctggagttcgagtccagtctggccaacatagtgaaactccctctctactgaaaatacaaaaaattagctgggtgtggtggtgtgcacctgtaatcccagctactcgggaggctgacacaggagaactgcatgaacccaggaggcggaggttgcagtgagccgagatcatgccattgcactccagctcagggtacaatgtgagactctgtctcaaaaa

SEQ ID NO: 211041 - DNA, 417 bp, Homo sapiens
aaacaaaaagagtcataattaagcagaagctgggcaatgaggttgatgatccttttcccttaaggttatgatcttagaatgtttgtaaattcatgactgtatttgatgccttgtctaaaacgtggcctgaaatgctggagctgcaagtaaccttagcaacaaagcaagtaaggagaatgccttattgtggaaaacaaggattttaacagcttaagagttcatggtggtccctttgtttgaaagacaaggaaactgagcaccagagatgctagataaattttccttagatacccagcgcattaaggtagaactggtatgcttcccagctgtaagtccagggctttcccattatgtcctattattttacttatggtttcttttcagaggttatatttgcttaattgcttatttatattt

SEQ ID NO: 211042 - DNA, 356 bp, Homo sapiens
tcttccctcctggtcagaaaacacgttgttatccaaacacacccctcgcttccccacctctagatctctactcatgctgtttcctgtgcctggcatatcatctactctccttgtgcgccaaaatcctactcatgctttagagcccaactcagatgtcacttcctccctggtgccttcactatgtggaatgtatccactgtcattgaatttcatttattcatttgctcatcatagagacccctgggccaggctgtgaccatttccccttcacatgcctctggtttgtctcctgtttcagtcctgccttgtggttttcacacagctgatgctcaataaatgcgtgctgagcaaactca

SEQ ID NO: 211043 - DNA, 305 bp, Homo sapiens
tcaccttcatcagagcccaaggtctgaagacactgaaaagaagatctggccaccaaatgccctcaacaaggggttgtccagaccctgcttcaacattgtcagcagcagggcatgctccacctcagcagacagccacttttgttttcaagtaactctctaattgcaaaaaatgtactttgtattcatccaaatcggtgtccaggtagcattcacaagtatttgggaggcagaggcaggaggattcctagaggacaggagttcgtatcctctgaaaacatgtagaataaatccaactcctttcccat

SEQ ID NO: 211044 - DNA, 450 bp, Homo sapiens
tggggttccagccaggccacatgtgtttgcaggacaaccccgggtgccacatcatagcaactgaattggttgactatgcctgaccagcacagagctccagcaaggtggcccctgtggctacacaccagcctgcgtaattcttccctgcactgcagcttcccccaggcccatggcatctccccacatcattttgctagcacatggtcacatggacaggttttgctttccttgcccttccagcgtgcaggagtgcagttcatctgttcccctcccctgcacaccaccattgcagacggagccttggctgggatacagccaggcagccccatccccaccagcatcctgcccttctgggcattgccccccgccttaaaatccttcagaaatgaagccagtcagctgaatccaccttattccacaatcaaaccctaaagatcttcaaataggaaa

SEQ ID NO: 211045 - DNA, 338 bp, Homo sapiens
ttacaataaatgctgcgttccatgtgctaagtactgaagttattaccatgacaacaagaccaccttcttgcctacagttcggagattaataaagggctcctgagataaccacaaggcacatgaaataacccaggaactataaattgcaaaagcccccgagtctccctggcaatcaataaagcacagaagctttgttcagattgccaaccacccggttcagttctggacaacctcatactgccatccacgtaagtgtctatgctgcattgtaacttttggaaaaacatgcacacacctggtgccacctgggtaggtgtgaccagaacctgcctgttgga

SEQ ID NO: 211046 - DNA, 382 bp, Homo sapiens
aacagacttggggaaggggtcttggggtgcacggagcaggcctggaggtggagaggccgctatgactctgctgaacgctccagcaggaggccacgagcgcagggagggagaggcaggctagactctagagacagggaagtaggactcaagaacaactctggggcctttagcctggggactggtggagcccctcactgagacaggggacactgaagatgtgagcagattgggaatgagggcaggggtatggatgagatcacgaattctattttggctttgagtttttgctgactaggaagacatgcagcagggatatttctctctcagttacgtacaggaggcaaccgacattctcaaggttccactgaacagcagaggtggc

SEQ ID NO: 211047 - DNA, 1425 bp, Homo sapiens
gatatttggaattgcaattgaaaacttttaagacaagctttatgtttttatacatattgccacattgttcttcaaaaagagttattaatttactttcctttgacagcatatgagaatgcctatttctttgcaacctcagcaaagagggatattatcagtcttttacattttcagcaaatcatgatagctgatcatggttattttatttttctaattactagtgagattgaatgtcttttcatatttactggtcatttgtatattttcttattgtggaatatggacaaagtacatgaaacatatgtatgcatgtacacaacagatatgtacacacatacatatatattttttaacatatcataatgtgcataccatatgaccaccgggtcaagaaatagaacatctccagtacctcaaaagctccatatatgtccctccctaacacaaccctctgtccactttaacatcatccctactctttgctttgcttttcttcatagttttaccacccatgtatatgtctctaaagaccatatttagtttctatttttggaatttatatgaatcaaattatactgtacacttttgagactggtttcttttgctaagcattatgagattcatccttatcattgtatgtagccatagtgtgtttattccattgtatgaatgtattacattacatatacttttttcattttactcttgatggacaatttggattttttccactttggggatatttcaaacagtgcttctatggatattttgaacatgtcttctggagtttgcatctttaaaaggacatatacataagagtggaacctagatcatgccaactgtttcccgaagattctcatactgatttacattcttcccagggtgtattggcttttccccagccccccagtctggtagatgtataatggtatcatattgtagtttaaatgaccattttccttatatggaaaaaaaatatgaaaggtgttcatgaggctgatcacatttcatatattttttgaccatttggatttcatctttggtgaatgaagtgtgttaaagttctcccatttttctcatgaatttgcaggtggttctttatatattctggctactactcctttatgagttgtgttgcagaatcttttcccactttgtggtttgtcttttcacaatgtttataaatatagtaacattttaattttaatatcttcaaataatagttttcctttatggttagctcggttttttttatggttatgttaaaaatatagttaatattctcttgttacatgctttgtagttttgcctctcacattttggtttcatcccacttggaacaatcttcaacatatagtatgaggtaatttttttgctgctatagggctagtctgttgtgccagcactgtttattgaaaaaaaaca

SEQ ID NO: 211048 - DNA, 324 bp, Homo sapiens
atagacgtgtggaagaatagtgaatagtgtcagagatagttaaaggtccatacagaagttgagaaggtaataagtaatagtggcttggactacaatatttgttgaataaattttttaaaaaaacaggctacctacaatttgtgttgaagatatgagtgaatgaagtttccacacccttatgtggagtcctgctaagtaagcaacaataaggaagggtccccaggttggggagagccccaagttgaggagaataatgaacaattattgtatgaacaattgttagagacagctaatcacaaacaacctgcgggcacaatgacctca

SEQ ID NO: 211049 - DNA, 647 bp, Homo sapiens
gtctgtccttgatgcaaaaatcccctctgcttcctctgcagctgcagatcatgcttgctactacagtctctcttcccgacccaagaagaactatctgtagggtcagaaaaacaccccagcctcttcctgcttctagccttcctgctctgtatccacacagctgaagccacaaaacaagcaagcaacaaacaaaaacagaataggccccaccctgacagcatgaaagtatatgattatcttttcccagatagaagagaataatcttccacccagctcttaaaagagaaaactttctgtctccagccacagctgttggcttggtaaaagttgaatacaatcaacaacccttgtcccagtccctagaaaccttcaaatgttaacaactgccttggttgagagtgagagatcacttcagaaaacctagtactaaggaagtatttctgtaagtgcttgcgagtaaatgcaaataaaacaagattttttaaactgagacttaaagcaattttactatgtacctgagtcaaggttctactcatctttctagtctcaggtggaagacctcttcttccagcaagccctcgagatgttaggactatgtttgttgtctctgctatgtgctcccatatcctcctcagtgtctcccgtca

SEQ ID NO: 211050 - DNA, 467 bp, Homo sapiens
cctcaagtaataactcaagtactatctcatatttatatacttactttcttttttctttttgagacagtctcgctctgttggccaggctggagtgcagtggcgtgatctcagctcactgcagcctccacctcctgagttcaagcaattctcctgcttcagtctccagaatagttggacacaggcgtgtggcaccacacccagctaattgttgtatttttagtagagatggggtgaaactatggagacatagtttcaccatgttggccaggctggtctcaaactcttggcctcaagtgatccactggcctcggtttcccaaagtgctgggattacaagtgtgagccaccccagcctatatacttactttctgtctgggaggtagtttctaaaaccaaggttttctcattcttattactgttgactgactggaaataaaatttttgatataaagtattatgtgtaaaaaa

SEQ ID NO: 211051 - DNA, 510 bp, Homo sapiens
ctggttttgataattagggaatatgctttgcagggcaggaagctcacatttctttgtgtccccatggcatctggcacagcacttttcactccaaagacctgcatgactgtgtgttgcttgagaggtctgagcagctcatgttcactttgtgctgataacctggagacaggaaggaaaggaacttcttctcctgctgtaagggcaacatggcgatacacagcacatctcaaactctgtgcatcccagtctcctggaggacttgttaaaacaaatcgctgaacctacccaccagtttctgagccagtggttctgcatggggctggataatttgcacatctaccaagatcccagctggtcttggaccccactttgaggatgactgtcatactgggaagtacaacccaaattcgaatcccatctctgtggcttactaaccacgggcaagtttctagaactctcaggatccagtagcaccctctgtaatgaaagcataataacatcaacaagttg

SEQ ID NO: 211052 - DNA, 311 bp, Homo sapiens
aagaaaaaaattacaattaaaaaaattttgctctctgagtccctgaattcaatggactaaatccaaaacccagcctagggaacatgaagacaaagtacctattttctctcgcagggattattgggcacatcagtgtcgctggcagcccctccctgacacaccaatatctactgcctccaccttctggagctatgtgagggctggggtccaaggtcagggtgaagctaatctttctcctatcttcccttcctagcacacacaagattatcgtccatagaataatctcactcactagatccatagaaagatct

SEQ ID NO: 211053 - DNA, 328 bp, Homo sapiens
aatgtggttgagtgaggcctttgatattcacgcacagtccctcgtgagcacggggtttccttccatcacagtttggatgacggatcactgatttcaataatcaccaacgccaaaaatctgaatgtgggtggtcagttccatcttccacatgtataaccctgtctcttgttcttcttttctcatattttccagaatctttctcgacttgtttcaccctgactcatatcactgatttgattttccatggcatttgtgttgttttctgtggctgttctaacaaattatcacaaacttggtgacttaacacaacagaaagtcattccctcag

SEQ ID NO: 211054 - DNA, 440 bp, Homo sapiens
cctttctgagtttcttcctagcgaggccgagagggtctttgaggaaaatcccgcatccggacacgccttgagggatggcgtcaaacccagaggcttggaaaagtggagacggagtttcaccatgttggcaaggctagtctcaaactcctgacttcaagtgattcgcccacctcggcctctcaaagtgctgggattacaggcatgagccaccgtgtccggccccactacattcttaaagaagcaataaattgaccttgtttaaatacacaatctgaattactggggtcttttgaaactaaacctttgttcattactaagatttctattttccttcctctttttcagcacttatttctatagcagtctcccagctgatgccacttaacttcattgaacaaaaaatgaggtttagaaaatcacaataatcattgtgaaagtat

SEQ ID NO: 211055 - DNA, 361 bp, Homo sapiens
aaagacgaacagcaaagagaattagaatgcaaatactctacaagacggacaatactgggctgggtggtggctcacccctgtaatcccagcacagtgggaggccgaggcaggcggatcacttgaggtcaggagttcgagaccagcctgggcaacatggtgaaaccccatctctactaaaaataggaaaatcagctgggtgtggtggcgggtgcctgttaatcccagctacttgggaggctgaggcaggagcattgcttgaacctgggaagcagaggttgcagtgagtcaagatcataccactgcactgggtgacagagccagactccgcctcgagaaaaaaaaaaaatgtgtagcccaggat

SEQ ID NO: 211056 - DNA, 469 bp, Homo sapiens
tggggagcaaacagtcctgggcagaggggaggcacaggaacatcatctctaagaaggtctgcattacagcctgcagcattatcttcataagtaattagttaccctactgaactcatttcataatttgataatttagagaatgagctagtttatatctgtagaaaaaatttttaccaatttcataaaattcaatatttctgcagaatgcctttaatctttgaccaaaggcattttctgacccctgaattttgttgtcaactacttgcatcctaaattactcacacttattagctctttatttcctgtcccatcagtgtccagtagattgtgtatatccccatttgttgtcctgctatgctgatgtgtactgactctgttggtagcatgtcccattattacccagtattatcgggtatcagtttttcattaaactctggttgactgttgatgtaaccattatttataattg

SEQ ID NO: 211057 - DNA, 651 bp, Homo sapiens
agtgtcaaataggcggaagccacccccgaataattatttcttcaggacttataaatgtgtcagcttgtgtgcactttttgttgtgggtgtgtaagacagcccagcatattgatagattttaggttttctccacaaaatgcaagtttcacccactcttgggtgtgtctcactcagcactagcccacacttgctttaagtggaaattatggactgtgattggctggggtgtccccattcctgtcacccaggaccacatgagcacagtggagggagcagggccggaggagggctggccctcaatgtgcccagcagctccctcccatgtctgaggcacacagtctacacacaactcccacttgtgtgtacatttattcttatgggcacaggggcagtcttgcctgttcatggacttggtgtctgcccttgaatttggcctgtcaggtcctctttgttaagcaggcacgcactgcctagtgctgggtgttaaggatcaaaaaatgggtgtgactgtagaaaaacagattgcatcacaggacaggtaatgcacatgggcctggaccaaggtgtgaatgatgctcagtctttctaatataagaatcctgcacgttggagcaccaccaagacatttctgggttggcaagcacatggagt

SEQ ID NO: 211058 - DNA, 1209 bp, Homo sapiens
  misc_feature (2)..(2): n is a, c, g, or t
  misc_feature (5)..(5): n is a, c, g, or t
  misc_feature (7)..(8): n is a, c, g, or t
  misc_feature (11)..(14): n is a, c, g, or t
gnacnanngtnnnnctggattttcttatttaatcttcattacctgtgaaatatgtatttgtattcttactttacatatgagatcagaagttcattttcaagcagaatggaaaggtggtaaatggactctgaattaaaatatgtcagtattttaaaaggttatcttctgcctagtatttttatggaatctgacaagttctcagatcacacttgtttccttaaatcttggtaagtctgaagcattcttcattttgtttatattatacacgttagtaaggtgggagttcttttgttttttgtgttttttggccagttgataacatgaaagtttaagagaggaggccaaagtatataaaaagtcttaaactcctgcttctaataaatgtccaatatgtgttggctcctgggttgagtgtttattaatgggtctgtactaactctaaaacattaaataagaatggtatgttctgaccagccctcaaagttcagccatttctaaaagttcaaaaaatcattgtaaatattttttaaatgaggtacgagattgtacctgtctatggccagtaacacaagaaatctaggctcatgcagagttttagcatagttgaccctcagtatcagtggagggattggtaggaccctcagtgcataccaaattcttcaggtgctcaagtcccttatgtaaagtggtgcagtgtttgcatgtaaatctatacatgtcttcttgtatgctttaagctgtctatatattgcttgaataatctggtaaaatatcttacatattattcatgtagattcagtatagtatttgcgtgtggcaaattcaggtttggcttttggggacttcgtgagattttttttcctgagtattttcagtctgtttgtggttggatgcaggaaccacagatacatagggctaacttaagtaagtgccgacataaatgcgttagtcatagaggtaaataacaaagacctgagtttggtagtaagttccccgaaatgaaatgttagtatactcctaagtgattagtaattagatctcaggttgaatatactaaatccttaataactgcatgtttacttttaagacctagatttgtcagtatattagtagaggtgagcatgtactaattgttcacacttgtttataaaagcatatatactgtgaatttttagtacgtttaatgttgacttcaacttacatagactg

SEQ ID NO: 211059 - DNA, 608 bp, Homo sapiens
atttaaaagctactgtagtatcttttggaggaaatgactcacccaatatcatgcaatagttatagacaggtatagtaccagaatgcaagtctcccagcactcaacatggattactctttatagtaaaccatgctggctatttaacgatgtgggataataactagatacttttcacaactattcatcttcattctcagtcttatatgcattattatcatcatacatgtcctttaatgtaaaatttcctactcgcaacaaggaaaggagagttcactgagatttggaatagccaggtcacaacatggaggacactgggcatttaaggggcaagggaatgggagtaggtgtgagttaatagttttgtgggttttttttcccaacctggacaacatagcgagacctcatctttataaaattttaaaaaatgcatggaatcaaatctaaaactattggtataacatgttttcttcctgataccccatgaacatacactgatgggagaagactggcgcatcttcgtcccatcagcacccccacttacagcaaaagcagagaaaacatctacaatgaaatcaaagttactatcttctgctcctgtgagcaactca

SEQ ID NO: 211060 - DNA, 560 bp, Homo sapiens
gtggggccagccaggacctgcccgggggctactgccctctgaatcaatacctccagggaccctacgttgacacccatggcctcccactctccacccctcagtcctgcgtgcggcacgtagtgctcactgggcgtctgtgtagggggttgaaggctgaggctggaacaagggcgtggcggtcgcaggctccagggcacgacggtccttcctcttccccttctcagccacatctggggctccgtccctgcagccaaggctccctggcgctgtccttggtgctgacgcggttctggaagtgcggtgccagggtggctggtgcggctcccgatggaaaagccccaccaaccccacaaagcagactcgggagagaacacgccaccgtctttagcgaatcttaccaacccagggccagagcgccctgcaccccagagcagcactcgtggtgggaacacaggctgatgtaataaacagaaaagtgactgcgggggatggggaaggcgggatgtccttagcgtcccatggaaaaaacatatttcctccagatgggatcatcgataact

SEQ ID NO: 211061 - DNA, 186 bp, Homo sapiens
tcacttctggtcaggctccatgcactcaatcagccctgcctgccaggactgtagtgcccacttgatgagaaatcacctgtgaaaatgccaggcatggtctggcacacagtaggtgctcaagaaacaaatgttaatgccccagcttccttctgtcttgtgtccactaatttggcatttggagcatat

SEQ ID NO: 211062 - DNA, 319 bp, Homo sapiens
caaatattaagtttgcaaacttattcacttatgtttattttatgaaagtgaagacaagcttattttatggcaaatgttaccctactttcttgaactgattaagaaaaaagtgatttctttctcattagtatagtggtattaaaataaaaagaagaaaaaagaaaataaaattatttttcaagtgatctcctcattaaataaaaatgcaaagtatttcctgttcagtgcagagaagacctcttaaagtatattgtccaaaaaggaggagaaaactttttacgtctaggtttcccctttggggatttctcgttgtttcagg

SEQ ID NO: 211063 - DNA, 188 bp, Homo sapiens
ttcctggcctcaggtgatttgcccttcttggcctcccaaaggctgggattacagtcatgagccacggcgcccggccttattcaccactttggatcctccagcctcctctatctgttattttagcctccatggggaggctacaaaggaaaagtctctagtaggccaattcaaagatttacctgtatttg

SEQ ID NO: 211064 - DNA, 449 bp, Homo sapiens
tatgtcctaaggcaactttgtcaacagagggtctctagatgtcaagaatcatcaaaggccaggtcatttgagctggccctttactaggggtgtgtgtggggtactgagcctaactttcaggatctctggtaaatgagacactcactaaatgacttccagccaaaggcagccagaaatgttagtcatgggaaaaattaggcaggtgtggaagaaagggcatgggatgaagtgaggaagccttgcaaaacgatgctaaagctagctccactttctcatctacaaaacagataggtgtaaaaattttaattttgcagaaaaaattcaagtaaatgaattggaatttaagaaaacaacaaaacagctttccctttgtccataaaggtgttcaaaccctagttataaatctatttgctcaagaggactgactttctagattgaatatgccctgt

SEQ ID NO: 211065 - DNA, 568 bp, Homo sapiens
tcccctcttcctgcagatgcactcaagggcagcaacagaaaagccccagaacacttacagtggctgaatcttagtaccagcccaggttctcagaatggagaactcagaatttaagaagccccaggcctcagagccttacagctgcaaggttccttggcattcaaccaatccattctctttccaatgaagaaccacccagaaagcatctggccatcctctgctgcttgcacactgccaatgacaaggagctcactacctcccaaggcaaggcagacagctctggagccatgagtcgtttggcattatgtgaacaggctgtcactgagtcattcacattgtctcctggttgtcctcagagccagggacagaagttcttagaaccactcatagggtgttgggtgggtaagggaggcagctgagggctggatgaatttttctatttaaaacaaactggctgtctgggcgtggtggttcatgcctgtaatcccagcactttgagaagccaacacaggcagattacctgagatcaggagtttgagaccatcctgccaacatggtgaaaccccgt

SEQ ID NO: 211066 - DNA, 460 bp, Homo sapiens
tcagaacttgtggattgtgctgaaagcagtatggcctctggcagtgaagtaaaccttggcccagatactgccatgaggtggctatctagctgaacattttagtacaattctgagacttgcatatttattctctcatttcctagaaaataccggccaaaaaaagtatgaggtctataaggaggaggaaaaacatgaagtttaacatgcctatagaaaaatttacatcccatgaatgtatataatttgctgctgttttacacagcaaaagcacccctgtgactagcacccagatcaagaaatagaacaccacctagctctggcagcttttaacaattttattctggccgggcgtggtggctcacacctatgatcccagtactttgcgaggctgtggtgggaagattgcttgcgttcaggagttcaagaccagcctgggtaacatagcaagacctcgtctcta

SEQ ID NO: 211067 - DNA, 231 bp, Homo sapiens
ggtctccatgtaagcgccgtcctgcaggaagactagaagggtaacctgggggtaaatctgaaggaccactgtctaagacaacacttggtttgtgggtctgaaatacacgtagaatttacaggcatgataataacagcacaaagactgataaaataatagcacaaactaacaataaggaaagaagaataattaggccaggcacagtggctcatgcctgtaatcccagcactt

SEQ ID NO: 211068 - DNA, 475 bp, Homo sapiens
tcaaagaatatcccccttttttttttggtagagatagggttttgccatgttgttggtagcaagccctaaccctgtcataaacaggccttaaataaactggccataaacaggatttctgcagcaatgggacatgctcatgatggctgtcatgcacactgcgaaaagttgttggtttactggagcagggcaaggaacacctggccccgcccggagcaaaaaactgctcaaaccacaaacgatagcaggaaaggcctgtgccttggcagcatgtttttgctgcagataatcagccagagcctgtttctctgctcctcgctgagattgctttgtttcccataaagattgcttttagctaatctacaatctatagaagcaatgcttatcactggctttctgtcaataaatgtgtgggtcaagctctgtttgtggctctcagctctgaacgctgtcacccctgatccccactttatactgt

SEQ ID NO: 211069 - DNA, 348 bp, Homo sapiens
tctctcagacatcatcttttaggatcctggaagaattactgggtataggaaagcctggtctaagaaagtagattttcttacagaggccagagacacagttataactgggattgatgtcagcatcataaaaacacaagcaggcaggacctctgtcttagtatctgaagaactgatatgacaaaagaaagatgtcttatatatcatgaggtatactagaaatgagcatagataaatcctagaattatttttaaaatgcatttggcaggccaaattttatcaatcactatctaaaattaatgttagtttctccaaattatcaagcagttgtactagactataatgtcacta

SEQ ID NO: 211070 - DNA, 356 bp, Homo sapiens
tgcgctactcccacactgtcacccaagctaaagcaaaatcacccgctgtccagcgccaagagaaggtgccgcagacaaagctcaacttgagtctcctggagagagttaaaggcactccagtgtatggggagatcaggtggggtcagagagcaataaggtaccaggcaaaacaagaaaacttgtacttgaatagtggtacactttagtgctgagtgaggcagactctattgaacataagagtctttgaagcaagtgaaggcaagcaactccagtgtcagcctcagctttagttggtggtagaggacgtcgaagaagcagtactggagagtagaatcttctagttatggtgtgtacct

SEQ ID NO: 211071 - DNA, 487 bp, Homo sapiens
catgccctctcccaagattctccataaaattagttggttgcttcttgccctgaggcagcccagtgaagtctagggtgtggtgatcccatgttgttgatggggaaaaagggagtgatggggtgcttgagggcttcttaagccatagttcaagcatagcgagtgccccctcttcttctgaaagggccagatacctggcctcatcctctccacaaagaactctcttgggatcctcaggggatccaggttagggcagagccctagggctcagagaggggggtcagtaattaacctgggccctagcactgtaaaagtgacagtttgatctccccactgtccttcttcccctgcccaccagggacaaggcttccagaaagaggggaccactgggaaattctgcctcttgttcagataaagttcttcccgctgcaaggctccgagcttcattcttcatcctcagatctagaatgggatggagggcagttaattt

SEQ ID NO: 211072 - DNA, 366 bp, Homo sapiens
aggagtaggaaaactttctatataatgaggagactaattggtcaaaactgattcacaactggcacagatgttagaatttttggaggacgttaaaactgttaatgtaactgtattctctgtgttcaaaaggttaagtagggagactaattggtcaaaactgattcacaactggcacagatgttagaatttttggaggacgttaaaactgttaatgtaactgtattctctgtgttcaaaaggttaagtagcaatatggaagacataaaaaaactaaagcttgtagagattaaaatgtaatgaaaactacactggatggaatatagcacacaactgtgaaggaaactataccaaggcacatcataatca

SEQ ID NO: 211073 - DNA, 378 bp, Homo sapiens
actcttccactagaaaccttagtgtccccacatgaggaaagcacttcattatgtcctgaggaacagttggttatagaaaggctacaaggagaaaaggaacagaaagaagattctgaactttctactggattgatggactctgaaatgactcctacaattgagggttgtgtgaaagatgtttcataccaaggaggcaaatctataaagttatcatctgagacagagtcatcattttcattatcagcagacataagcaaggcagatgtgtcttcctccccaacaccttcttcagacttgccttcgcatgacatgctgcgtaattacccttcagctcttagttcctctgctggaaacatcatgccaacaacttacatctca

SEQ ID NO: 211074 - DNA, 287 bp, Homo sapiens
gctatgaatccagaaaagatgctatgaatccagaaaagatggagactgaagattttcaaagaaactctcaataagaaactgaaaaaccacaccctgtccagtccttccaccctctcagttccctccctcccaaaggcttgcccccatctcctcctccactttgccatgccttccgccatgggatgatgcagcaagaaggccctcaccagatgccagcatcttgactgtggacttcccagcctccaaaactgtgagaaataaatttctgtacaatataaattacccag

SEQ ID NO: 211075 - DNA, 490 bp, Homo sapiens
cactcaggaaacaaactaggagtaggtgcttgcaagtaaattgactataggagaaagaaaagaacaacattagaaagagaagatcacacagaggaaaagtgaattataaggtgaaacgcccagcaaatatcctgtaattcctctgcactgcacaagccagaacatgattctaattcttccatgctagaattgacaacacaatctactgagagaggttctttagcatttaaaaaatatgagaataaagatttatttggcaaaaattttcttattattaaaaaaattttagataattttttacagccctctgtgcagaagacacgtatctcataaaggaaagacatttatatatacacacgccttgcattttaagcctcaaatgattcttctaaaaatacaaagtataaactaggtatttggcacgaaaaatttaaaagaagaatgtacaatgtctctttttttaaaataaaatatttatttcaactttgca

SEQ ID NO: 211076 - DNA, 475 bp, Homo sapiens
atcatcttcagtcttacattgagaagagtgaccttggctgtctttagtatatagagctttgcaaaatcattctacgaccaggcaggtataatattccataatctactggtgggagtgttttttaaattgtggtaaaagtatagaaaatatgccatcttcatcatttttagatgtgcagtttagtaacattaggaatgttcacattgttgtaccaccacactccataagcgatgtatttactagtgaatgcaccaagtgatgatttgttgtttttatttttattttcactttctggttcttttaattattttttttattaacccttatctatgtgatggaatgtttttctttttatttttttttttttttgagacagagtctcctgtcacccaggctggagtgcagtggcgtgatctcagctcactgcagcctttgcctcctgggttcaagcgattcttatgcctcagccttatat

SEQ ID NO: 211077 - DNA, 479 bp, Homo sapiens
atgaagcaatcagtcatcaatccctgggtgggtagtgaggaccctagaaagccttcctctctactcttgaatttactgaatgacctaagaaaaatcacatcaaggaactgttgccagtctgtcacttaagcagctgctaggtcacctccactatccaacacggattaagggaatttctgtggctggtcagctgctgccttgaacagcgcttggagaatcggcctatgagcagctggttaaggaacaggctgcactgggaagggtttatattaatagataccaatctggagaaagatttattattttatccttaaaagtataacagtatagtatagtatacagtatagattatatacagcttattttccacttgtttctacatctatgaaataaagtagtgatctattttcactactctttccaaaaatgttaagtatggagttttgataccatctctagatgcccttaccttctttcta

SEQ ID NO: 211078 - DNA, 492 bp, Homo sapiens
ataatgatgtctttaatgattttatggactctgcagggaagctttaataaatatgaacttagaaatactttgtatttttgatagataccattagcccaatttccaaagaaggtctataattttaattatgaagtgatgataaatgttcttatatgcctttcaacttcagagggattttttttcctgctattagtggaatatacttcatttacagattagatttctgagaataatttaatagtaaattattgttttaatatactgctattcattttcctaatagtttctttgcttcagttttcaagtgatattattatagtttcctttgattatagtatcactttctagtttgtggttagtgttctgctagctttatagaatgaattaaggatatttggggctttcctatattctgacacatttaaatagctgagaagttatctatttcttgacatttgtagaatttcacagtggtatttttaagcaaagtac

SEQ ID NO: 211079 - DNA, 669 bp, Homo sapiens
  misc_feature (579)..(579): n is a, c, g, or t
  misc_feature (616)..(616): n is a, c, g, or t
  misc_feature (647)..(647): n is a, c, g, or t
tgttatactgtacatacctctggctgcccaaagctgtcaataccatgtgtttccaggcctacaatcccacactgcctccctggtattgttacaggtagtgtggagaaagaactggatttataattagtagtctggacttaaaactccaacttttcttattatttatttatttatttatttttcttgagatagagtttcactcttgttacccaggctggagtgcaatggcgcgatctcggctcactggaacctccacctcccaggttcaagcaattctcctgcctcagcctcccaaatagctgggattacaggcatgcaccaccatgcccggctaattttgtatttttagtagatggggtttctccatgttggtcaggctggtctcaaactcctgacctcaggtgatctgcctgcctcagcctcccaaagtgctgggattacaggcgtgagccaccacgccgggcctatttaaagaactcttacagttcaacaacaggccagggacagtggctcatgcctgtaggcccagctacttgagaggcggagctacttgcgctaccacgcctggctaatttttgnattttttgtgaagactgggtttcaccatgttgccaangctggtttcgaactgctggactcaagcaatncacccaccaaaagtgctgggac

SEQ ID NO: 211080 - DNA, 376 bp, Homo sapiens
aggctggtcttgaattcctgggctcaagcggtctgcctgcctcaggattcctattcactctttacaatccagctctgctgcacccctgagcttctggagatgccacagaacacttgtctgtgctcctttgtggcactcaccacgttttgttaaaatgaccaatcgccctccttgacagggttgtgtgctgcttgagggcaggggctgtctcattcacgtggaggttcaacacatgtctgtggaatgggtttcgctgccccaaagctgattctatcttttgctgtgtttgcattggaacaatgggcagaaatgatttcctaattctgcttgcatggggtaggtcagacaacttggatgtgggttttagttctgggtc

SEQ ID NO: 211081 - DNA, 384 bp, Homo sapiens
gaaatcaggagagtataagtggctatactaatatcagacaaaatcgaatttaagacaaaaaaaagttcagttcctagagtcaaagtagaacttttatgataaaatagccaatgtcttctatcaggaagacataattacatgtacttaaaaacagagccccaagattcttgaagcaaaaactgacagaattaaaggaagaaatagtcagttaaacaatgatagttagaaacttcagtactccatcttcaataatggatagaataactaggctgaagatcaacaagaaaacagaaggcatgaacaccaccacaaagtggacctaatagaagtctacaggacatgctacccaacaaccacagaacacattcttcccaagcatacatg

SEQ ID NO: 211082 - DNA, 424 bp, Homo sapiens
ggaaagtgatgaagaagaaggcagagaagaactccattttcctgagtctggtctgaaagagggtacctcccacctgaggagcaggaggacattcctgggggtccctgagacaatgagcttgaggtgcctgaggggcagccaggggaagatgtccaggggcaggctccaggggagtggtccagagccatcacgtttggagccatccatgtacaggaaggagcaggagctgagccaacgatgtgatgagcaggagagggtgcagagactaggagagatggctctgccaaggagagaagaagatcaaatgctccccagagatcaagcagataatccctggaaagtgagtgttgaatttcacagccccgcagtgcccagagtgtcaagaaggtataggatgggcgtggtggctcaaacctgtaatccc

SEQ ID NO: 211083 - DNA, 211 bp, Homo sapiens
tgttcttgaagcagacacttcctggctgtgagactgcatattagcagttgcccctaaggactggctgcagatgtcatcactcccattgggtctccttggcattggctctcagtgtattccagagcctgttcctcctagcaggaacaactctcagaagtcccatttggtatggctcagagacggtcccaatgtcttgtctactgcaactctt

SEQ ID NO: 211084 - DNA, 512 bp, Homo sapiens
gtcctcactgcgcgtccacacctcgccttggtttcttttgttttattcaagccccggccccgcggtacagcggggagactcgcccaggcccacggaagaagccgagctcctccgaagggagaaccagtgattccacggaccccggaatcccccgggagtgggaccaccaggctgcgggcggaattaaccctgccgcggaggcgctgggcgaggatgagggcggcgagcgcggaggggaccgagtcacacagcagcccggcggcctctgccggcaggccccgctcgctcctttcggcccgacccgggcgggggttccggtgccgccctccctaccccgcacgtaggctcgtgggggcggggacagggggacgaaaacaaccgcgtcctcagcctgactgaacaggctcggactcctccgacggcgccgcgccgcgcacagatgagcctttgtgggaccccgcggaaggaggcgccggccgcagccacattcctttccgggcaagcgcggccgc

SEQ ID NO: 211085 - DNA, 454 bp, Homo sapiens
tcaggtcccataatacacactaataaaagagaattgaagaacaaattaccaaaaaagattataagaaagcatctagctctcataaatatgtgcatttgcagataaaattgctaaagcactatcagtgacctttgaatcatcatataaaatagaagcccctgaagattaaagaaatgaagtcctaattgtcaaaaaaagagaaaggcagatccacaccacagaactacagaagacaggtttagtgacaatgctatacagtaacatcatgaactggtcaggagcagcatatggcactcaactgaagtagacaagggctcactaagcataaaccaaggcctaagccttcatttattctgtgagttatcagactagtaggtgaaatgaatactaaaaatgatatctggacttaaagtatccaccaaattctcttctgataagaggcagggtttctaac

SEQ ID NO: 211086 - DNA, 548 bp, Homo sapiens
tccatcgaacacccctatgagcacagcactcggcacctcccgcaggcctgcctcagtgctgcaaagaaagggccgcgacactctcatgacgagaagctctgcttctccacagccagctcaattcacaagcttgggttacaagtctttgggaggcaaacagagaggtgaagaaaagcaagtgcaaaatgatgcttcatattagcagaggctgcagatctgtgccgagtggggtggagcttcctggcagcctgcctgcctagcaatctgccagcaaaggaggaagccccttccgtcgctcccaggcacacaatgtggtcatgggcgagtgtgccctccaggccaccacggtaggcccagaccaagggacatgcctgctcagcagcatccacaccagaagccagttcgactcggcccagtgcctctgccccatagcccctgtgatctcccaggtggaacctggtttgaacctgctgagacccaagtccccacttataggaggcagagaatgggtagccctccccctccaggcactctggataattaaaaaa

SEQ ID NO: 211087 - DNA, 386 bp, Homo sapiens
agggtgaaaagtagttcccataatacacatggttgactatggtgatccaccttgtgatggttaatattaggtgtctggagaaggttgcttcattggccctgggacttctctctgcaggaggagagaccgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggggcggttctcgaggtgtgtgccagctacacgtgtgttctgtatgggtccagctgcgtttccatcactcgctaataaatcaacagaaacac

SEQ ID NO: 211088 - DNA, 223 bp, Homo sapiens
ccacaggcgctaaaaaatatccaactcacaaagcaggaattcatccagcctcatatctgtctcaccttgcacaaagcctgccttcacgggttgctgaaataatcccaagatacccttccaggacttaaacagccactggatttttcatgaaaatgcaccctggtatgaacactcacagtagtggccagaaaaataggggtgcgcaagctgggtcttcctctct

SEQ ID NO: 211089 - DNA, 404 bp, Homo sapiens
gccaggcatggtgatgtgtgcctgtggttccagctacttgggaggctgaggcagaggattgcttcagcccagaagttcaaggctgcaggcagctgagatcgtgccactgcactccaatctgggctacaaagcaagaccctgtctcgaaaaaaaaaaaaaatcatcattatgaaccaaataacagcatagaccactaatttacaacttctggactacagaagtactctaacccatgtatggcagtaaaaccttttcttcaaacaaaacctctggtgaacacccacctccccatcaaagggaaccgctccaggttaagggggcccttcctccgaagttagaagacagaagggggtttgtgattgccctcagacaagctctttgccccgcctgaagagtgggacaac

SEQ ID NO: 211090 - DNA, 475 bp, Homo sapiens
atatttataattcttgattagccatattttatctccataaaagtcataaaatattgatgaatataagatttatgtagagatcatctttctattgacattagcagatatatattatagtatctggtttttttgttttaaaaattaagtttaataaatacaacttatttttaccatgtcactcttcagtaccactttctaatatttaacacgtttcaaaatgtataaatacggcctcctatcgaatcaccactgaaggtcaagaatctacctttatatgtttatagtaccttgcatacagaaggagaacaataatatattttgcataaatgattagataaataagtgggtattacctgaatacccacttattattgactcatctaaccaacagaagttcagtctggctgtagcctctcagaacagacattttgcaaaatatatatattggactattaggaagaggaccttcactgta

SEQ ID NO: 211091 - DNA, 393 bp, Homo sapiens
acatgatctcatccaaccctcccagtaaatttcataatgagcatcttgaggccctgtgcaaagtctcacaactagtaaatgccaaagctgagctacttatggagcttgtctctgaagcccacacttgtaatctttttgtgatactgttcctgtggcacagttgtactgttccagtggctgcatctgtttgcattttcttctcaagatgcatgtttcctgatacagggatcaatatattttgattttagatgaaaattgatttacttggcaatttttcttttaggttattcttttataatctaaaaaaggtatattattttcttttccaagtagagtcctcttatttttatatgtatagttgaataagaacagctatataatgcagttaacaat

SEQ ID NO: 211092 - DNA, 107 bp, Homo sapiens
acacacacacacacacggtattcttatgaaaggagtactttgaaacacttcaacaaatgagctaaagacatgaacaagaaattcacacatacaaaaaagagacatgg

SEQ ID NO: 211093 - DNA, 713 bp, Homo sapiens
ctggagtctcttctctaaaatgagatgataatagtactttgataacaccctgctattgtaaacctctaatgagacaaacaatggaatccaatgcagaggttagtgatgatgtaggcagaagccacccaggctgctgattgtgcaatgacacccacaccctatgggaactagcatggctcaatcccaggaacgccactctgagccttggagaagtaactaaaatttactcctttaagaatctcggggcttggagaaatcccagtaaccatagcaacatgactcaggtagggttttaattagcatctgggttgagatcagagttttttcggcccagtttgttatgataaaacccttagattgcatatagctcaagcttgatgggaatcttggaggttcaaggtttcagctcttaaaaaataaacaagttagaggagaaaaaagaattaaaaagaagggccggacttagtggctcatgcctgtaatcatagcactttgggaggccaaggcaggcagactgcttgagcccaggactttgagaccaacctgggcaacatggtgaaacccagtctccaccaaaaaagatatgaaaatcagccagggatggtggcacatgcctgtcatcccagcttctctgggggctgaggtgggaggatggcttgagcccagaaagtggaggttgcagtgagctatgattgtgccactgtactcctgcc

SEQ ID NO: 211094 - DNA, 2801 bp, Homo sapiens
  misc_feature (110)..(110): n is a, c, g, or t
  misc_feature (906)..(906): n is a, c, g, or t
  misc_feature (1790)..(1790): n is a, c, g, or t
gttgcagtgagccaagattgtgccattgcactccagcctgggtgacagagcgagacttcgtctcagaaaaaaaaaaaaaagtaaggtggatatgtgcagtggctcaggcnagccagcctgcaggaccacctttgggaggccagagcaggaagatcccttgaggctggtccctaactcctgacctcaagtgatccgcccgcctcagcctctcaaggtgctgggattacagacatgagccaccacacccggcaaatgtactgtattttagttgttgataaatgtgaaaataaatagaacagggaaaggggataaatagtgggtgaagcggtggaggctgcaattttcagcaggacagggagggcagggtccacggcaaaagtgacagttgggccctagaggaattagaatgtgaggtgaggctgggggacggaacctgtggagcacagaggctactttgaaaccatggaggtgcagcgtgtcgtggaggaggagtgtatcctctgaagcacgccgatctccagagattccttccttactccctctttgctccagccagtggaagtatggctggtgtgagagtttaccttctgaccagaactgtctcaagaatttaggaattcttgttgcaagaatgttgcaagtgcttgtaataagtagaagaggaatagaaggaaggaattaagagctggaagctccctggtggggattctgagcttgtataacacagttaacattgttccccttgaggatattcttcatttatcagcatcatgcagaatgtcaccattcaggagttgaattgtgaattcaattaagtagtgatttgggtgttcctaggtagatatactcacaatatggtagagttgaaaaaatgatggagataaaaacaattttggagggaagtgntctgaaaatacagagcaaagttcttgttttccatttagttaccaggtattttgtaaaccttatgcatgacctttgtatttacagaacaaatgaagcatccattaacttcgaatgatcagatgctagggtgtgaggaattttcaggccaaaatgcactgggttattgtctcctattgacagtgtgatattacagataacctctaggagatcctgaacatattcaggctaaaccaggcaaacaaacattcaggatgttaccagtgtggaaaacccctaggaggtaagtatggcagggaatcagtctgagaaagagggtaaatcgaatgaagctattttggttataaaagtgctgcgaatgtatgagagtacttcaaaactactctctatgctacaaaagccaataagtttagttatgcagttccttttgtgtcattacatttcaatagagtttatttagttttgtttctgtttcacctatgaaatgtgtattagtcaggattctccagagaaacagaaccaatagaatatatgtagatatataaaaagggatttgttataaggaattagattgtgcaattttggaggctgaaaagtcccaccatctgccgtggaaaactggtggtatagtttcagtctaagcccaaaggcctgagaaccaggagaacccgtggtgtaagtcctgacttctgagacccaagaaccaggagctatgatgtccaatgtcccagggcaggagaacatgcatgtcccagatcaacatgagagagataattcacctttcctctttgttctctgtaggccttcaatagattggctagtgcccacctacattgctgagggcagtctctttattcagtctactgattcgaatgttaatttcttcngcagacattctcacaaacacacccaggaataatgttttaccagctacctggctatctgtttagcccagtcaaattgacacatgaaactaaccatcacaaaactcaactcttattttaagatagcagctttaaaaaaatttactatacacatttaattaaatttattttcagtttacctctcagttgtactacttactagctgtgttacaatgagtacaacatttagggtttctgcaccttgatttagttctctagaaaatggtgagtactactattgtctacatcacagaattattttgaggattaaataaaattaaaattataagggctgaggacattacatggcatataatacataattattacatattagctataattattactgttgtgtcatcattattataattaccatcattttctcacagaagcatttcagggctgttattacaaaactctttcccttgtgtttccaatatgccaactatttcaatcaagaaaattaatagcctatggaaagacagtggcctttgtcatcactacgattgattctattaaatgtattaaaagtaatggcaaaaaccccaattacttttgcaccagcataaaatcactaggtgcatgaattttgcataattcttttaatttctcagaaccttgatgtttctcatttgttcaaccaggtagatattattaatcccttcaaagagatgtgaagaacaaagttcagaaatgttaaggacggtaaacgatatcatatttaagggcttggcacttcgttgactcgataaatagtagctactactttgagctattattccctttcatgaaaatcctcctactaaaactatgtgcttcttccaacagagacagccaaaattaagactgatggagaaatttcccccagcaataccacttaaaaatatgtattttttactttaattgcctggtattaagttttctgcaggaatacaaataaaattgcttgtatggctttgagaaactacagtt

SEQ ID NO: 211095 - DNA, 551 bp, Homo sapiens
agtcaccaaccctctacttggtcctttgcaatcctttccagaccttctgtggtctcctgtcacacagggctcacctggggggaccctgatggccagattctcttgaacagtctctagggacatattgggtattgctataccttcatccattgaacagttttccagtggctccataatatgtgatatcacaacagattgaatgcagaaacagaacaaatgaagcatccattaacttcgaatgatcagatgctagggtgtgaggaattttcaggccaaaatgcactgggttattgtctcctattgacagtgtgatattacagataacctctaggagatcctgaacatattcaggctaaaccaggcaaacaaacattcaggatgttaccagtgtggaaaacccctaggagagacagccaaaattaagactgatggagaaatttcccccagcaataccacttaaaaatatgtattttttactttaattgcctggtattaagttttctgcaggaatacaaataaaattgcttgtatggctttgagaaactacagtt

SEQ ID NO: 211096 - DNA, 333 bp, Homo sapiens
atgaattccctttcattgaagcagcaaaccctctggggattccttttgatgaaaatgagcctttgtcacaatatgtccaacacagtgattgagccgaacagagttaaacaggcagcatcaaatgaaccaaagtacttggcagaattacattttccttgaaaaaaattctacattttttttttgcattaaaaaaaccaacctctctatgtaaaactaccagcatcataaaattcactggaaataatgcaaaggaaatatagtataatggcagagggaaacactaatataccaatacaaataaatattaaagttcagagtcaatctcacttgccc

SEQ ID NO: 211097 - DNA, 415 bp, Homo sapiens
atcctcgcgccaaatgtgcaaaaaactgataaagccatgtaaagtctgatgtttaggtagtagtaatatagcaatgttgctttcttatttttgatggatgtactacagtgaggaatatacagaaactctctgtactatctcttaactaacttttctgtaaatctaaaactattccagaataaaaacctatttaaaaataagtttagggccgggcatggtggctcactcctataatcccagcactttgggaggccgagatcgcaccactgcattccagcctgggcaacaagagcaaaactccatctcaaaaaacaaaaagaaaaagaaaatctgttgttcaccaactatcttatgtagatttttctagataacttccttgcagcttctacatcagcacttgcagtttcaccttgca

SEQ ID NO: 211098 - DNA, 529 bp, Homo sapiens
agccaaccacagattgaaagtgttctgtagttgtgtccgtactgaacagttacagacttttttcttttcattttcccctaaacaacataacaattatttacatagtatttacattgtattaggtatcataagtaatcaaaagacgatttaaagtatatgagatggtgtgtgtaggtttcatgcagataccacgtcattttatgtaagggacttgagcatctgtgcattttggtatctgctgggaggtcctggagccagtgtgtcccatagatattgaagagggctgtgtattataatttgtcctataacgaacccgtgaatccatctcgatagtaaaaaaggtagggtgggggtggttctttacagaaggatgccagttgataaaatgtagaaggaatgatggaatcagaaaaaccattttgtaactctcagtgtaaaaattgattcaggcaaaaatcattgatggtgaaaatttgttgggaaattaaatattcattggtttaaaagtatcacctcacaaattatttac

SEQ ID NO: 211099 - DNA, 411 bp, Homo sapiens
acaaaaaaaaaaaaaaaaagccccaagtacccatgcattccaaaacaaggtgctagaccacctatgcagaacctgccagcctagccatcacctatctctgctctataaaagagtgaggggaaagaagctaactgggagatggcgggtggtgtgatgtggatcctgccttgtctgtgggagatgggagttgggttcccccttcatctcaggcccaggggaagcggcatcaagggaatactcagctaatttcacacatcctcatgactggctaactaatttgtgggatccagtacaaaatgcaaatgtggggcccctttttcagaaagtaggaagagatggcattaaaagtaccaaattatttaaaggaaaaaaatcgtgccattactcttgaaaacaaatcctggtgaagca

SEQ ID NO: 211100 - DNA, 467 bp, Homo sapiens
cacgttccttatgagaatctaatacctgatgatctgacatggagcagtttcatcctgaaaccattcccacccagtccccaacccctgtctgtggaaaattgtcttccactaaaccagtccccagtaccaaaatggttggggaccacccatatatattatttcacacatgagcaagtatttctagaaatgggagtgctaggtcaaaaggcacgtgcattttaagttttgataggtgtggccacattatcctatatagatgtttaaccagtttatattcccatagaaatatataagagtgactctttctgctagcttcaccaacaatatgttattaaacttttggttttgtgtatttcatatgaagcatctttttgtttgagagctatttgtattttctgttaactgtctttgcatatcctttgctcattttctgctgtgtcattggtcttactgacgtataggagttc

SEQ ID NO: 211101 - DNA, 227 bp, Homo sapiens
gaaatatgaactggaaaatagtttctcttctaattaatccatttaaagagcttttaaatgtcctattcttggtattgaatggccatagattaaaggtttaattagtagtccctactacttgggaggctgaagcaggaggattgcttgagcccaggaggtggaggctgcagtgagctgtgattgcaccactgcattccacctcgagcaacagagagagatcctgtctc

SEQ ID NO: 211102 - DNA, 591 bp, Homo sapiens
gcggaaaatatttattgagcttcttttgtgtgcaatgaacatattagagaaaagacttctctcatggagactattttctagttggagaggacagatgataggttaaagaagtgaagtaccaaatactacagacaacggagcggggaaggaaagcaggagtgctggggtcactgagaaagtgaacacctgaaggaagcgagggaatgaggcaggagggtatctgtgggaagtgcactgaggcaggggccatcaagtgcccaggctctcaggtcttacctggagatcacagatctccactgtgttggagatcactgtggctggagttataatggcagcgggcaggtagagacaaaggtttgagatggaaaaaagtccagatcatgtcctgtttgtagaccatcataaggacctggctttcctgagtgaggcaggaagtcatctgagggttgtgagcagacgagtcacatgacttgacttgggtttcaacaggactattttggctgctgttgaggagggacaagggcagacacaggacactatgccactacaacacatttcagagatgatgctggcttggactagaatggtgta

SEQ ID NO: 211103 - DNA, 537 bp, Homo sapiens
ggaattgtgaattgaagtttcccaagacttcacgtaggatttggaaactttcaagactggaacagccagaaagtagaatcctcattgaacacttgcaacattcagacaagatccaaggaaagctacactgttttaaagtctcgctctgtcaccaggttggagtgcagtggcgcaatctcagctaactgcaacctctgcctcccgagttccagcgattctcctgcctcaacctccctaggagccgggactacagatgcatggagtcatgggagaagtccatgtgaagaagaagcagagattggaatgatgtatttacaagccaaggaatgacaattgccagcagccaccagaagcaagaggcaaggaagtgttcttccctagagctttgggaaagagcatgcccagtcgacacctcgatttggactttagcctcaagagtatgagaacagatttatattgttttaagtcacccagtttgtggcaatttgttacagaagccctaagaaactaataaatacatactttaaaagtttaaaa

SEQ ID NO: 211104 - DNA, 705 bp, Homo sapiens
tctaattttgtttgagtgtttttatttttaaggcaaaggaatgaatagtacggggaacccaatgtatctgtcagcaaaccatcagcttcatattttatttattcctcacactttttgtgttaatatattttaaaacaaatcccagacactatttcacccataaatatttcattgtttatctttcaaagaaaaggacttgtgtctttttcccggcataaccacagtaccattataaccaaattaataataattccttgatagcacctaatttatatgaactggccaaacagtacatctggccttagggctgtctatagattctaactcttaagtaagatgttatgttttatgtatttactactgcacagttatcattttaataaaattcacggttccaagatggctgaataggaacagctctggtctgcacctcccagcgtgattgatgcagaagatgggtgatttctgcatttccaactgagctctgaagagagcagtggctctcccagcacggtgttggcgccgacatggcaaacacttccaaaggggcctaacctgtgcactacttggaacccccatagggccatgccctctacgggtgccaggccgttcgccatctgtgccacatgtctggccctggaccacaggtgggccccacacaacaacgcggtaacacggtcacacccactgtagccacgacttcct

SEQ ID NO: 211105 - DNA, 226 bp, Homo sapiens
tggggcaggagccgcacgtgcttattaaggttggatcagtggatacactcatcccctggatctgggagcaaactggaatcaacagtgccaccaagtggcagccagctaataagcaagttgaaacactaagactgcaacttctagtgctttgcccaaatatctctgtctcttactctttttctttctaaaaataagatcaagtatattttcctagggtggatataga

SEQ ID NO: 211106 - DNA, 1517 bp, Homo sapiens
ctccctgtggtatctatttacatctatttacagcatggtttactgaatattttaagcccactgtaaaacatactgttcagagattcctttcaagatattaccactgataatgaacctactaaccaagagctcttatggaggtataaacaagattggcgttttcatgtctgctaaccgcagcccatggattctggaataattctgactttcaagtcttattatttaagaaatacatttcataaggctatagctgccactaataatgcttcttctgagggatctggataaattaagttgcagaccttgcagaaaggattctccattctagatgccattaacaacatttatgattcatggaaggaggtcaaaatatcaacattaaggcaggtgtggtggtgtgtgcctggagtcttggctactcaggaggcataggaaggaggatcacttgaggccaggagttcaaggctacagtgtgctctcatcgtgctggtgaatacccacttgtactccagcatgaacaacacagcgagaccttgttctctaaaaaaaatttttttaattaaaaaaataaaaaccaacattaaccagagtttggaagaagttgattccaaccttcataggtgactctgaggggttcaagtcttcagtggaaaaagtaactgtggatgtgatggaaaaaagagaactagaattagaagtggagcctgaagatgtgacagaattgtttcaatctcgtgaaaaaacttgaacagatgagaggctgctttgtatagataagcaaagaaagtggtttcctgaaatgaaatctactcctgaagatgctgtgaacattgttgaaaagacaacagacttagaatattacatcaacttagttgatcaagcagtggcgaagtttgagaggattaagtccaattctaaaagaagttccactatgcgtaaaatgttatcaaacagcgtcgaatgctaaagagaagtttttcatgtaatgaagagtcaatcaatgcagcaatcttcactgctgtcttattttaagaaactgccacagccaccctgatcaacagccatcaacactgaggcaagacctaccacaagcaaaaagattacaactcaccaaagtctcacatgatcattagcactttttggcaataaagtattttaaactaaggtactttacttagacataacacaactgcacacaagagactaccatatgatgtaaacctaacttatatgcactgggaaaccaaaacatttgtatgattcatgttattgtgatattcactttatagtggtagtctggaacaaaactcacaatatctacagggcatgcctgtatcttgtatcaataggtttctcttctccattgcaacatcttatatacttagaaaggcctaaggaaataatgagggctttctgtgttttctacattgtatggccccatggtgagttctcaaatgttggattgtgaccacaatccaatcccttgagaaaagaatgtgtattaacaacgacttaca

SEQ ID NO: 211107 - DNA, 560 bp, Homo sapiens
tgagccaccgtgcccagcctaccgcagttttttttaaagggcatatggttcattttttccctctgccaagagggatgtgcagcatgagtgagaacaaagtctgttttgaactactgaggtttgagtttgttccagcagcataacctagcacatcctgactgataaggatcataaggaccataactgcccttggagttggagaacaggagcagatttgagaggtagaggattagaaggtgatatgttgcatgtgaaggtggggagaaagccagaggtctcacaggcgtgtctggtttggaccactatgtagttgatgatgctgtttacaaaactggaaatggaatccaaaagattcaggagagattacttttgttttggacatgttgagtttttaggggagacatccagtgtgtacgtgtttttacaatgcctggcacatagtaggtgctccataaatcagtgaccctagatcagtgatccgggtcagtaacacagggagataggtcaggtactagattaaagctaggggtgtgaggctgaggagtcttatcataagactg

SEQ ID NO: 211108 - DNA, 949 bp, Homo sapiens
  misc_feature (22)..(22): n is a, c, g, or t
  misc_feature (85)..(85): n is a, c, g, or t
  misc_feature (114)..(114): n is a, c, g, or t
  misc_feature (149)..(149): n is a, c, g, or t
  misc_feature (222)..(222): n is a, c, g, or t
  misc_feature (231)..(231): n is a, c, g, or t
  misc_feature (234)..(234): n is a, c, g, or t
aacgtgatgtctcttcccgggnacacccatttgcagaggcccagcccatccgctggagccactggattctggagcacgccgtggnactgacccgagactctgagcggctgctgnaggtgcggaagcggatcaatgtcctgcccctgggnagtggggccattgcaggcaatcccctgggtgtggaccgagagctgctccgagcagtactcaactttggggccnttactctcnacngcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcct

SEQ ID NO: 211109 - DNA, 889 bp, Homo sapiens
  misc_feature (22)..(22): n is a, c, g, or t
  misc_feature (85)..(85): n is a, c, g, or t
  misc_feature (114)..(114): n is a, c, g, or t
  misc_feature (149)..(149): n is a, c, g, or t
  misc_feature (222)..(222): n is a, c, g, or t
  misc_feature (231)..(231): n is a, c, g, or t
  misc_feature (234)..(234): n is a, c, g, or t
aacgtgatgtctcttcccgggnacacccatttgcagaggcccagcccatccgctggagccactggattctggagcacgccgtggnactgacccgagactctgagcggctgctgnaggtgcggaagcggatcaatgtcctgcccctgggnagtggggccattgcaggcaatcccctgggtgtggaccgagagctgctccgagcagtactcaactttggggccnttactctcnacngcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcgggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcct

SEQ ID NO: 211110 - DNA, 372 bp, Homo sapiens
tgaccttttccattatacagttccaggttttcacttgtcatgtatctggttttactttggaatgatgcagatatccagttccccatcaaacgtccacataatagttttgccactatttaagtgcaattaaaaatgtagattttcatcagaaaaaaatgttggattgctattccattcttctaagaacctagtactgaatgcagtatttggttcatctgctatatgcctgatgctttttcccttttgaaaaactttagtcctaaaagtcgttggatttttcattcattctataaaatctttttatttcagtctggattcaaagtggtaacagaaaagtcctaggaataaaaaagcctgtagctatccttcctt

SEQ ID NO: 211111 - DNA, 1156 bp, Homo sapiens
gagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaaaaac

SEQ ID NO: 211112 - DNA, 1130 bp, Homo sapiens
gagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaaaaac

SEQ ID NO: 211113 - DNA, 1032 bp, Homo sapiens
gagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacgcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatgggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaaaaac

SEQ ID NO: 211114 - DNA, 1360 bp, Homo sapiens
gcacacacgcgaggggaccctgggtgggcaaaaacgtgctttcccggacggggttgaaggggagaaagggagaggtcgggcttggggggctgcctcccgcggctcagcagttcctctgaccatccgaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcgtgagtgtccttgccaccactcccagcccaggaaagcatcctgtgtccctgtgccttatttgaccctcatgccaaccccgggaggtggagactgttgccccactctgcagatgcagaaacggaggcttggctgctgccagggggaggaggaggatgtgcacccagtctacccagccccatagcccttcccactctcagcccctcccctgccccactcactctgccccaggctgacctcagccccgctgctccccagggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaaaaac

SEQ ID NO: 211115 - DNA, 1067 bp, Homo sapiens
  misc_feature (1011)..(1011): n is a, c, g, or t
gagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagggttgctgtctctctccttcccactatcgtccgcacagcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcgtgagtgtccttgccaccactcccagcccaggaaagcatcctgtgtccctgtgccttatttgaccctcatgccaaccccgggaggtggagactgttgccccactctgcagatgcagaaacggaggcttggctgctgccagggggaggaggaggatgtgcacccagtctacccagccccancccgggctctggcaagctggaagtgaatctcatcaggaggtttcaaagcctctgaa

SEQ ID NO: 211116 - DNA, 1114 bp, Homo sapiens
gagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatgggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaaaaac

SEQ ID NO: 211117 - DNA, 1449 bp, Homo sapiens
gagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagggttgctgtctctctccttcccactatcgtccgcacagcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcgtgagtgtccttgccaccactcccagcccaggaaagcatcctgtgtccctgtgccttatttgaccctcatgccaaccccgggaggtggagactgttgccccactctgcagatgcagaaacggaggcttggctgctgccagggggaggaggaggatgtgcacccagtctacccagccccatagcccttcccactctcagcccctcccctgccccactcactctgccccaggctgacctcagccccgctgctccccagggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaaaaac

SEQ ID NO: 211118 - DNA, 346 bp, Homo sapiens
caaaatcctccctcacatctcctctaggttaggggccaactaaatgttttgatttaaaagatgtggctgggcgcagtggctcatgcctgtaatcccagcccttagggaggccgaggcaggcagatcacctgaggtcaggagttggaggacagcctggccaatatagtgaaaccctatctctactaaaaatacaaaaattagccaagcatggtggcacatacctgtaatcccagctactcaggaggctgaggcaggagaatcgcttaaacccaggagatggaggttgcagtgagccaagatcatgccaccgcactccagtctagatgacagagtaaagctctgtctc

SEQ ID NO: 211119 - DNA, 467 bp, Homo sapiens
catttagggttttgggcacagcatttgcctgacaccgctgcctggtatactccatttaagcagcaattgttggcttgttagtgagtgcttttggacacttagacactaacaaagaaagcatcagcaggtattgttatattctgacatgtccattcttggatggatcaaaaatgaaaacatcaacaaagaaggtaatgctcagcgagcatccattatttaatggaaatggtatatccaagaaagaagtaaactggacatattattattattgttattattattattatttttgagacggatacttgttctgtcgcccaggctggagtgcagtggcacgatctcggctcactgcaacctctgtctcccaggagaatgatgtgaacctgggaggcggagcttgccgggagccaagatggcgccactgcactgcagcctgggtgagagcgagactccgtctcaaaaaaact

SEQ ID NO: 211120 - DNA, 484 bp, Homo sapiens
tctgaatgttatcaatgtggtggtaataatggtggtgtcgatgttgtgtggggtaaaatttgaatacagtgaaatacccagggcttaattgggttagtttttaaaaattacatttatgtaaccatatttcagtcaaggtgtagactatgtccatcagcacagagttcccatgttttcccttccagtgaatctccatcccccattagaacagacaataactgtcctaattactgtcactgtagcttacttttgtctgctctagaatttcttatgaatggaatcttatgtacttgtactgcatgaagactctttagattcatccatgttattgcattgatttatagtgccttttaaaaaattatagagtagtgttgcattatatgaatacgcaaagtgttttttttttacctgttggtggacagttggattgtttccagtttgggactattgtgaataaagctgtgtagtcttattgtggaaatgt

SEQ ID NO: 211121 - DNA, 200 bp, Homo sapiens
ggacaagggaaggatcaatgtcatcaactcactgaacaaagtcagactggactagggctgagtcgaattatgccaggaaaatgtgttctctaggccaaagggtagggcactggatggaaaaatcagcccctcagagagctgaaagagggtttctggatggaaacagggcattccaggccagactgggctgagccatcaag

SEQ ID NO: 211122 - DNA, 918 bp, Homo sapiens
gacagagtgagaccctatctcaaaaaacaaaatgaaacaaaaagtttctcttattctggtgattttttttttattagttgtcttgcttcccttttccatatttgtattttccagatttggggttattaccttagcaggttttatataatttaaattactggattcaacattataaatgtgaagatggctaagtcatgatggccatattttgtcaaaatgctatttatatgtgaaaatgttggttttacttgacgcttattattgggtattataatttttatgtcaaagttcaggtaataaattgtgtcttactttgatttgcatttttaaattaatgagattgaaatatttggatgtcgtatgttaatttgtttcctaccttttaataatttatccattttgattatttgtatgaatttcttgggtaataatgtatcttttccatatttatcgcatgtatttttttcccattctttgctgttgtttctgttttttggagcaagggacatcgatatttcttaacttttaagtggtgggaacatcaaagaaaggtgggctgagaatacacgagtgctatgtcatgcaaattcttatgtcatatttaggggatttagacttcatcttgaaaaagctgaggaactactaaagattttttacttttaagcaccaagtgatacgatcagtttagaaagattactccaaaagcaatagagaggaaggagtagagagagttgaggctggagggcaggagatcaactaacaggctcttgtggttggtaatcttcaagaataatctgaaaaatgatggcagcctaaacaatggaagtttgaatggagaggagggatgggggtaagagagatttggtagaatagaattgagcacttgccgggaggagtcagcaggaggggagaaggaaa

SEQ ID NO: 211123 - DNA, 382 bp, Homo sapiens
ttttcttcgttattcctccatagatcagagattacttgattttaaaaaacaaaatgctagtgaaaaacaatcacctttcagacaagatcattgttttgccaggaaaaactgaagacgtctcacttcctgaggctgtagatgtgatcatttccgaaccaatgggatacatgctgttcaatgaacggatgctagagagttatcttcattccaaaaaatggctaaaatcaaatggaatgatgttcccgacattcagcgacatccacttggcccctttttctgatgaacagctctacgtggaacacttctccagagccaatttttggtaatgttcttttctcctcccttcctttcccttcaaagtaaaccagtttttaaaactatt

SEQ ID NO: 211124 - DNA, 703 bp, Homo sapiens
ttttcttcgttattcctccatagatcagagattacttgattttaaaaaacaaaatgctagtgaaaaacaatcacctttcagacaagatcattgttttgccaggaaaaactgaagacgtctcacttcctgaggctgtagatgtgatcatttccgaaccaatgggatacatgctgttcaatgaacggatgctagagagttatcttcattccaaaaaatggctaaaatcaaatggaatgatgttcccgacattcagcgacatccacttggcccctttttctgatgaacagctctacgtggaacacttctccagagccaatttttggtaccagcaatgtttctatggggtcaatctgtccagtctccagggtgctacagtggatgaatacttcaggcagccaatagtagacacatttgatgttaggattttgatggctggaacagtcaaatacacagtaaactttatggatgcagaagaggaagatctacacagatggcagtctgggctcatccatggcctggcgttctggtttgatgtggcatttgttggatctctgtatgtataccccccaccaacattttctcagtctgctctaccccatgctatctactatttgtaatcacaattttaaagtgtttaataagtgattttaatgacactaattcttgtttctccaattttcaaggaaataaacaccgatgttaa

SEQ ID NO: 211125 - DNA, 256 bp, Homo sapiens
tgccacagcccagctccaaccccaaacccagaccctgccctccgtgctttgattccgtcccctttctttctccagccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtactacgctttggcagggtaccgagctc

SEQ ID NO: 211126 - DNA, 3122 bp, Homo sapiens
  misc_feature (5)..(7): n is a, c, g, or t
  misc_feature (2229)..(2229): n is a, c, g, or t
ggccnnncatcctgccacccctagccttgctggggacgtgaaccctctccccgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacgatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctcctgccttggcacgagctaggctggccctgagtcattagcaccttttctgccttcatgaggccactgaactcaagggacctcaccttgcttccatcccagcctctaagaccagagggccgagggggtagtgaagattggggaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagnctggcaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttaatagcacctattatacctgaaattatctc

SEQ ID NO: 211127 - DNA, 2394 bp, Homo sapiens
  misc_feature (1501)..(1501): n is a, c, g, or t
gtgtggagggcggcagaggtttgaacagttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacggctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctcctgccttggcacgagctaggctggccctgagtcattagcaccttttctgccttcatgaggccactgaactcaagggacctcaccttgcttccatcccagcctctaagaccagagggccgagggggtagtgaagattggggaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagnctggcaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttaatagcacctattatacctgaaattatctc

SEQ ID NO: 211128 - DNA, 1776 bp, Homo sapiens
  misc_feature (883)..(883): n is a, c, g, or t
gggttaagaaattccctcttccttggggggggggcccccaaaaaaaagggtccaaaggtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctcctgccttggcacgagctaggctggccctgagtcattagcaccttttctgccttcatgaggccactgaactcaagggacctcaccttgcttccatcccagcctctaagaccagagggccgagggggtagtgaagattggggaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagnctggcaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttaatagcacctattatacctgaaattatctc

SEQ ID NO: 211129 - DNA, 774 bp, Homo sapiens
gaggctgtgtttaaatctggccgaggagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggcctgcagatgtgctggctgctgctcccccaaaactgacactgctgcttgtgacccctgaatgcctatgtgctgcccctgttgctgctgctgctggctctgcatgcccttgtgcatgtgtctctgcatctatcaagctgtgcactctctgtatccagcttgctgctgtgtgttgtcacttgtgattgtgcaccaaagagatatgtgtgttgctttgactgtgtcctgctggccacttgctggtgcaaagctaattgccaccttgttgagtgctctgacagtacgtgggagattgaaccactcattgcttggctttctttcatgtgtgctgatgcaatgctttcctgacctgtgagcctacatcatggctccttgattggtcacaatctccgagatgattacacacctcatgtggtcttcatgtgacccaccatacctttgccaaatgtgctgcaactgtgcatgatgcaactgagtcttcagtagttatgcatcgatcatgctgtgtccatgtggccctgtatagttggcctggggtgcccccgacagttcctggggccccttgcatgacttccacttaccag

SEQ ID NO: 211130 - DNA, 1495 bp, Homo sapiens
gatcgaagacacgagcaaacataaaggctagtagaggctcggtgttaatcggccgagagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtg

SEQ ID NO: 211131 - DNA, 2928 bp, Homo sapiens
  misc_feature (2035)..(2035): n is a, c, g, or t
gatcgaagacacgagcaaacataaaggctagtagaggctcggtgttaatcggccgagagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggccctgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctcctgccttggcacgagctaggctggccctgagtcattagcaccttttctgccttcatgaggccactgaactcaagggacctcaccttgcttccatcccagcctctaagaccagagggccgagggggtagtgaagattggggaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagnctggcaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttaatagcacctattatacctgaaattatctc

SEQ ID NO: 211132 - DNA, 3012 bp, Homo sapiens
  misc_feature (2119)..(2119): n is a, c, g, or t
gatcgaagacacgagcaaacataaaggctagtagaggctcggtgttaatcggccgagagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacggctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctcctgccttggcacgagctaggctggccctgagtcattagcaccttttctgccttcatgaggccactgaactcaagggacctcaccttgcttccatcccagcctctaagaccagagggccgagggggtagtgaagattggggaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagnctggcaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttaatagcacctattatacctgaaattatctc

SEQ ID NO: 211133 - DNA, 2913 bp, Homo sapiens
  misc_feature (2020)..(2020): n is a, c, g, or t
gatcgaagacacgagcaaacataaaggctagtagaggctcggtgttaatcggccgagagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctcctgccttggcacgagctaggctggccctgagtcattagcaccttttctgccttcatgaggccactgaactcaagggacctcaccttgcttccatcccagcctctaagaccagagggccgagggggtagtgaagattggggaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagnctggcaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttaatagcacctattatacctgaaattatctc

SEQ ID NO: 211134 - DNA, 1276 bp, Homo sapiens
gatcgaagacacgagcaaacataaaggctagtagaggctcggtgttaatcggccgagagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcacgagcacacagcccacctgtgtgctc

SEQ ID NO: 211135 - DNA, 303 bp, Homo sapiens
aagacaggtgcacagacagagccttctggaatacagtgcggggtatgctatcatagaagtataaactgggcaccctaggagcagagttgatattgctatgactgtctggggacatcaggacagacttcatagagcagagatctgaaactggacaatgtcctgttggaccacgagggtcactgtaaactggcagacttcggaatgtgcaaggaggggatttgcaatggtgtcaccacggccacattctgtggcacgccagactatatcgctccagaggtgagtgcagctgcttgatgcagctct

SEQ ID NO: 211136 - DNA, 3808 bp, Homo sapiens
caccgcagggccgggccgcggaccgcgggccacgcccctggggtccggaaggcgcgggagcggacgcgggggttctgtgaacttggaacctggcggtgcgaggttctcgccggggatgcggcggcggcagctgcttcctggtttgaagctcgccgagtgggggagagcgtgagccttcggaggcgggggcaggaggagaagcaagaggaggcgggggaagagacgcttggggctggggctcaccggacgggtaggtccggctctccagggagaggagctgcccggccctggagaaggggcgagtcctgcgcgagtccccgggaggcgccgcgcgcttggaagggacggtcgggcttccccggcccgctgagggctcggcggcgggctcccctcctttccacctcgggagggagggaaggaggggagggaaaagtcccacggaggaggcagaatggccagtcgaggggcgcttaggcgctggcctttccccagggctgcctcgactcctgcacctgtcccgagggctggcctgagacgggactcccggttctcccgctgcgaagcagcgcggcccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgcgtgcggcacgaccggcgcctcggacaccttcgagggttgggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaaaaaaaaattt

SEQ ID NO: 211137 - DNA, 2962 bp, Homo sapiens
  misc_feature (14)..(14): n is a, c, g, or t
  misc_feature (30)..(30): n is a, c, g, or t
  misc_feature (32)..(32): n is a, c, g, or t
  misc_feature (55)..(55): n is a, c, g, or t
  misc_feature (60)..(60): n is a, c, g, or t
  misc_feature (79)..(79): n is a, c, g, or t
  misc_feature (91)..(91): n is a, c, g, or t
gcgaccgcgcggtngaccgacgccggcatngnaccgagtgggggccccgcgcggngcctnccctctccgcgccgccaanccggggactgcncgcgggtcgggtttcccgccagctcaggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaaaaaaaaattt

SEQ ID NO: 211138 - DNA, 2682 bp, Homo sapiens
gcgaattgtaatcactggccatcgatggctcctgtgtcaggtagttaaccggtagagcattcgcgaaatagtgataatcagtgacaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaaaaaaaaattt

SEQ ID NO: 211139 - DNA, 1911 bp, Homo sapiens
aagacaggtgcacagacagagccttctggaatacagtgcggggtatgctatcatagaagtataaactgggcaccctaggagcagagttgatattgctatgactgtctggggacatcaggacagacttcatagagcagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaaaaaaaaattt

SEQ ID NO: 211140 - DNA, 3753 bp, Homo sapiens
caccgcagggccgggccgcggaccgcgggccacgcccctggggtccggaaggcgcgggagcggacgcgggggttctgtgaacttggaacctggcggtgcgaggttctcgccggggatgcggcggcggcagctgcttcctggtttgaagctcgccgagtgggggagagcgtgagccttcggaggcgggggcaggaggagaagcaagaggaggcgggggaagagacgcttggggctggggctcaccggacgggtaggtccggctctccagggagaggagctgcccggccctggagaaggggcgagtcctgcgcgagtccccgggaggcgccgcgcgcttggaagggacggtcgggcttccccggcccgctgagggctcggcggcgggctcccctcctttccacctcgggagggagggaaggaggggagggaaaagtcccacggaggaggcagaatggccagtcgaggggcgcttaggcgctggcctttccccagggctgcctcgactcctgcacctgtcccgagggctggcctgagacgggactcccggttctcccgctgcgaagcagcgcggcccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgcgtgcggcacgaccggcgcctcggacaccttcgagggttgggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccactttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaaaaaaaaattt

SEQ ID NO: 211141 - DNA, 766 bp, Homo sapiens
gggaaacaggttattgccttggtttcgggattttaattgcggttcactaatagggaattgtgggccctcgaggtccaaaattttgggcccgagggggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaaaaaaaaattt

SEQ ID NO: 211142 - DNA, 2279 bp, Homo sapiens
  misc_feature (2209)..(2209): n is a, c, g, or t
  misc_feature (2212)..(2212): n is a, c, g, or t
  misc_feature (2243)..(2243): n is a, c, g, or t
  misc_feature (2249)..(2249): n is a, c, g, or t
  misc_feature (2276)..(2276): n is a, c, g, or t
caccgcagggccgggccgcggaccgcgggccacgcccctggggtccggaaggcgcgggagcggacgcgggggttctgtgaacttggaacctggcggtgcgaggttctcgccggggatgcggcggcggcagctgcttcctggtttgaagctcgccgagtgggggagagcgtgagccttcggaggcgggggcaggaggagaagcaagaggaggcgggggaagagacgcttggggctggggctcaccggacgggtaggtccggctctccagggagaggagctgcccggccctggagaaggggcgagtcctgcgcgagtccccgggaggcgccgcgcgcttggaagggacggtcgggcttccccggcccgctgagggctcggcggcgggctcccctcctttccacctcgggagggagggaaggaggggagggaaaagtcccacggaggaggcagaatggccagtcgaggggcgcttaggcgctggcctttccccagggctgcctcgactcctgcacctgtcccgagggctggcctgagacgggactcccggttctcccgctgcgaagcagcgcggcccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgcgtgcggcacgaccggcgcctcggacaccttcgagggttgggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagattctccaagggaaatgcctgtacggggcctgcaantanaactgggtggggcaatggggccgttttgccnccaatnaaaaatgcccctgttgggtccaccccnccc

SEQ ID NO: 211143 - DNA, 2269 bp, Homo sapiens
caccgcagggccgggccgcggaccgcgggccacgcccctggggtccggaaggcgcgggagcggacgcgggggttctgtgaacttggaacctggcggtgcgaggttctcgccggggatgcggcggcggcagctgcttcctggtttgaagctcgccgagtgggggagagcgtgagccttcggaggcgggggcaggaggagaagcaagaggaggcgggggaagagacgcttggggctggggctcaccggacgggtaggtccggctctccagggagaggagctgcccggccctggagaaggggcgagtcctgcgcgagtccccgggaggcgccgcgcgcttggaagggacggtcgggcttccccggcccgctgagggctcggcggcgggctcccctcctttccacctcgggagggagggaaggaggggagggaaaagtcccacggaggaggcagaatggccagtcgaggggcgcttaggcgctggcctttccccagggctgcctcgactcctgcacctgtcccgagggctggcctgagacgggactcccggttctcccgctgcgaagcagcgcggcccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgcgtgcggcacgaccggcgcctcggacaccttcgagggttgggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaaaaaaaaattt

SEQ ID NO: 211144 - DNA, 2066 bp, Homo sapiens
caccgcagggccgggccgcggaccgcgggccacgcccctggggtccggaaggcgcgggagcggacgcgggggttctgtgaacttggaacctggcggtgcgaggttctcgccggggatgcggcggcggcagctgcttcctggtttgaagctcgccgagtgggggagagcgtgagccttcggaggcgggggcaggaggagaagcaagaggaggcgggggaagagacgcttggggctggggctcaccggacgggtaggtccggctctccagggagaggagctgcccggccctggagaaggggcgagtcctgcgcgagtccccgggaggcgccgcgcgcttggaagggacggtcgggcttccccggcccgctgagggctcggcggcgggctcccctcctttccacctcgggagggagggaaggaggggagggaaaagtcccacggaggaggcagaatggccagtcgaggggcgcttaggcgctggcctttccccagggctgcctcgactcctgcacctgtcccgagggctggcctgagacgggactcccggttctcccgctgcgaagcagcgcggcccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgcgtgcggcacgaccggcgcctcggacaccttcgagggttgggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccggtttccggtcccccatggaaaagaagaccaagtgcacagatccatcccagccctacacaatgatactggaaagctgtatgtggaccagaaatgccaaaggaggttccatcaggaagaggggacttgtgctctgactctgctgtacccctgatcatatgttaccacttatttatgctttaaagaaca

SEQ ID NO: 211145 - DNA, 2142 bp, Homo sapiens
caccgcagggccgggccgcggaccgcgggccacgcccctggggtccggaaggcgcgggagcggacgcgggggttctgtgaacttggaacctggcggtgcgaggttctcgccggggatgcggcggcggcagctgcttcctggtttgaagctcgccgagtgggggagagcgtgagccttcggaggcgggggcaggaggagaagcaagaggaggcgggggaagagacgcttggggctggggctcaccggacgggtaggtccggctctccagggagaggagctgcccggccctggagaaggggcgagtcctgcgcgagtccccgggaggcgccgcgcgcttggaagggacggtcgggcttccccggcccgctgagggctcggcggcgggctcccctcctttccacctcgggagggagggaaggaggggagggaaaagtcccacggaggaggcagaatggccagtcgaggggcgcttaggcgctggcctttccccagggctgcctcgactcctgcacctgtcccgagggctggcctgagacgggactcccggttctcccgctgcgaagcagcgcggcccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgcgtgcggcacgaccggcgcctcggacaccttcgagggttgggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctataggtgagttttggttgctgccctgtcttctaattcactgcctcttccctctcctggcatgatccatccttccacttctcatgataatcagttgataccttttttggaatt

SEQ ID NO: 211146 - DNA, 2543 bp, Homo sapiens
caccgcagggccgggccgcggaccgcgggccacgcccctggggtccggaaggcgcgggagcggacgcgggggttctgtgaacttggaacctggcggtgcgaggttctcgccggggatgcggcggcggcagctgcttcctggtttgaagctcgccgagtgggggagagcgtgagccttcggaggcgggggcaggaggagaagcaagaggaggcgggggaagagacgcttggggctggggctcaccggacgggtaggtccggctctccagggagaggagctgcccggccctggagaaggggcgagtcctgcgcgagtccccgggaggcgccgcgcgcttggaagggacggtcgggcttccccggcccgctgagggctcggcggcgggctcccctcctttccacctcgggagggagggaaggaggggagggaaaagtcccacggaggaggcagaatggccagtcgaggggcgcttaggcgctggcctttccccagggctgcctcgactcctgcacctgtcccgagggctggcctgagacgggactcccggttctcccgctgcgaagcagcgcggcccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgcgtgcggcacgaccggcgcctcggacaccttcgagggttgggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctgtaagtttggcttacccagctagcttctgatgtattgcaaaccagcttgtttcatgtgctgcttgagtcttttcagtacttcccaccagtaaaccactagctctaactaaaatttgtattgttctaatctaaagaatcaaagaaccagagttctgtcaggctgttaccctctcttatgcaa

SEQ ID NO: 211147 - DNA, 422 bp, Homo sapiens
tcttttatgtgtaatgtttagaatacagggaaataagccacctctattgcatcactgttctgtaattattttatacctaatctaaaatatgaattagaagtagtcctgttataaaacaacaaccacaacaaaacatacatacaaaggtttgtatattcatatgtgcctgtgaaactgttgaactatattcctgtgattatgaaatgcttgactctattaaatattgtgctaaagcagagtgcatttttgtttatcctaaatgagtgagactgttaggcattttccattttttaaatggtaagaagagaagttaatagctgtaaaatcaattaaaattatacgttattttataaatgaatttattattatcaaagtaaatagattttcaaaaattatattatgaattagtttggattccccag

SEQ ID NO: 211148 - DNA, 479 bp, Homo sapiens
aaaagaggggcttaaactgcataccaaaacaagagtaggcacacccccgctaaacagcctagtatgctattttgtaacaaatttaaatgatacaatattcattttgcttcaattttcttttattattgcgggtaaacatttttttcaaaataacattcttctctttgtcaatttaaaaagtaatacatggttatttagaacatgtaaaaatatgaaagtataataaagaaaataaaaattacccagaaataaaaatggctagtatattcatatcttttcttccagtttttttgtttgtacattatttatgtacatatataacaattgataccatacagtttgtaaaatgttaaatgtaacattgtgtcatttttccaagtcattactagtctttgaaaactttaaatagctgcatgttacaaactttaataatcatttaggttgtttccatctttttctaaataaaagtgtgcttcagt

SEQ ID NO: 211149 - DNA, 141 bp, Homo sapiens
acatctgttaggtcatcggggataggtgagataaatgaatggaaacattgcacacagaagatggagactagcagggaggactttaggagtaggtgtgagaaccaggaaaacttagcatcctctcggtcaggagactagaat

SEQ ID NO: 211150 - DNA, 334 bp, Homo sapiens
catcagtgtggcttatctcagaaaacaaaacatttcaagctagacatttgagaattatatcagatacctccttatccttcaacctctatatccagtaatcaccaagttctattgattgacctccgaaacatctttccaatgcttccatcttcactttatccaccttagaccatctcaccatcatttccatgctagactaggcagtagcttcctaattgctatccccacatgcacacccgcacctttccaatccattcccttgcttaaaattcttcaatggtggccatgcatggtggctcacgcctgtaatcccagcactttgggaggccaaggc

SEQ ID NO: 211151 - DNA, 540 bp, Homo sapiens
cctgacctcaggtgatctgcccactttgtccccccaaaatgctgggattacaggtgtgagccaccgcgcctagccatttacaaacattttaaacttacatattctgtactaagcactttgcaaatgatttagttatctgccaattttattttactttattttattttttgagatggagtctcactctgtcgcctaagctggagttcaatggagcaatctcagttcactccaacctcctcttcccaggttcaagcgattctcctgccacagccttctgagtatctgggattataggtacccaccatcacgcccagctaattgttttacttgtagtagagacagggtttcgccttgttggccaggctggtcttgaactcctgacctcaggtgatccgcccaccttggcctcccaaagttctgggattacaggtgtgagccaccatacatggcctgattttttaatgacaaattttctttgagctctcattaatctagatagtatgctaggaagtcaaaaattgcagcacttcaatccctgac

SEQ ID NO: 211152 - DNA, 751 bp, Homo sapiens
tactaaatcctcatatagttctgggtctgtttctgggctctactttgttcatttactgtgctggtactgcaccgttgtaattgctgtggctttgtggtatggtatggcttgctctctgctagggcaagtcgaagctcttttgttcacctgctctttcacccaaattttctgtcctgaatccagcacagccaaattatggtcattgtcaccaccaactacagtgggtgttgagcatttcccattgaatctcctgtaagggttttattggattctgtgatagcagtaaaatgggagcctaagaggtattccttaaaggactactaatcagacctggtttcccagatgatgctgaagatgacggggcctgggctagacttttgagggacatatccttggggttgggtgtgatatagaccagcccttacaatttgcttgactcatgggaatcgtacagggccagaaccagacacctgtcatgctaataacttccctcacaattcagaaatcactgtgattgaagatgggtggctgttataatactacccacttaaaaatggatgtaacccattttttaggactcttaaaaacatcaaatcagtaatggccgattaggactttttaatttttactaatctctacttgaaagttttctagtcattcatttcaggaaacctaattcttataattcatatcatttagaatatcataatgctatggatattagctagctaacttctcaaatcttctagtt

SEQ ID NO: 211153 - DNA, 425 bp, Homo sapiens
taaaaacttattcacataggattataaatagtatttttatactagaattttaatgtatttctatgattacttcacttttgtcattcttaattttgtatgtgcatactttatctctttttcattagatgacctagaagaatatctattttagaggtttctcaaagaatctgttcttgggataacttgtcagttcaactggtttttgtgtgcctgtgttcaaattaaataatatctgtctttattgatttctttcttctgctttctttaagtttgttttatggatttgtccatatatgccctattgttattcttctttaataatgaaaatatttcatggtatgaacttgcttctgttcacaattttgactgcattttcatgtgtcttaatatgtggtcttcagaacattaaaatatttgttataagg

SEQ ID NO: 211154 - DNA, 518 bp, Homo sapiens
ccagagctgcatacctgaaggtcacagtgtcttccgggacagctggggacaggtatcttttgttgcaggagatcaattatcctgagaactcaactcagccagtgacatgaacatgggggccagagagcagatggactgaagggatgggacgtagttgacacttgtgggaccctttctattctaaagccagagtgcttggctccttgtttattaaagttcagaaagtggtgggagagtgtagcatgtattacacggcaattctaggactctgcaggaacacctcattgccatcccaggatgcttctggaagcttagcagggcctcactgatgaggaaactgctgacctcaggccatgtccagccatggggaacatcggtttcacccctgagtcagcccttgtgggcacccttccctcactgtttcatgtcagtgagaatgggggagcaggttgtccctagaggagactgggataccacagtttcgtccacaaagcacacataatgataaaaaatacttg

SEQ ID NO: 211155 - DNA, 510 bp, Homo sapiens
gtaccgcctgcgctgaacttgcggctatggaacagttccgaggtggcactgagtctgaagcaatacaagcatgataaggcggtcgactgatggagggacggggctgctcgtccagctgagagagtgagaggcaaaccatggtcatatctgggaaaggacgttttgagcagttcaaacagagggaatgggcatgcggaggccctgaggcagtgattatgtccatgactgagaaaacacggaagctgagttagagcacgtgagtgagaggggcagcgtcctgtgaggcctgtccccttctgtgataagaacattgagggttacagtcagtgagctgagagggccctgagagttggggcagacgagcctccatttccagagggtccctctgctctgctcatggagaggcagctgcagagttgcagcagggaggttggttggcaggcatgctgatacatctgcgaagaggtgaggggaagtgactgggaccaggtgactggtgagaagtggtgg

SEQ ID NO: 211156 - DNA, 271 bp, Homo sapiens
tgtataaagtaatgaaatgcaaacaaaagaagtaactttactttgtcctatctcgccagaattttctttttttcttatcaaggagcaacttggcctacttatgtcaaaaaggaagtctagatgtgcaaagaaagtttgaagtaagggccataaacataaaggttactttttctggttttctcctcaaccttctgctctgctgcttctcaggataaatgctgacatgggtcatctggcctgttcacattcactgacagcacagcacttcccc

SEQ ID NO: 211157 - DNA, 610 bp, Homo sapiens
caatccagttttcttagattatgaacccatgtatttaaggatatgatctttcggaaatctgcctttttctattaaaatctggaacatctcatgttgcattaaaacctttttatgaatttaacactcaaattgtagctcctttgagagagatctgctatatccctgtgtgcacaaagtttgattattcttggaaatgtaaccatggtatatagaactattttatgatgggtttgttgagcagtccacttaaatttgatgaacttaagttataaagtcactgttagattgggggaaagtgattttgagttacattgggatattgggatattgcagacaaaaacaaaactatgtgtctgatccctggtttgcatcctctgatgttccatggtctgaaatttaaatggaatagggaaatgtgaaaatactggttttctgtaatcgtgagaaagtttacttttgtctttttctgtgatatttcagttgctactgaaaacttcctgcttgcagggaacatcagctaattaagagccctccctgcttttataagtggcattttaaatgttttaatgaaataatggttgaaaattcagttttatttttgtctcatttt

SEQ ID NO: 211158 - DNA, 325 bp, Homo sapiens
tggcggatcagcatctcggccgctttgggccagccctggcccacctgcgggaccctgtccttggcagatgggactcggcgggacccttcttactagcctgccttcctgacaaaccagaaagcggtccccttggaccgccctggggatggacccgacctaaccgcatccctaacgatgcgttaggatgggaggatggtggaacccgcagggacgagaaggagactgggcacacactaggatcccagccccggccctgccccccgggacacattggcacttgggcattctcacgggtcacggcaaggccagcttgaccaagaggtca

SEQ ID NO: 211159 - DNA, 378 bp, Homo sapiens
acgttactcacttctcttctgtgcaccggagacacatttatttccatttgcgtaggccagcctttgcctttgccttttcaattagagccacagagtccaccgatggagaaagtgataatgggcactgagggcatttttataccttgcagtgtcttaaagtaaatgctgaccaacaggcctgataaaatcccactcagagcactgtgtataatttggggctctctcctctagtaaagatatataaagcaattagtggtagaaagggtgagttaagcacaactcatttatcgctgccttttaaaagctaaagagggaactttacagcatatgaagggtgagatataagtgaaaaggataagctaacacagtgccttgcaa

SEQ ID NO: 211160 - DNA, 436 bp, Homo sapiens
tgagacagaatcttgctctgtcgccaggctggagtgcagtggcgtgatcttggctcactgcagcatctcgccattgcactccagcctgggtgacagcatgactctcaggaaaaacaaaaaacaaaaaactacacacacacacccctccccccaccaaaaaaaaaaaactgctcacaagagtgcgccctctactggagggcgaagaaacctcgtcattacaggcctggtactgtggcactccgtgaaattagccattatcagacatctactgaactgattcgcaaacttcccttccagcatctggtgtgagaaattgctcaggactttaaaacagatctgccgttgcagagtgcagcttagtggtgctttgcaggaggcaagcaaagcctatctggttggctttttgaagacaccaacctgtgtgctgtccgtcgac

SEQ ID NO: 211161 - DNA, 418 bp, Homo sapiens
gatgttcatcatgatgtttttaataaatgaaaggttgaaaatcttttgcatcttgatatccaagaacaagaattggttaaataaatcttagtatatccatataatggagttctccaaagctatggtcaagaccgatgttctggaagaatttctaaactaccatatcaaaaattctcatgctgcaatattatgataaaaatccaaaacagaattgcacacacagtatgatattaactgtgtttaagtaatatgaacagggagggaaaaaatgggacgtacaccaaaatgttaacagtggtgattgttattcctctctttggttccagttttttcttagacatttttctaggttatcaaaattctctgtaatgggcataaaatacaataaaatttcaaaaattaagatacagaagaaaaa

SEQ ID NO: 211162 - DNA, 532 bp, Homo sapiens
gtttggtggacccttccttgtattccttcacaaatattttgtcatattataattggttgtcatcttggtgctgctaaaatcatagactagctaatccagatagaaagtaagtggaaaataactttttacctgatttttttaagcctagaaagcaaagttttataagttaggtatagtaatgcttctgtcccaagataaaattcaccttaagaaagtagctagtttgcatgtcatttacgtttttgatctgtctcaagtaatcctgataatcctagacattttcttttttttttgagacagggcctcacactgttgcccaggctggaatgcagtggcaccatcatgactctctgcagccttaacctcctgggctcaggcaatcctcctgttccagcctccagagtagctgggataacaggcatgtgccaccactccaggctaatttttatatttatttttgtagatacagggtcttgttatgttgcccaggctggtctcaaactcttgcaaggctcaatggatcctgtaggtt

SEQ ID NO: 211163 - DNA, 243 bp, Homo sapiens
atgcatttttttctaagttactaccttaggaggaaacgaaattcaagcttaaacaactacaaacctccaattaatccctgattacataaccaggaaatttccacccagacactccaaataaagcgactacataactgtacccaattatttaattgtctttgcttcctcacacaccttatacaagcctttctttcaagaccttctagtagccccccaaccacaaaccattgctgagcgctgtcc

SEQ ID NO: 211164 - DNA, 590 bp, Homo sapiens
tgtatcaacctcctgggctcaagtgatcctcccgccttaacctcccaagtagctgggaccacagctgcatgccaccacgcctggcaaattttttgatttttttttttttatttgtagtgaccagatctcactatgttgcccaggctggtctcaaactcctaggttcaagtgatcctcccgctcagcctgccaaactgttagaattataggtgttagccaccaagcccaccctgtacttcaatttaacttaattttttcagatgagcaaattgaggcataaagagattatgtaccttgctcaatacagctgaaaagtggcacagttggtacttaaacccagatactgctaccatggttcatatccttgaccactgtactatacactatactaccttttgttgttgttagagacaggatctttttgtgttgcccaggctggtctccaactcctaacctcaaacagtcctcccatgttgtcctcccaaagttctgggattacagacgtggggtcccacatgtggcctatactgcctttttgataagtcaaaagcagctggagcctcaactaaccaatcctaattgcacactgg

SEQ ID NO: 211165 - DNA, 432 bp, Homo sapiens
aaaaaaaaaaaaaaaagtgataaaagagtaatgcttttcccataaagactaagaagagtaagaatctcttagatgtgggcaggaggattgtcgggctctgtccttctcaggctcaccaaacacttgcttcattttggcattcccatttgagaaggtgtatagagaagttggagagggttcagagaagcattttcattactgaagttttgggaagtaaaagtaattttaatgcagaataaaatctgaagaaataggttatatttaagtaagacagggagtttagagaaatttcccagtggttagaagttttagcaaccaagggaaagggcaaaatgttaatctctcaggtaaatttgattaaaagggaaactgtaatcaggattaggaaaccaagtaactttgcggtgagtaaacagatgcatggttagaata

SEQ ID NO: 211166 - DNA, 1431 bp, Homo sapiens
aagtggtttagcatgctggagctggttttctgcttggtagccctacaactttggcccaactacttggcctctgggactcagattcctcctctttaaaatggtgctaataatagcacccaccctctgtgaggaggatgctgtgaggacaaaatgagatcatccacataagccgtgaaccctgttcctggtaagctcctggaaagaagtctatggattatactcaacctacactccagttaaaggaacatctacacacagaggaaatgaataacatgaagtgaagtcttcatctccattcccaacagtccccattctacttgcagaaaggttgcttacactgaaaatcagtttattttcccctggtgcaaagaacagtcgtttctccaaaactgaagctggaaattatctgaaatatcaggtcctccggaaaagggacgtgaagccccctttgtaatttctgcattagcgtgctctcctggcaagcaggaaacctcatcagagaagtcagccaaggaaagtctttaaatggaaattgtgcaaacgaggagcaaatgcattaaaaagttgctgacgggcatgaaatgctttgatgtgaagacggaaaactccaagcaggaaggattttaacattttgaatctgattgactctgtggtttctcagcacagttattccatgggctaaaataaatgcagaaatggtactttcagaccacagctgcagaggggatcgtggtgaatttcaatgaaaatccatttgaatcttgaggttcagatcttaaaaaagcaaaggacatgagagaagtaatattgttgcttgaaatttcattgcttatatctaaaagaaactcctatttttaagagaaatgttgaatctttgcaacgtggtagacgctcccacaaaactttctcctgaaataggagataaatgttggaaagaggcaatgtattgagtatgctgatagaggtggagttcagagacaggcaagcatacataagagtcaggatgtttttcagtattatctttacaaatgagtttcttacagtggtcaatgacaaaccaatttcattcaaagcttgcttcaataggcaatggtttgatgccaatatgttagctatttactttgaccaccgtatgcattaaaaagaagaaaaattaagaatactcaagcagaacctccaacttagatagcactttccacaaaaagtaatggagggatagactgaagttaaatgggatcaggtatgtgatgagatctcagaagtgtttgcacaataatgcagatactcattttaaacagagtcataaggattggaactaataaaaataatagaataaaataccgatcaagaatgtgtcctcctgcgtatctgggttttgaattctggctccacagaacttgtcagatatatgacattaaacaagatacttca

SEQ ID NO: 211167 - DNA, 363 bp, Homo sapiens
caagatggcggcgccactacactccagcctgggcgacagagtgagactccgtctcaaaataaataaataaagttcacattacaccctcattcttctcaaaatcacatattcacaaattcaggctccagacaaatagaggcaggaatgactggactcatttcttcctctgtaagaaggaaggggttggggatgggagagagcctcccttcagagtcaggctgtttataatctgccatttgcaacatcattattcctcactgtgaggacagttttgctcagaggccttgcaaggatggtgtccccaattcctcatccagtgcagacataatcaaaacatatcaccaccgccaaggtcaggttcta

SEQ ID NO: 211168 - DNA, 745 bp, Homo sapiens
cattttggaagaaatgctaggtcagtttgtgaagctttaaataccaaggtatgggtaagggtggagccaaagtaaatggctgccttctgcctctgagagttacattgatggttaatcaatttcacatatattatgctaaaaatactgttccttttcaggaagtcatccagattggtagaacttaggaagataaagaggaggaaatagagattaaaacattaaaaaaaaaaacccaaacaaaacaaatcttagattattaggtttttaattaaacatgatgaacacattcaaatataacataaaggccccaggctgaactgcacctaatcgaaacagattaagtcacccttccatgcttgggtggttattaattctgtttatttatgcatgcgagctgaaggtagcatttgctgctgttgtgttggtgcttattgcactgggattccgttgccgcttgatgctgtgctcttaattagcattcagctgttgattatggaaatactggggatgctaattgaattctttttaaaattcagggcctgcattttccttgtggagtttggtttgacttgcaagattgtaagattgggtgctccagtgagctgtgcatctcactctttgcttcctatccacttagctgcgttttggtttttaaaattattttcatgttgaattcgctttccgcaacaatccaggtgttgcacaaagtgaaggttctgttgcttaccatgttactacagggtgt

SEQ ID NO: 211169 - DNA, 346 bp, Homo sapiens
aaagaaggaggggagggaaaagagtcagcatgtgtattacagaatgattaggaaatgggaaaggaagtacccagtacagcaaaatcaactatcaaataaacccctcagtgatggggtcaccaaagcccaaaggagctcagtctcctgcagttcaggaatgaggggaagggatcagggaaagaacacacaggtaccctccctctgtccccataaattcaagatttcacacaaagctttggtttctagcagtaaacatggagttatatccttctatctcctattaaacaatcttgtggccactttgacataagtttcttatacccccggaagttccagggtaccgact

SEQ ID NO: 211170 - DNA, 1172 bp, Homo sapiens
ggacagatggattttttctctggaatattgacttcaacccagccacatatggatatgcttagaacagcagggctcagtctgaagttgggaccatatctgttctcaaaacatgtggatccctgaggccagacaccaggtgcccgccattggtgtcagggccctactcctctccctgcagtgcaaggggccagtcctcaaggcaggggttcctcctctctggacacacagagaaagaggaggcggggaaacagcaagtgcccaggaagggtgaggccccagggacttgaagccagccctctgatagcatcgctgtttcagaggaacactagctacgaacggggctcccttgccagtcagtgctcagagagataagcttacctagcaggtccttcctacagctgcagcaatgatgcctggactgtgtctgcccaggggtgggcggtggaaggttctagggagaggagttggcacttccctggtgcagcccttccctctcctccccagccctgacaccaccacagccccttcgtcttctctgtccagaacctcttcccagaggctccctaaggagaccgcggagtctccgcctggggctctcacagccccacaccatcaccacacccagccaggtctgatgagtttttaaggtgaaatgggagtttttcaggctgttgggaagtggtgtccccgctgtaagcatgctggccccacatctgctttgatgcttctcagcccaggatggtgcagcagcccacaatggggagcagctagctctgtctatgagagtttggggagcggggtcttgcagaaaagatgtctgaagagtttttttttatttattttggtttggagacggagttgcactccagcctgggtgacagagcaaaaaaactccgtctaaaaaagaaaaaaaagagaacaactgccccttctagcagcagcccagatggagacacccatagcagggcgccggatccaatctcttcctctcctccctcggccttcctctccccacaaaccccagggtctagaaagtagaaggttctccctcttctctccttcctcataatgaacctcgatggagctggccgagtgcagtggtggttacagttaattgatcacaagacttacagattttttgtccttctccatcccaatggttcactggacgg

SEQ ID NO: 211171 - DNA, 550 bp, Homo sapiens
caccaggtgcccgccattggtgtcagggccctactcctctccctgcagtgcaaggggccagtcctcaaggcaggggttcctcctctctggacacacagagaaagaggaggcggggaaacagcaagtgcccaggaagggtgaggccccagggacttgaagccagccctctgatagcatcgctgtttcagaggaacactagctacgaacggggctcccttgccagtcagtgctcagagagataagcttacctagcaggtccttcctacagctgcagcaatgatgcctggactgtgtctgcccaggggtgggcggtggaaggttctagggagaggagttggcacttccctggtgcagcccttccctctcctccccagccctgacaccaccacagccccttcgtcttctctgtccagaacctcttcccagaggctccctaaggagaccgcggagtctccgcctggggctctcacagccccacaccatgtggcacagcctagggtgtgacccccttgcctgccctgcgtttgcttggctggagggacaggccttt

SEQ ID NO: 211172 - DNA, 691 bp, Homo sapiens
ccaaaaatcccaagaaggggaagccccacgacagctgaaatcctgtcctcatcagaggaactggcagatattccctatctgctatgtattccagtaaaaaaggaaatactcagccactaaatccaggattgaaaagaaaaaggagaaggttcttgccactgtcacacaaccaaaaaactggtggtgatgagaatggtagtacccaggtgggtaaactttgcaaaatgcctagatattaccctactgaagatgtacctttaaagctgccaagccacggcaaaaacccttcagtcaacatccaagaaaactgtgagccagcatcgctcccgagaccctctgaccatcatcactgggcactacagacacaagagggtggcttttctgaagcagctgagctacttgtgactagacctctggtcttcaagcaagttcctctttatagaacacaccagaaattatcattgccacctccataaaaattaatatcagcaatgtgaaaatcccaaataatctcactgatgcttacgtcaagcagcagctgagaaagcccagaagccaggaaggtgagatctttgacacacaaagagaaatatgagattacaaagcagtgcagggttgatcagaaagatgtagacttgaaaatttcatcaaaaatcaaagctatttctcatctccagggctacctgtgatc

SEQ ID NO: 211173 - DNA, 780 bp, Homo sapiens
ggatcacaaggtcaggagttcgaggccagcctggttaacatggtgaaaccctgtctctactaaaaatacaaaaattagccaggtgtggtgggcccctctaatcccagctactcaggaggctggggttagagaactgcttgagcctgggaggcagagattacaatgagccgagatcatgccactacactccagctggggtgacaaagcaagactgtctgggggggataattataatcctgtgcctagaatgctgttggacagcaaacttggagaggtgcttagagaacattgtgcctggcattatgtcagcacacgtagtgctgtggaaacacctgcctgtgcacagcggtgtctagtcccgccaggtcacctccctcttcctactgatgaggcacctgagcctctagcactttctggaattgggcagaaacaagcaggctgcatctggagccacatgctccaaagacacttctccgtggcagcgccgctggccagctgagcagaggatgatgggaagagggttccataccccacaagaccataggcaccctggaggtcccctgggtctgtgttacctgatcttctgaatgcgacagtccttcccactcagcacgctgcccagcagctccatcacggggtcctggaactggttggtgtccagcctggccaaggggagcagtgacagtgagtgtcccacccgcccacgggcagggtgggggccctggcccggggcctctgcctctctccatcccatgcagcgctatcaccgcagctctgaga

SEQ ID NO: 211174 - DNA, 552 bp, Homo sapiens
gtgtatttgggaagatttctgaagaagtttgtctctatggtagaatctgcaggattagggtctaaccaatgccttttaaatcatctccgtcagttgaatctcatgtccactgaagtttgaaagtcattgctaacttgtatatgacattgctaggaggcggtacttcatgaacagtatgattaacagtatttgtttaaacatgtcagaatatatggctatatttctcttagtattataatgtgtaggagatgataaaagtcctatattttatcaagataaacctggacagaataagctaattagatcacattgctaaattggttataagatgtttttaatatattccacatatattgtaaatataattcaccttaatgggagagactttaatgtacacaggcacatgtataacaaggtataaatatttgggccaaaaggccaatctaccacatattccaaaaccatgaaacagaacaaatacagttggccctccctatccgtggtttctgcatctgtgattcaaccaaccatagattgaaatatttgaaaaaa

SEQ ID NO: 211175 - DNA, 497 bp, Homo sapiens
ccaactgtgctgtccataatgtgtctatttcttccacttctgattggtagggcacgctgattggtcccagtgggcccactccacctccctaatttttccaccactcctgaacctccttcactccctccctctttttaattttttttttttttcatttcagttgctttaaggttacagatggtttttggctataaaaatgaattgtgtagtggttaagtctgagattttagtggacctgtcacccaagtagtgtacattgtacccagcgggtagttttttggctctcactccctcccagctttcccgcttctgagtctccagtgtccactgtactgctctttctgcctttgcgaaccgtagtttagctctcacttgtaagtgaaaacgtgtggtgtttggttttctgttcttgtgtcaatttgcttaggatagtggcctccagctccatcgaggttgctgcagaggaggtgattttgttcttttttatggacaccgtg

SEQ ID NO: 211176 - DNA, 411 bp, Homo sapiens
aaccaaacttcttatcgactatgaaaatagcccccacaattactaagaagatcatttcactttatagaagtcattttttttttgctttggataccctcataatggaatttttgtattgtaatatttgattattattataatctagaaagggaaagtgatagagaacagttgcatcatctcagaaaggggcccacattcaccgtgtctgctcttcctaacaaactgttctcaagatgttctcatcaaggagcttcttgtgctatatctttgttaaagagatggagcctgagttctgaggtattctgattatctgaagagattacttaatgacacaatgctatctcaaagaacagaagtagggagattcaagacaattctattccttacagaggtacaaatttctatgctagg

SEQ ID NO: 211177 - DNA, 220 bp, Homo sapiens
  misc_feature (18)..(18): n is a, c, g, or t
  misc_feature (43)..(43): n is a, c, g, or t
  misc_feature (46)..(46): n is a, c, g, or t
tagcaggatccccgcatntgctcccatcagaactcctaacttnttncacctccgggcctttgcaagaaaaagactttatataacaggatggggatggagaagagggactgaactctattcagtgaagtgctgctctgcatggcttagaagggtggggcaggaggtcctaagcatcaggtagtgggtgtgggccaccaaattctgatgggagcaagatgcg

SEQ ID NO: 211178 - DNA, 810 bp, Homo sapiens
aatcataggtagataagagacaaactattgcattcttttgagtctctgattagcctttcacagaatacacaatttacaggtgagaggagggtagaggaaataatcttatgccctagtctggcttagtgaaacaatatggcagaagaagcaatgagatatgcgtttgtctcacatgagcctcagcgagatgactgagttctggctgtccttcatccacaaggaatttccatgtgggcaaattgtgagggaggcatgtaactttttaaaaaatgtttgtagctatcttgtttaggaataaaatgggaggcaggcctgcctgacatagtccccagcttgactttttccttggcttagtgatgttggggttccgagatttttttcctttcacaggatttacagccaaggaacagagcgagtggatcagtggatggaaaattattcatggagacatcaagggcatggaaagtcttgccatactgacttaacaggatttttgctgaaggcaggtcaaggacttagagtgttaatggaaaaagcaaactgtaaaatatttaaagaggtttattcagagccaatatgaacgactatggcccgatgaacagtctcaagaagtcctgagaaagtgtgtgtgaggtggttgggttataatttggttttatacattttaggaaggcaggaattacaggcgaagacataatacgtggaaggtatatattgattctgtctctgcctgaaaactgggaaatctcgaagtgggggggtggtggaatggggagcttatgggtcataggtggattcaaagattttctg

SEQ ID NO: 211179 - DNA, 776 bp, Homo sapiens
ggctggtctcgaattcctgacctcaactgatccgcctgcctcggccttccaaagtgctgggattacaggcgtgaaccaccacgtctggcctatatttgagtttttctgactcatgatcaggcagaagaaagacaatggaaacctgtcttattaaaggggtgctcatatggggcatgaccctatggaaatttgagggcaattcccttccaggtttgaagggttattggaatcataacctggcaagcatttcaatcacttgctaagagtctactatagtggactatctgctaaagcaagtcttgtcagcatttcaatcacttgctaagagtctaccatagttggggtagtctgctagttgctgtgaatacagctaactggggtggacgtggggaataagtgcacaataaaataaataagaaggaagagtactatataggaaatggctgaattaatggtatagaaaggtgtggagaaaaggaagactctgcagaagaggtaagacatgagttgtgccttaaagcaaaggagaggtcatatgaacagaaaggcaactcagttaaagagcaaataacctagctttgccataacatagaatgtgtatgtcagagtttggaaattactagatacgaaaattgaacctaggctaaggaatttggactttcctctgttgaatatgaaatgatccattatacctggcatccattacatttctttccttagctccatatgtctcactccactttgctataacggtacattcgtcccttgagtatccg

SEQ ID NO: 211180 - DNA, 304 bp, Homo sapiens
attaatgattttcttagctttgataatggtgttctggttgaggaggagaatgtccttctccttgggtgatgccagataaagtatttaatgggagggacatatcatgatgcctactaattatttttggagacagaaagagagagagtgtgtgtatgtatagaagagatgtagtttatagtaagatggtaacaactggtgaatctagatgaagatatatggtcatttattatattacgttttcaaccttactgtggatttgaaaacttttgaattaaaaagtattttttaaaaagaaaagttcaca

SEQ ID NO: 211181 - DNA, 305 bp, Homo sapiens
atcaattggagaaagctaaatatgcaccctaaccaatcatgcaccccaaccaatcatgcactgtaaccaatcatgtgggatgctttgcttttcttctcccttctacagcgtccccatgccaacagccaccaatcagggcatatctgaagccttcttttttccactctagcgctttcccagtccctctgcctaactatgagtctctgccaaatgcaagtgacagtggctgattccttgcttattctcatttgagtgttcctcatttattcccacagatgctttcttgaaaaattatgtttctaggc

SEQ ID NO: 211182 - DNA, 374 bp, Homo sapiens
tgtgccccagggcagcttttaatgcagtccaacagaaatttgtaagctgtcttaaaacatgagattttttttgtgattttttttaagctcatccgccattgttagcacattttatgtgtagcccaagataattcttcttccagtgtaacccagggaagccaaaagatttgacccccagtaacttcacacctaaggagattagcaatattccataatctgtaatattcagtctgtgttcatattctcagttgtgttcattcttttcatttgtgtaaacaatgcttttcataggttatttttaaattcaggaaccaaattcatgaattacatttgtgcattgttcgtctcttttaaagtaagaatggcccttcccc

SEQ ID NO: 211183 - DNA, 290 bp, Homo sapiens
cacctcagggacctgtgggattataacaaaagatgtaacatttatgtcatgagagtcctgggaaaagaagagaaaaagggagggactgaaaaagtactcaaagaaataatggctgaaatttctcaaatttggcaaaaaaacacaaacttatagatacaagaagctgagcaaatggtaaacaggataacctcaaagacattcacatcaaagatacatcataatgaaactcctgagaactacgaacaaagaaaaatcttgaaagaaataggagataatcggctgggcacggt

SEQ ID NO: 211184 - DNA, 215 bp, Homo sapiens
tccaaccacgcccccatcagtaatccattctcaacacaacagccagattgatcattaaatcatatcatgacattcctccctcaccccatcaaaacctctgatggttccccatttcattcagaatgatgtggtttggctctatgtccccacccaaatcttatctcaaattgtaatccccacatgttgggggagtggcctgatgggagaagatgcga

SEQ ID NO: 211185 - DNA, 378 bp, Homo sapiens
ctccacaccccatagacataggagagacttgggaaatcatatcccaagaggagcttcccagaggagtagggaacacatacttccctcttgattctagatacaaggggtcatcatcattgtagaattctacttactcagagtattttcatgatgcattaagcttagaaatatgctataatgcccaactgacacactgttgtttttaaaaatactacttttgtaaaaatgcatatgtttatgtaaaaaatactgaaacgttatacgtgaaatgtttaacactgattaggtgtaaaaaagagtggtcatttttactaaagcttctacactgattgtcttttatttaaaaagcatttaaaatttttttgacagagacgactc

SEQ ID NO: 211186 - DNA, 369 bp, Homo sapiens
gacagaggtagagagaggctgctgtggtggagaatgaagaggagaacataatagctcccacctccaggatggcactgtttaatgctgtaaactgatgtagctaacccctcacagctggcaattaagcacgatagagaacgtgtttgcaacgctcctgcagtatttgtgacacatcatctaccctctggttatccaggggaaaaaactctctctggggagtgtcagtacatgaacaccaagttctggaggcttaacccgctggtctcacttctcaccagcgtcacttgcctgttagggtagctgctccaggctgggagatgagtggagtaggcattattcgttttggataactacagctaaaaaaagaaa

SEQ ID NO: 211187 - DNA, 440 bp, Homo sapiens
ctcatgaccttagagcctaacactgttatcctcaattaaggacacaccatgtatcatcttgcatctctgattagttcatagtgtctcacatataatatcagtaaagtacaaggctgcctgtgttctcctttttttatacttttcaaatgaattcaggcttcccctttgccttagtttcactgacactgtcccacttcgctaaatgacattaatcgataaaaggcaggatttgcaagcacactgcaaaatacaacatactccgttgcaaccagtggtatcctaccttaggaacgatatattagggcaaacatcaagaaacatctagaacttatgcaataccagataatctttattttcctctgaaacctgacaaaccaatttcacaattttctcagtacctgaaagtctatgttgccagccaaagtgttcttcccctatgt

SEQ ID NO: 211188 - DNA, 574 bp, Homo sapiens
taggaaatatgatattgcattcttatagccaaagctctatggaaaatataaggaaattttaatgtatcttcttaaaagttgcttataatatggtttgaaaattgataatgtacataactatacattcacatgtaaaatatatataaacaaatatacgtataagatatataaataaaaatatgtataaaaagagatgcttcaaattcgtaagtaagtatggaatgagtggttgaaacagacaataaatgctgtagaaatcccaaggagagagagattgtcagggcccaagagtgtcaggaagagatgagaaatatggggctctgtctaggccttcagaggtgtggggatacctttcagatacctggttaggtacaaggacccaaattaccagcagaggcacatatcctgatgttagaatttaatttgaaatagccaagtcacatacatatatgtttgtatatttcatttaaattatccagagcagtgcctcttttgtcatgtcttgatgaaattatctggaatttataaagaggaattttatgagctgctactaaggatcaaatgggaagggaaa

SEQ ID NO: 211189 - DNA, 303 bp, Homo sapiens
aacagatgaacagataaacaaaatgtggtatatacatacaacgaaaccttactcagccctaaaaaggaaacgaatcctgacatgcactacaaaatggatgaaacttgaggacattatgctacgtaaacaagccagtcaaaaaaggacaaaaactgtatgactccactaaataagacatctagagtagttacattcacagagacaaagtggctgccagagattgggggaaggggaggtggggagttattgttcaatgggcacagaatttgggaagatggaaaacttctggagatggatgatggt

SEQ ID NO: 211190 - DNA, 671 bp, Homo sapiens
gttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggcctcactcagcagaattttttttgagattatgctaacatccatgttgttgcaccttataagtggttggccttcaatatctgcaggttcctcatccatagattcaacgaaccatggatggggaatattgggaacacacagaacacgtcgaggggggg

SEQ ID NO: 211191 - DNA, 396 bp, Homo sapiens
tgaggtcgactcttgaggatccccaataccaagcccaagttgtataaaagagaaagcaacaagctcaccccaagggatggcaggaaagaggaagtgaaggtgcttcatgggatttgaaatagtgagtaagggaaagtgtgaaagttggacaaactggcaggacatttcagttagaattaatgtcacaaaaaaggcatgaagaggtgaatgggaataaaggatgtgagtagcacgaggccaaagatgttgtaacataagtattcagggtgcagacatgcaagacttgcgatgacataaaaaggaggttgggatttacaaatgataggcaagctatcacagaattttaagcagaggaaaacaaaattgtatttatgcttctggggcaacacgaaggac

SEQ ID NO: 211192 - DNA, 443 bp, Homo sapiens
agaaaccagaccttagcggttattgtatccttgggctaattatgagcaacaaaaagccactcagtaatttaaactgaaacagaattaattgaaaggatatgaaatggctgcagaactaggcttgcaaaataggcaggaacaagggcaggtagctaaagggcaggaccctggacaaagtcatggcacacactcagtcactctcaacctggtgtgagcacggctgctgcggggtgccacagctggagctgcctgttcccaacacagctgcctctggaccctggatgagaaagctgctacatctactgtttctgctcctgttttattagttagtatctgattcactctgggcaaatgtatgtgattagccaaacccaggtcacagccccaccctggctgcatgggaggcgtttttgcttgtctgatgggaggtgatctcagtaacc

SEQ ID NO: 211193 - DNA, 517 bp, Homo sapiens
aactctgtgtctactttgcacactcctgaatccagtgactaacgtagtgcctgcctgtggccagcgctcagtgaacatttgttgggtgtatcaattgtgtcaatttgtgcagtgagtactattatcctctttgtgtaagtgaagagtctaaatctcgaaaggttcagcaccttggtgaaactcctgagtggcaggagttgcatccaggtctgtaggaccccagggcaagggttctttgctgcctaagaatttagtctagttggggagacagatgagtgagtagaaattggctgtacaccgaggttagcacaatgataagcacagcacagtagggcaccaaggagggtgccaggctgaaccttggaggggaaaggacaggagaagaccacgagggctttgtggaggaggcgatgacccaaccgcatctacatttgtccaaacacatgaattgatccttgggattctagtggggaccagaaagagaatttgctgaagaggagaaggaaaaaaaaaacac

SEQ ID NO: 211194 - DNA, 459 bp, Homo sapiens
cctcaaagtcctgggctcaagcaatcctcctgcttcacccttctaggactacaggcacacatcaccatgcctgcctaattttttctattttttgtaggaacagagtctcactatgttacccaggctggtcttgaactcctggcctcaagcaatcctcctgccttcagctccaaaagtgtaatcacaagtgtcagccactatgcccatccctaagttgttttagtatggttatgaattctctcctctacattctgaaaccaacatgagttatccctttttctggatctctgaataaataactctaacagatgctatttcagctacttcctaattccaatttcccaacagatcatataatacctagaacagctacagttaaagatctcaaacataatgctaatagaattttatcacaaaggcttaatttcaaaagaaatgaatattgtggctcacgcctgt

SEQ ID NO: 211195 - DNA, 553 bp, Homo sapiens
agaatccagctgtagtgatactcagaaactgacaccattattctaattttacccataagacaaacctttgcgaaaaaggatgtcctgcagagtgccctggatcagatgatccaggaaacgtcactatagaaatgccaagcatcttggtagcatcaagcattccaatttctatggggcagtactgctacaaggtttgattaatactggtataccactaggcaacttggatttctatgacatctctcctctcggaagtgtgctggtgtgcaataacttgaggcttacagtgaattaagggctgtgaacttgctgacatacactggcagccaggatgggatcagtccacaggaagagaaagaaaagcaaatcttcttccctgctgtaaatgatccctctgccattgggagttctcaagtctttgttaacccatgtttgctaagacccttggccaatgtcgttaaaaccaaatgctagttaaaaccaaaacccataccctgtttaacccattagtgggtgttcttgaaatacagtctcgcattacctaacaatgaca

SEQ ID NO: 211196 - DNA, 893 bp, Homo sapiens
  misc_feature (873)..(873): n is a, c, g, or t
actcgccagaaatacattgtgagtcagacatccctttgaggacagcgtctaataaaatgactggcacacaggtgatcaattaatgattttaaatcaatgaatgaaatcaagttcttttaaaaaatgctttcctacatgattttaatagcaaaaacaagtaataatagaagctcgtttaagagtattttagtgtatcttcatgatgaaataatatgcagttattaaaaatgctttttaaaactttaaaaatcatgcattttatagcctactcttcattcagcataatactataaatatttccatgtcaatattctagacgtaatgctgcacaacgttagttgtgtgggttaggacatgttattcagtccctgagctttaccttatctttcatctgtaaaatgaggctaacaatttatctctatggtagctcagtgttattgtgatgatcaaatgagatgaagagtcagaaaatcctggcaaagagcatagcctgtaaaagagactcagtaaacatactgtggtgagaaagaaaagaacttttggccgggtgcggtggctcatgcctcccagcactttgggaggccgaggcgggcagatcacctgaagtcaggagttcaagaccagcctggacaacatggcgaaaccccgtctctactaaaaatacaaaaattagccaggcatgatggcacacacctgtaatcccagccactcgggaggctgaggcaggagaatcgcttgaacctgggaggcagaggttgcagtgagccaagatcgcgccactgcactccagcctgggcaacagagtgagagactgtctcaaaaacgacaataaaatgctactcgcaacccactagcttgatttcattaccctcntgaaggtcacatcagcagtg

SEQ ID NO: 211197 - DNA, 868 bp, Homo sapiens
gtggacacatacacttttctccaaagacctccactgattatttacaagaaagatcggctcaggggaaaagaccagagagctcacctctgtagcagaggaaagccacggaaataattttctattgactggaaacacacaaaacacagcacacttctctgagctctttgactatatgaagcaaaagccttaacccactggaaaagaaaggcaaaccttccagctcctgggctacttcacccaggtaagaggtaggaaattatattaccagtcaccagatccaggcaaagatccaatgctaccgtggaatggtagacatagaagtcttctgtcctttgcgagtgggactgaaatatctcttcttctaggatcttgtaccagtataaacaagtttgctagaggtgtggagagaggaaggtaacttactcttgccaagcctgtcacagattgaaagcagaaaatagctgccatgcagtgccaagtgtcaggaatgacaaaagagccttcacaatccccaagtgcataaaaccttcctaagattgtggcttgacgataactgagaacactgtaatagagaagattcatgattatactgatatatagagaaagaacatttgtcaacatataacactatctcaagctaaaaacatctcaactaagtgtaataggaggattctatcttcttcaatctaatataggacatctacttagaaaaaaaataaataactaaagcaaaaatgtcaaatgattctccaggccccaactccaacaaaacaaatcacgaaacaaagatatcctctccagtgatatttatccagtatttaaattggagaacttaaccaatttatatatttttatatttataacataa

SEQ ID NO: 211198 - DNA, 907 bp, Homo sapiens
cacttctttttttctttccttcttccctctctccctctctccctggcttttctcccgtcatctttctagctttggccacagttcccggtcgggctcccccgggcggagggaagcgggtctgcggccgggcggctcttgtgaggtatctaggatgtgccaggacacaggcaccgcagtcctgggaaaggcggcgggaagtagtggggaacgcaggctgacgaaggggacggaaggaacagagagcggccggcgcgtcctcctctctgggtaaagccgcgttggttcctgccgcagcgctgtgcttcggactcctagggggcctctggccgtttgaatgaatcgacaatatcagagtattgtggacactttttaatggggccggggaggggccgccgctgccgagaactgagggcgacagaacaatcccacctcttgtgaggagcaggtctgccattctgcttgtcagttctcaccttcccctcctccacggcaaagagtccctttcacacccttctgagtgtgcgggtgcgcccagttttacaagtcctctgtcctgccagggtagtgggagaagcacgcgatggggctagcgcccagtcctgcgggggcaggcgccaagctcccgggagtccgcaagtcgcttcctatattggcaagcttcaaatgagacattagaatctccggcaaccttccttcaaacctgaaccggggaagagaataagccgccctatggccaaggcgcaattgcgtacccgtgtgtacaggtccatgccctgtcccctacactctaattttctcaaagaaaattgttttgccaaaagtaaccctgagaaatgcagacgctccaaacgccctctccacttcggatgaagccagcatctagtagggtctccggccctcaagaagg

SEQ ID NO: 211199 - DNA, 239 bp, Homo sapiens
  misc_feature (24)..(24): n is a, c, g, or t
  misc_feature (34)..(34): n is a, c, g, or t
  misc_feature (43)..(44): n is a, c, g, or t
gaacaccatgacgaagtgactgtnaggaccctgntgtctatanncctgctattagtagaaaagaaaagaaacctctttccttgtagctggctgcacacaaggtgagtaggccaggctgctgcactttttcgatcattccgccaattctggatgtctcactggatccaggactcagccactgtctttgctgctctctttgttcatgactactgcgtcaggtctgtattccatacctgctc

SEQ ID NO: 211200 - DNA, 554 bp, Homo sapiens
attagctttcatcatacagatctcagcttaaatgcaccgcttcaatctaatgcaatccacaatcaacattacaggtcattcccttacccgttttctttctttatagcagttaacaatatctgaaattatcttgttatttgattatttactggttttttctgttacctgatgggagcaagatgcgatcttgctcccatcaggcagctctctcacctagagtccatgacaaatgcttccttatcacttgctataataaaaacaacatctttgattcaatatatcctactacaaaacatgattttcaggccaggcttggtggctcacacctgtaatcccagctactcagaaagctgaggcaggaaaatttcttgaacccaggaggcggaggttgcagtaagccaagattgcacctctgcactccagcctgggcgacagagcgagattccatctcaaaaaaaaagatttattttatgacccaggttctggtaaatcttgctgaatcttctgatgggacgaagaagtcaatgtataaaatccgctgatgggagaagatg

SEQ ID NO: 211201 - DNA, 570 bp, Homo sapiens
atccataccattatatattcttaaaaacatgatgttaaagtagcatattatagggatatgtcagtactttgctaagcttccattttattgtaaaatatttatactgctcccagtaactctttaataagcatcttttatttctatgacactcccttcaaaatagaattttctgtcatcaattaaagtaaaatctccttgaagccacaactcttgcccaactggtagttgatttcaactacccccaccatattatggatattcaataagaaccactctaagaaatatgtccccaccaattaacattcaataaaaatatttctcctttcaaacactatgaaactgattcacacattcatactactccgagttcctcatagtgccataataaattttgcatgaaaaacttaataattacagctaaatatggccccctctctctggaaattttttctataaaccgtgggactttataaataccaatacaatcaagatacatctataaattcacctgttttgttaaccattgtaatgcctagatgactctgtaacatgaaaagatacggttgacaa

SEQ ID NO: 211202 - DNA, 335 bp, Homo sapiens
tcacacaggccatcttaagcaaaaaacaaaaccaaaaggaacacttctgtaccttaaatgtttgcaaatcatggtaccttaaaagtagaagaggggcaaaaaggggtgatacacaaaaaacaagaattccaagtaaaagatgaatgagctgctctaccatatttatggtgactgagagccatctgctggttacagtttagttacaacagtccaggagggccaactattgcaggcagcttctctattacatgatgcatgcaacatgcttagaaacacaatgcactggttctcactcctgtgaggaagcttaaaaaagtttcctatcggccgggcac

SEQ ID NO: 211203 - DNA, 550 bp, Homo sapiens
ctctatagtagagaaacctggaagacaccaccataatcaagtgatcgggaaaacttaagacacactgacctcagggactcctggtatgactcactgaaaaggacttttgaggtattttgaccaaaaacacacaacctcaatctaattatgagacaacatcagacaaaccgaagtagagacaaattcaacaaaatatctgaccagtgctcatcaaaacatcaaggtcatgagaagcaaagactaaagaactgtcacgattggaagagactaaggagacaggacaattcaaggtaaggttgggctctggaacagaaaaaggacattagtaagaagaatctgaataaagtctgtagtttcattttcaaaacaaaacaaaacagttattcttggcctccactactgccttcaattctgcttcagtctgtctgggaaatctgtattttcttttgaaagctccacagggattcactcagtgatgagtcagatgtgggcatcatcgtccttggggctcacttctcacccccggtgcacgttgcagtcactgaggtgc

SEQ ID NO: 211204 - DNA, 347 bp, Homo sapiens
ccaggtctccttttctgctgcactgctaaaacctcacaaatactgatcactaaaaaagccagcatgaagaagtcacactcacagaaaaatcatttcaaaagaaattgtagcaaattatttggagatattaaaaagttaaaaacctactgtttttttctactttgaaaacaaaaatacttagccacaggagtcccccactggcaattgctcatctattcctgaaagagcatcatcgcttcatccattcacttaaacaacttactgagcatctacaagggccaaaaagcactgtttctagtttacttcataaatgaactagattgaaatgagactttatgttgaggacc

SEQ ID NO: 211205 - DNA, 377 bp, Homo sapiens
gattcaagcttctaatctccatgtttcctcatctggttgctgccaactaatagcgaggtaagcaggaagtaagctgatgacctttaagatcttttccctgatattctaatattcaatgacaaaaatgcccacttttacttattgattccgagctgaccaaactacctcttgaggttactgaagccattcatgccttctccaactttatgctgaatacaaccaaaaagtgtatcagttatttacaacatcacttttaatattggtgatcagttgcttattccctagctcaaataaaaaattttaacatgtacactgattttaaaggaaaagcttttcaagaagctatgagccaagaagcattatatgaaaggcccaca

SEQ ID NO: 211206 - DNA, 301 bp, Homo sapiens
ttagatgtgaagcatcctcagtcttataatgagaaaacccattttgctatttagtttacggccaactttgttaaaatatgtatacttaataaagcaaggactaaacaagtttccctccacttaatatgacgtgtcttttattctaagtcataaatgttatctgtgaggactatcaggagagtgagagcttgttctttttcttcttggagagacattttggatagaaatcttccctctcagtagagtttgtatagaactgtgaatgactaatacaaatatgtgaaaatagtccttttatagg

SEQ ID NO: 211207 - DNA, 446 bp, Homo sapiens
tagtgcagtggcatgatcttggcttaccacagcctccacctcctgggttcaagcgattctcttgcctcagcctcctgagtagctgggactacaggagcctgtcaccacgcctggctaattttttgtgtttttaatagagtcaggttttcaccatgttgaccaggctggtcttgaattcctgacctcaggtgatctgcccacttcggcctcccaaagtgctgagattacaggtgtgattcactgtgcctggcctcagttgaactctttaagattattcaactctttccttaattcttaggtagtcaggattcttcaaaactttatgtttctctgggagtcaaaggaagtttatggacacaatttctccatatagtagcttatttctgaaaataagaaaaatgagtaagttggacctcatttctttttctaacaatgtgtgggttacc

SEQ ID NO: 211208 - DNA, 620 bp, Homo sapiens
aggagaattacacatatgcagttgtgttattggaaagtgcataaaattctgaaatcctttaacaattctgatgtgttttattattttattttattaattggcaatttcaaaataagtaagattacctgcctaacagctttttattttgggcagtcattaaggcaagttttgatggccagcttgtctgacattttttgtgtctaaaacattctgaatttggcctaagattttcactggaaccctcctctgctttggacatctaccgtaagactagagtagcgccgtggctcttgttaactacaaaactcaagacacatttcctattacatctaataacaatcttccaaataatgtggaataatcacagtaaataaacttgaaataaatactatgacttagttttactattgggtataaactaatgagcttagcaaacaatttctgttagtgcagtaaaggaatctgaatttgcctatgagtagactagtactagagaacttgcccaaggattagagttttaaaatagtggttatttaatccctcaaaagaatatattttagatgactttatgcattgttcaatagtaatgataatggccaggcgtggaggctcatgcctgt

SEQ ID NO: 211209 - DNA, 369 bp, Homo sapiens
cgggaatgtgctagtccctgctcatccaagcagatactcactctcgtgatttaaggagcagtggaaatatcacctgttcatacatacttccgtgatctgtgttcataaatccagtattagtgagtgactcagtctttgcctgttcctgcgattgcattcactacttaaaagtgccctgagacctcaaaatgcctgaatttatcagattggctaccactctgattagacaactgaggctgcaggagaggaccagattcctggcagtgggcagtggggtgacagaggaaagtaaacagtgaagaagggagcattaggaaaaccaacagtaaacttcaactgcctcagcattttgccaaggacagccctgaa

SEQ ID NO: 211210 - DNA, 392 bp, Homo sapiens
ccagttgaggcaagcttgccgtgtgttggggtcatctggccagcaacatcttgcaatcccctctttccctctaatgggttagcagattctgaggaaaggattttatttttctgttttgagttgtaaattggatttatatttttgttaaagatgaagggaatggggaatgtgcaaaaggaagggaggccatggaggagaggttggaaacccatggaagatcaaagagaacagtggagtaaggtctcggcaggttcgactcagagcagagctgaccagaggcaggagagcagctcaggcagaggagtttatggaaagatgatgcattggcagctgagcccagctggtcagcctccgtgtgtcgtcagctgagtggcaaggaagggtggcattgg

SEQ ID NO: 211211 - DNA, 491 bp, Homo sapiens
atcccatggcatccgtttgactgcaaggaagctgggaagtgtagttcaaatttgggaggtactgtgcccagaaagagacacacaaatgttggtgtgtgttgtggagcactagtagtttctggcgcaggcagggagaatggctgtgcatcttgtaggggtcgtagtagtgtctgtcctgggctgggttgggagtgtactctctgagaataccttggaaggaagctgatatgagaagatgtgtatgagtggtgcacacccatgtgctttatggctcaacaatcattccattctttcccattctcaaggtctttcactggataagatcttaattctctcacaccttaccactgaaataaccttgtgaatgctttatcctctacaattttcccccatcaaatctaactggatattatagtctaactaatcttcctaagacttggcgtatgtcatgcaatccctgttcaataaaaacaataacaatttcaacagca

SEQ ID NO: 211212 - DNA, 595 bp, Homo sapiens
gcaacaaaaagacaacccaataaaatagggttgcacataaaagtttaataaaaactgtacataaatgtttatagcaccattgttcataatagcccaaaagtgaaaataatccaaatatctatcaagtgataaatggataaattgtggcatatctatacaatgaaatattattcagtgataatatttcagaaatgaattgacacttcaaaataaaagataagcaaatggccaataatcacatattagccatcaaggaaatataaacaaaaaccatgatgaaatacaagtacacactcaggagaatgcctaaattttaaaatgccaaacattgtgaagaatgtggaaaactgaactctcataaaaaaaaaactggtgggaatgtaaaaagtgttaaattttccattttggaaaagtttagtggtttctaaagttaaacataaatctaccctagtacacagcaatttcactcctagatatttacccaagtccacataaagatatatacaaaaatgttcatagcaactttactcatagtaaccaaaaactggaaataacccaaagcccatcaatagaagacttgttgctacatacatat

SEQ ID NO: 211213 - DNA, 732 bp, Homo sapiens
cttttataaggtgggtcattaaagacatatttaaatatgttacatgacaagatttaagctataggacagataatatttaagcatttaagccaatctatctgtctgcaaaaattttagtagtttacatttctttctccttgaattctgtcagacacaacatattttgaatttgtagcgtgtcttagtttatacttccttggaagtgtatacttacgagttttatgaaggtaagttcatgactaactgtcaaagctgtcagcagacttactcaaatccaatcaatgtaaagtggtaaaatctagggccaagaataaaggcatatgaaatatttactcaaaatacaaactatctggaacaaaaggggaactgagtgtttgatcaaacctgtagcttagaagaaagaaaagaaggcttacccctgtaaactcaacactttgggaggtcagggtgggaggatcacttgaggccgggatttttagttctctcaatctggtgtcttgggatgaatagttttctgttatttagatggtaatattaggtaccaccaggaatgtgcaactatgatgctgtagaaatcaacaggtgttttaatgagtatccactgtatctgtagtcctttcctagccatggtaattcgggggttattctggggtaaccttggcgattattaaggccagctgagttacctactgggtttaaggataacttattgaaactcctttgaaggttggg

SEQ ID NO: 211214 - DNA, 184 bp, Homo sapiens
tgtccctcatcaaaagagatgcaaaaatcctgaacaaaatatcaacaagctcaatctaacatcgtatacaaagaattatgcatcacagtcaagtgggatttattccagatacgcaagacgggctcaatattctaaaatgacttaatgtgatccatcatatccacaagctgcagaaggaaaatca

SEQ ID NO: 211215 - DNA, 943 bp, Homo sapiens
gttttcacatttactcccttctagacatacctgtacttatgtacttacaggctgttccaaatgtaatatgttctctaccaaatgtggttaagaaatattcactcacaatttctttctgtgtacaattctgatgcctctgttgtcactgtaattgtcagttgcttttctgttttccaaatgtcttcttgtcataaggtatctgactttaaaaaatgttttcccttttctttttattcttctgtattttccagctgcatgtgtgtgactatggcttttacatatttgcacagaaaaataaaacctttgtttctgtatcttctctttctcatcttctaatggtacttgtacttgtttgccttgactatgtcttgtatgataaaatttccaccagccatgcatacacacacacacacacacacacacacaccacagaagtactggtactgatcttcctgaatcgtgatctctttctgtgaaagtgtcactgtgagtaaacactgtggtatccaagtaaagttgcatgtactctggcaagtaatcctctagttggcattctaaagttgattacaaccctaattgttcttattattggtttacattgtccctgccaaagctagccatagttcaacctggttctaaagaggggctgttttacctaaatgacagaaatttacactaactcctctggaccaagcttctaaaacatagcctatatttacttgaataaaaactaattccattttgctgcgtttttcagatttaacattaaactaaacagggctatgtctctatgtttggccatgcctccttttttgtgtgcgtacgtggcaagtgggtttttatcaccctcccttttgcaaaataggaaaatagagagaataggcaaatttggaaaaatcagtgtttgaggaggagagacaactaagttcaattaacaccactg

SEQ ID NO: 211216 - DNA, 536 bp, Homo sapiens
gagcacttcagcacctgcgtctggtgggcctatggaaatatatttgttacaagaggggttttgattcctcagatcccactgttcagagaacaataagaagagcctcctgaaggggctactgagccaaggccctgagacgcaggcctaggatgaataagtcacccccaccttagagaaaaggaaaagacaaagggcccaaatagaaagggggctggggtggaggaaacccctgtggaagacaactgacatttctgggccacaaaagtgtcctccccttcaaataggaggctggcaaaggcttcatagcagagactgcattggggtaacgtcacatgaaacaggcatttccacagggctgactgccagccttggcaggatgggagggggtcagggaagcagtgggtgaggtatagagacatgctccagaatgacagagttgttgggggtctggagaagctacgcaataactggcccacctctgagcttcaatgacctcctgatggccacaggtggtgttcctcagggcgggcaggtgc

SEQ ID NO: 211217 - DNA, 384 bp, Homo sapiens
tgttgggattacaggcatgagccactgtgcctggccttctagactgttacttaattgggtcttttgaacatatattttaggcaacttctttataaccctgtttcatcttgactgtcgtagtgtgattggcttatctgctttaaatgaagttacaaagcacaaaagaagtcatattttgtttgacatgtacattactaggttttgttaatgctaacttaattctcaggtatatcagcacaaatagcactgtttaccatccaggtccaacaaacttcactcagccacctttgtggggttggggtcatcagtatcactgtcttccatctccacatcgtgttccactggaagatcttcatcagggacagtaacactgcttgtactttc

SEQ ID NO: 211218 - DNA, 590 bp, Homo sapiens
ccacgtgataccgaaagcaagtcctaacaattctatctcctaaacatctcactaatctgtccaggcctctgtctccattgataccaacattctttcttacccagatataaatagctctttctttttaataacggtatacactgagcatggtggcacaggcctgtaatcacagctactcaggaggcaaaggcaggaagatcgcttgagcccaggagttagaggctgcagtgagatatgatggcaccacagaagaaatgcactccagcctgagtaacagagtaagacctcatttctaaataagtatttaaaaataaaaataaatgtacagttcaatgtgttgtgacaaatgtttacacctacgtatctaccctgccaatcaaaatacataacaattccatcaccccaagaagttctctcatgcccctttcgctatcactccctgggaccaagagtcaacctctgttctgatttctatcaccctagcttacttctgactcttcccaaaattcacaaaaacagaattatactgtagcagtatatggcatgcttatttttctcaaaataatgtttgaggccgggcgcggtggctc

SEQ ID NO: 211219 - DNA, 571 bp, Homo sapiens
caggataatttttgtttagtgaactcgactgaaaacaggatcaacagttataacacaagattcagtttggaatactgggaacttatcttcctaccagggaaggcattgatgatagccctgtggagatttcataattgtagatttcatccactggataaacataaagcatgaccacaacccatataattgctaaatgaataaattagtaaatgagtgagcagatatcatttcccttatgtgccatggcagagaaaaaaagttaataattgtctcttccagtatcaagcagcaagaaccatagggaatgctggatcataaactcttattaactatttcccttttgccaaaataaattttaaaaaattctaaccttttttgacatcatgcagataaactcatccagaaatcaggcaattacagagtggatgctagcatgatataaattgcctatatttaaatggcttgctcaaatgaggactagcattaaagattctaccaggagagttgaccctgtctgtccttccaaaagcctcagatctcttcctgttccctttttagaagacttgaataa

SEQ ID NO: 211220 - DNA, 524 bp, Homo sapiens
tctgaccctgccatatctttatttgttggtggctttgactgagttttgaatacttttattgtagagatgggggtcttggtttgttgtccaggctagtctcgaactcctagcctcaagtgatccttctaccttggccttcctaagtgttggattgcaggccagacccattgcacccagcctcagcctcttttttttttttttttttgtgagacagttttgctttgtcacctagtctggagtacagtggtgcaatcatgactcactgcagccttgacctcctgggcccaagcgattctcagcctcccgagtagctaggactacaggcatgctttatttttttgtagagacagtctcattttatggcccaggctggtcttgaactcctggcttccagcattttatatttctttgtatcctctgtagttgtgctagtttcagtaaattcttatgtatgtgagggctcacttgatttatacttgtgtcttcactgttgccatgcttgctcagatgtttattatcttggg

SEQ ID NO: 211221 - DNA, 354 bp, Homo sapiens
tttgttctcaagtagtaggactttccagaatgtcttctctcgttctgctccttgctggcccagttaccccaaagcctccccacccccaagcccactgcgaccaaaacaagcgcaccgaccacagcactgtggccgccgccgccccaactgttgcagcagctgcggggtggcggtagaggcgacgcgggcagggccggacccggaccccgacgctccttgtccaggaggctgggaggctccagtcggccgccctggggcgcgcggtgcaggagagtccctgcggcagctgcctgggctaggagaggtggcgctctcagccgggaccccagcgcagagccagcccgaccgcggccg

SEQ ID NO: 211222 - DNA, 424 bp, Homo sapiens
acatccagccagcaccacaggattaagcagacatgatgagtctttgacacaggggcaaaccaggacccagagaggtgacttgggacagggctgtctcttcagtccttaccacaccgtggacgagatcaaccttaagacagcaccctgggctctcactggaccctggattctggctcacagcacacaaagcaaactgatccctggaaagggtcacttgttgctgcctagcagcattctggtaggttggcatcctcaaagtgacataagcagtgaagcaattcagagcaacatttatttatcaagacagggtctcactctgtcacccagactggagtgcagtggtgtaatcacagttcactgcaacttctgcctcctgggcttaagcgatccttcaacctcagcctcccaaatagttgaaactaca

SEQ ID NO: 211223 - DNA, 301 bp, Homo sapiens
ccatgattacctttaaaataatctactattatttgtgtctttcctgaatatcatagcaccttcttgtcacaaatgcttaggggaaagaaaatcatccaatataccccatatcccacttaccaacatctctacagtaaaatgagacccaagagcatgatttccttaactagctatcaagcaactacctccaacaaacagcagttatcattaatatgttcatgctattttcatttgtgaggtctgtaatccatcagaacaacctgacagtgattaagtaaaatcaaagagactttgtaaacat

SEQ ID NO: 211224 - DNA, 432 bp, Homo sapiens
atggctttctatttatagacacaccttggagatgttgtaggtttggttccagacggttccatgcaaattttttggtttctgagtgcatataaaagttatgtttatattacactgtagccaattaagtgtgtaataccattttgtcttaaaaaaacccaatgtacatataccttaattaaatatacattattcacttgcagaccaaagaatattaagttataaaaaaagaaaaaatatatatttttactaaaaactgctaataatcatttgagcctttagtgagttgtaatctttttgctggtggagggtcttaccttgatatggaaggctgctgaccgattagggtggtggttgctgaaggttgggggccaggggtctctggcaatttcttaaaataagacaaaataaagttttccacattaattgactcta

SEQ ID NO: 211225 - DNA, 596 bp, Homo sapiens
gcttcctactcttaacctgtctctcctacctggaacatgagtgaggaagcacagagccctgatcctaaagcttggaatgaggctaacctgagcatggtagaatggaaagggagaaagaatctgagtctttgatgacaacattgagccactggtttgaactgacatgaagtgtaccccatcccctaactgcaggtttcatgaaccaataacctccctgattgtttaaggcagtttgaatcatgtttgctttatttgcaactgaagccgactgcgttcagcaatgaatgatgataataattatgacactagatctctcaattcacctactacatcctaagtgctttggaacccccagctctccatggttattttcatttaacagatgaagataccatctgggcacagtagttcatacccgtaatcccaacattttgggaggtagaggtgggaagattgcttgaggccaggagttccattctgggcaacacagcgagacccatctctactaaaaatacaaaaattagctgggacctgtagtcccagctactcaggaggctgaggcgggagaatcgcttgagcctgggaggttgaggctg

SEQ ID NO: 211226 - DNA, 343 bp, Homo sapiens
agtgttagctgttccacagctcaaagaggaactaaaattaaagacaggaaagcaacattgtgaaaatgcctatggcagccactgagagttacaaaacagcctcaactatctcctaagaaatgatcactggggatgcatgttttcaaactctcattggatgccctgtatgcacctgttgtaaagtcgagaaatcacaccagcaccagcactgctttcctgatcacctgttgaaaatgtaatggacacgaaataccaaaaacgggattaaattccccaccaagaggacatccttttcgtgtcagcggcttcccagtagcaccaccaatacaggggattctctaag

SEQ ID NO: 211227 - DNA, 406 bp, Homo sapiens
ggagaaagcctcaggtggaacaagcatgaggataaatggagattcacaagcctgttaactcactgtataaacgtattaaggaaatgagctttaatttcaaaatggggctcatcagagattgagaaatatgttgcttcagtactaacgctatcctacttggcctaaacaagtccaagacatgcctctcttctagtaatgactctacttgcaaaaactcagttctgtctacatacctggcaaagtaatgctctgcaatgagaggatattaaattatgcagattattcttgtggagggcaaggctggttaataaaacaaacctgtaccggcaggcagatgttttcaactatttaattagatgacaaacttagtttgaagatactcctctgtgcaatctctcccccagcc

SEQ ID NO: 211228 - DNA, 385 bp, Homo sapiens
ctgctatttctccatgttgttgcaaaacaatcaatagcatgcaaagaggaaaaaaagagtgaatgaacataaaaaataaaaagtgaaagaaagcaagacattttagaaacaaaggcaagaaacaattctagaaaagtaaaaacctaataaatatcgatgtctataaatttcaaagacaaaaccctaagaaatgctgccacagtgtgctttgtgaggattggaataaagtgcaaggaaaaggagctggggaaggtatgtgacaaaaacatcataccagtccttttgggatgcagctaaagcagtgcttagagggaaatgtatagatgaaaatgcctacaatagagaagaactttctcaagtcagtatctcagctttccgccttaag

SEQ ID NO: 211229 - DNA, 381 bp, Homo sapiens
tcactccatgcggtgtgtgtcacctccgctgtgatggttgtgtatggtcactccatgctgtgtcatctccgctgtgacgattgtgagagtgtcacctccactgcaatggttcctgtattcttgcaatgatcatcttggctcaggtcacctcagatctggcatttttccattatgactagtttatattcttaccctgaggtttggcaaaaatattgaatcaattgttcttaattatgaccatcttgtacactttgcattgcaggaacagttcaataatgctttatagtccaaagagccctaggagcactgctcaatatcccagagtggaagactagagttttccttttgttcaactcataaactattcttaaaagtgccata

SEQ ID NO: 211230 - DNA, 314 bp, Homo sapiens
aggatccccgtagtcttgctacatcagccccgccgttacgagtaaaggtgccacagaggagacaaatattttccctgagccctctctcccaatatataggaaaaaatacaagggatacattactggatggcgcatcttcgtcccatcagaaaatggtcatgggccttctacacaaatagtgactccaacgactgcaagaatgtgcatgaaacaaatctcttctctagaatccttcagggcgtgatgggacgcaagtacagtcttgctcccagtcagtcatatactattttaagattttgtgcttaaatttacaa

SEQ ID NO: 211231 - DNA, 304 bp, Homo sapiens
agttgaatccaacttggagactttaacacacactatcagaaatggacagatccagcaggcagaaaatcattgacataactgaactcaacattatcaatcaactggatgcaatggatatctatagaccacttcaaacaacaacagcagaatacacattcttctcaagcttacgtagaaagttcaccaagacagagcaattctgggccataaaacacaccttaacacatttaagaacagaaccgtgtctgctgtcaggctacataaactagaaatcagtaacagagatagctggaaaatcccaaaa

SEQ ID NO: 211232 - DNA, 575 bp, Homo sapiens
cttgggaaattcaatattgttaagatgctagttctccccaaattgctctataaattctatgcaatgtcaaccaaaatctctgcttttaaaaaaattgacaaactgattctaaaattcctataaatgccaaaagcctagaataatgaaagcagttttgaaaaagaaggagaagttggacaagtacaaattttgagacttattataaagctaaaataatccagaaaatgtggtattgacataggatacatatatagatcaatggaacagagtagagagaccaaaaatagattcaatgtatagggtgaattgatttttgacaaaagtggcaaaatactttaatggggaggatggtagtcttttcaacaagtgatgctagaacattgagttctagcaccagtagaactagaatgtggaaaaagtgaactttgggcatatcatgttgaaaaataactcaaaatggatcacagacctaagcacaagaactgaaaatataaaacctccagaagaaaacataggagaaaatccttgcaaccatggaatgagcaaagatttttcagggcccccagtgcatgaaa

SEQ ID NO: 211233 - DNA, 503 bp, Homo sapiens
ggacaaggttgggatcctgcaggggaaagaaccagggagataaaatggtgggaaaattgtgcactccaggcaccccgaaaatgccccacgcctcaggggtgccgaaatggacactttacttctaagtcagaagcagggcaaatttagggaaaagacgttggcctctacaagggcagatcagcatgctatctagcttcctaaaatggtcaaaagaggacattaactgaataaagtaaaagaagaaaaaaaaaggcagccaggtgctttgtgcggcggagcccgctggaggctgggcaagtgatgagtccggacccggggagcaccccaggccaggctttccccaacgccccctgcgtcaccatcacctcatcctgcaggcccagcttaggcgccatctcctcttctgcatcccagagcccctcacgggttctctgagccggtgacgctggatggcctctgactccctcttttcttgctgagtccccgagtgcagggcccagacc

SEQ ID NO: 211234 - DNA, 231 bp, Homo sapiens
cttagttgctccagcccagccacccctgtcccctggagacagtggccccagcctggtccacgccacaggagaaagatcataagaatttatttggagccaggtgcagtggctcatgcctgtaatcccggcacttcgggaggcccaggagggcagatcccttgagcccaggaatttgagaccagcctgggcgacatggcaaaaccctatctctataaaaaatttttaaattat

SEQ ID NO: 211235 - DNA, 437 bp, Homo sapiens
agggataggggagggccgggggtgtccagcagtcagcagagatcctgcgaccccagtgcagcactcatggtcccacctccctctgtctcattccccgtgaatgagcctgaacagcttcagtcctgcccctgccctgcctgccctgtggcacctctatgctttgcccatgctgttcccttgggctgcaatactcttcctagcttatttgccaggctcactcttactaaccctttcaagctctgtccaagcatttgctgcctccagaaggccttattgaagcttctaagtccccacctgggcacccccacacagtgctgccgcagagcactgccctctcggagccccggtgctggtttctgcttatgtctcgctcctctccccatctgtgagctcagttcccagcccaggcgcgtgcccaataaatgtttgctgaacca

SEQ ID NO: 211236 - DNA, 1602 bp, Homo sapiens
tatctcatatgccaccttctcaaaaaggacttccctgatcactctatttaaaatagcctctccagatacgtttgtcagcttgctcctttctgcctgtggatgccaacaaagaagcatcattaaagtctctcttctcccttccgtcgtgtctaagtcagagtctcctaaagagcccgaatagctgaggaagctcttcattggagagttgaggtttgaaacaaccgacgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagagctatggaagtggtggacagggttgtggaaatcaggacagtggctatggcaggagtggcagctatgacagctataacaacggaggcagaggcggctttggcggtggtagtggaagcaattttggaggtggtggaagctacaatgattttgggaattacaacaatcagtcttcaaattttggacccatgaagggaggaaactttggggcagacgctctggcccctagggtgatggaggccaatactttgccaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgt

SEQ ID NO: 211237 - DNA, 664 bp, Homo sapiens
caagactctgtttccaaaaaaaaaaaaaggaagatagatgatcaaagaaaataaactgacaacctgaaaacaaggaagtagaactggataacaaatgtggaaaaatttctagcctcactagtatcagagaaatgcaaattgaaacaaggtgccatttttggactctagttagtgatggtagtgaaaaccagaatggtcctttctaaaacagcctgtgtgtcaaaaccataaaaatgcttctacctctttttaccctgttaattctacttctgagagtttttcctaaagaaataattcaaaataggaaaaagctaaaagcagaaaaatgttgaacatgacattatttatagctgtggaaagattggaggctgggcacagtggcttatgcttgtaatctcagcactttgtgaggccaagttgggaggattgcttgaacccaagagcttgagaccagcctgggaaacgtagtgagaccccatctcttaaaaaaaaaaaaaaaaattagctgagtgtggtggaacgtgcctgtagtcccagctacttgggaggctgaggtgggaggattgcttgagcccaggaggctgaggttacagccaggatcacaccactgcgctccagcctgggtgacagagtgaggctctgtttaaaaaaaaaaaaaaaagag

SEQ ID NO: 211238 - DNA, 503 bp, Homo sapiens
cttagcaacggggcctggccaggccagaccagacgaagaagcctgaagcagtacctggctgatttcccctcccccacagccccatcccagcagctgcctggttgctaaggaggccttctccctagcaaccacacctagccaggctccaggacccaaggccttctgcccactggaggaccaccctccgggcctccgatgccccacccccttgtggcccggttgctaggggtagctgcaccttagcaacaggcctaggtctgggctggagtctcacattggagcctggttgctaggggaggtaactctttcctgacaggcctagcgaggcgtagtggctcctcgaatctacctgaaggtgcccaattcaggaggacctgccttctgaagctgcacttgcgccttttgctaaaggggctcaaaagtctgggggtttactgtggtcagatgtggtggctcatgcctgtaatctcagcactttgggaggccaaggcaggcggatcacc

SEQ ID NO: 211239 - DNA, 106 bp, Homo sapiens
acctcatttgttttgttctttcagggatcaggtttctgtgctgcttcttgtctaatgtccaaaacctttacgtcctatgatatattttggccagttttctagttgt

SEQ ID NO: 211240 - DNA, 323 bp, Homo sapiens
gggttggccacttcactgatgaccaaagattaggactgaaagaatcaagagttgtgcctcacaagggacattactgccactgccaccagggcaagtagtttcagcttgttgttggcatttgcctggcatagggatgagagaatagaaagaactccatcctgcagggatgctgccgccaagagggatttgctgcttagttgctggtgttcacttggagtagggccaaggctgtccaacaagctctgtcccataggggctggtggtgggggggtgcagtaggatctgggctaggaaagtcccaggagctctggcctgcaggggtt

SEQ ID NO: 211241 - DNA, 406 bp, Homo sapiens
acaaggcacaatagacatgttcccctttgagcaacacaattttctaacagccaataggaaataacagttcgaaaatttatcctaaaatttactaaacttttaaaggctatgtggaattaatgcattatcaagcaagagtagataattggaagctaccctttcctattatacagttcttggaatcaagagttacttacagtaactgataggatgtgaaaataagactatagaatcagcacaaaggccaggtgcggtggctctcgcctgtaatcccaacactttgggaggccgaggcaggcatgacccaccaggctcggctgaattacggttttaatttttatctttgtaatttatttaaacattcctttattcctgcttgcttttctatgtatttttacactgttga

SEQ ID NO: 211242 - DNA, 426 bp, Homo sapiens
ccctgccccacgcggctccggacacggaattgcagctgcggtagagatgagatgtagcaacagttctgcagtagtgtggtggtgacttgggtgtgttctcctcctgacattcacctgcacctttttctgcgcttttcagtatgtatgtatttaatagtatcactcaacaaaaaggagtttatcaggccgggtggctggctcacgcgggaggagagcttgagccctgcaggagttcgagaccaggctgggcaacattgggagaccccccccaccaatctctacaaaaaaataaaaaataaagtttataggctgggcgaggtggctcacgcctgtaatctcagcactttgggaggccgagatgggaggatcgcttgagcccaggagttcgagattaacctgggcaacataatgataccctgtctctta

SEQ ID NO: 211243 - DNA, 282 bp, Homo sapiens
gaagaatcaactggctacttcccactggttttcagatcagttagttgctactaggttaccatggataaaggatttgtttataagcccagaagtttaattttatcctcttgattctcagttattgatactagtaaacaaacttacaagaaactaatttgtatgagagaatacaaccccgaaatttacataggaaaatgtacctagaaactggggcttgtggtctatacaggtgtggcagagacggtaatcacttaccttgtccttctcaacatttcctaccta

SEQ ID NO: 211244 - DNA, 448 bp, Homo sapiens
caaaagaaacgtaaacaagcattaagattcagtatttaatcataggcataaaactgtagtacagtatataacttcatagccacctcctgttgctgttgtggggagctcaagtatccgcttaaaacaccatgtgatgccagtcatctccatgtgagcagttcccctctctgtaaattgcatattgcagtaaagagtgatctctcgcagttctcatggatcttgcgtcgtgcttcatgcagtaccataaaccttgaataaccatgggacccatacgaagtgccactagtggtgcttgaagtgctcccaagaagcaaagaaaagtcatgacattacaaggaaaagttgaagtgcctgatatgtagattgaaacctgcagctgatattgcccgccatttcaagacaaatgaatccagcataaggaccattgtaaaaaaaggaccattgttta

SEQ ID NO: 211245 - DNA, 1158 bp, Homo sapiens
gtcaaataaacctctttcttttgtaaattgcccagtctcagatatgtctttatcagcagtgtgaaaatggactaatacacaccctaatactgaaacagactaatagacaccctaataccaaaagcaaggaaggacataatgagaaaagaaagctacagaccaacatccctgatgaacagagatgcagtaatcctcaaaaaaaatactagctagctgaatctaacaacatatcaaaaagataatccatcatgatcaagtgggtttcataccagggatgcagggatggtttaacatctacaagtcaataaatgcgatacactacataaacagaattaaaaaacaaaagtcacatgatcatctcaatagatgcagaaaaaccacttgagaaaatccagcatccttattttattaagaccctcagcaaaatcagcatagaagggacatacattaaggtaataaaagccatctatgacaaacccacagccagcattatactgaacagggaaaagttgaaagcattcctcctgaaaactggaagaagacaagattgcccgctttctccacttctattcaacatggtactggaagttctagccagagcaatcagacaagagaaagaaatcaagggcatccaaagtggtaaagaagaagtctgcctattgctgtttcccaatgatatgattgtatacctagaaaaccctaaagactcatccaaaaagcttctagaactggtaaatgcattcagcaaagtttcaggatacagagttacacacaagtgtgcacaaatccgtagctgtgctatacaccttcagcgaccaagccaagaatcaaatcaataactcaaccctttttacaatagctacaaataataataataataataaaatacttaggaatgttcctaaccaaggaggtgaaagatctctgcgtggaaaactacaaaacactactgaaagaaatcacagatgacacaaacaaatggcagcacatcccatgctcatggatgggtagaatcaatattgtgaaaatgaccatactgccaaaagcaatctacaaatttaatccaattcccatcaaaataccaccatcattctttacaaaatgatgaaaaataatcccaaaattcatatggaaccaaaaaagagcctacatagccaa

SEQ ID NO: 211246 - DNA, 441 bp, Homo sapiens
tttcaaaggagacaactttctaatattctagaaggtgaagaatatcataactgatttatagtccaagaggtctcattagaacagtggaaactatttgctggagctgttgaattttctgttagagtattaaggcagggagaataccattttcagcctcacaactactggcatgcatagagtttaatgttggattctagctgctgtcttgggaagaaagtactttttttgagacagagtcttgctctgtggtccaggctggaatgcagtggcgtgatctcagctcactgcaacctccacctcccaggttcaagcgattctcttgtgtcagcctcccaagtagctgggactgcaggcatgtgctaccacacccggctaatttttgtattgttactagagatggggtttcaccatcttggctagcctgggcttgaattcctgacc

SEQ ID NO: 211247 - DNA, 204 bp, Homo sapiens
ccattcgagaattttgaacaaggaagtgacaacatcagacaagatcagattcacctggaggctagagaggatggtgactagaatcaaggagaccaaaaacccaggatgttatttcaacaatctaggccagagagactgaggacttaaattagagtagcattagaggaatggataatggagacaggatatatgagatattcagga

SEQ ID NO: 211248 - DNA, 519 bp, Homo sapiens
ccactgtgtgctgcagaaactgcagtaaaaataagcttttgtgctaacagtgtaagaagagaagcctttgagggatgatgagattagcactctgtaggttcaaccaggtctgcagctggatctatagaccaagaatcaggaagtcagaggaataaagtaataatgatagctcccatttcctaaggcttttcatggtagtatgtggtgtgcttttcatgggttactcaatggaatatccttaacatccctaagaggtcagtaccatacatattcccagttcaaggaggaaagatgaggctcactgagatggagcaatctgcccaaagttacacagcaggtctgtgacagctccacgtgactccagagctctcaaccactagccaggtcgtctacacacctatctgaggtgtataaactgaggcacagtcagtacgttgcagagcttataatacatttgaacatatatattaggtagaagctgaactacaaaaccattatagtaaaataattatcctttaa

SEQ ID NO: 211249 - DNA, 459 bp, Homo sapiens
atcaagtatcatatcaatgtcagataggtgtagttgattatgtcattcaggtgtactgtatcatttttaattttctacttattctgtcatctctgagactctacttagtctatcatcactgacaggagagtgtattaaggcattcatccctttgttcatttctcctttcagttctattagcttttgcctcatacaggagaattacatcttccatttagaattatgtcttcttagaggatagacctctttattattatataatgtctttctttatccctgacaatattccttcttcagaagaatgctttgtctgatactaataaaactaccccagttggtttgttttgtttttgtttgttgagacagaatcttgctctgttgcccaggctggagtgcaatggcatgagtccagattgcaccactgcactccagcctggcgacagagcaagactccatctc

SEQ ID NO: 211250 - DNA, 526 bp, Homo sapiens
tttacttgttcccttcaaaaagctttgctttgttttgtgttttaaaatataagctatttatttagtatttgacctgatacctacgaagagctcaactgtggaatgaaaaagcagtaatgcatgtcctctaaatcttagttctcttctaaagtaaatatgcttattatctgtctttcgtgcttttcatttatttaaaatttagaatgtcttatttaaaaataatcagacaacttttgagagctgttggtaatttctcacaatagcacacaatctggagtctcaagactgaaaactggacttgggttagttacttaatctttggtgcatttaatccttaaaaaaatacctgacgctatttaattcacagggctgttttaataatcaatggagataacgtatatggaagcattttttataccttaaagcactatataaatattagttttttttaaatcactgttcacatttctgttagatcacatgcaaagcttctaaaaatctgctacccacctaatttacccacagt

SEQ ID NO: 211251 - DNA, 468 bp, Homo sapiens
tcacccttctaatgatgtgataattatgggaaacagcttttggaactgttatttgggatttgtcttcagaggcagttgaaaaatacttgcccagcttaggcaacgtagcaagaccccgtctctacacacacaaaaacacacacaccagcctatgcaatgtagcaagaccctgtctacacacacatacatataaacacacacacacatgccagcctagacaacgtttcaagaccttgtctctacacacacacacatgcacacacccaggtattgcagctaggcaacgtagcaagaccctgtctctccacacacgcatgtgcgcatgtgtgcacacaggcactgcagctaggcaacgtaggaagaccccgtcgctgcacacacacacacacacacacacagccaggagttcaaggttgcagtgatcaccactgcactccagcctgggcaacagaatgagaccctgtttct

SEQ ID NO: 211252 - DNA, 560 bp, Homo sapiens
ggatcaggaaaattaccccagagggtgtgattttgggattgagaccagaagctgagtaggcactggggaaagcatggggggcgtatgggaaatggcttgcagagaaccaggcattcctccagccctgtgtgtaatgaaatcatgattttcattgtgaagtgctttatttctccacctcttcaatctggtctcggccatgtctttctttggtcaacagacagagacttgacaagtccttgcacattggggcttgccctcccttcttgccaggagccttgaagccactgtgaagaaggccactctagggtgagagttggggcaaaaggtaactgacaggagggggcagaaagcgtattacaagcagaggaacggaatgggcaaaatcccagtaagggtgtctatttggggggcagccaacatttctatttggctgaagtgtggtatctagagtgggaagggcaagaatgaagatggtgagtgaactaaggcaagaccaagaagttcgggggaagccgcagctacaagttagggctttgcctttggggcggtagtgagtcact

SEQ ID NO: 211253 - DNA, 485 bp, Homo sapiens
ctaaattatattttcactgcactcatttttaagcagcactttgattagttctgaagaatcacattaagaatgaatgtggataaatataaggaaatgtaatgaaaaggtttgagggagtgattcctctcagctttcccaaggagaaagcttatgcagagacaaaataatggacaatgtgctccctggtgttacaaaccgtttgaaccattgactatttttaaaatgcttcccctgtatgcatgcagtgtcagaaaacacttaataaggaccctgtaaattgagtgttgcttgctagagagaaaacctaacctttcattgctttgtttttcccctggagttaatgttatgatcaatagattgccggtataatttagataaatctggagtttaattgctgtttggaaaaagtagttcctttttaaaatgtgcaaaagcaaaagagattgaggaagttatagggtgtttaatccaagccttaagagaga

SEQ ID NO: 211254 - DNA, 311 bp, Homo sapiens
ccttcagtggtacttctttcctagccattaggaaaacatccaaactcccttacatatagaatggtaagctgctataaattcacaatccccaaaactcaatgaacactccatattgcctgtcagtttctccaacgtttccattctctagtgactacagacggtccctgatgtatgatggttcaacttataattttgactttatggtggtatgaaagccataaacattcagtagaaactgtacttctcagctgggtgcagtggctcaccacacatgtaatcccagcactttgggaggccaaggtgggaggatc

SEQ ID NO: 211255 - DNA, 142 bp, Homo sapiens
gccataatcatttaatcgtgtatagacttaattaatccagaggatcaagcctgttctttcagttgtctaaggaagcgtattttcttttttcccatgttatgatattctggagtttctacttgagattatctgagcataagaa

SEQ ID NO: 211256 - DNA, 495 bp, Homo sapiens
tctctttcttccttctgtctgcaagctggatgggtccagggtcaccctaaaactgcattaaaaatggtggagctacacaaaggaagacatctgagcccccagatcactgcgtggagaagagggtcccactcagaaacccacattaaatagtgacatgagttaaaaacaaatttttattgtgttaagccactaagatatgggtatgtgttaacactgtttatgccaatgaatatatgctgaaaccataatttctacagttctatagtgatagttatatattcaaatggattcaatgctcatgaccagtcttttatttttagaaggatgtcaccattcttgaattctatattttgatttatctgtttttcagttgggtttcatttcaaatcgcttctttcaagtgaggctcatgagtgctctatttcctgaggcattatatgtttgtgaatatatttgtggtgcttttaacaataaataacagcttggctggatatt

SEQ ID NO: 211257 - DNA, 281 bp, Homo sapiens
tggagcaagactccatctcaaaacaaaacaaaataaaacaaaacaaaaaaaaacaaaacacagtaatccactgaattggttccatgaattggttcccactaatggggcacatgagctgttgtttggaaaacacttagcatagtgttcagaagctttagcatcagagagacccagattcagacatcagctctgtctgaatctagcagcacttccatggaactcagtttaaatgtactttttattcaatttttcaggaaattatttatgccaaagaaaaaata

SEQ ID NO: 211258 - DNA, 283 bp, Homo sapiens
agacagagtgagtgggtgggccttctggcagcttccttaccttcaaatctttgctctctgtgaaatggttctgcttcagtatccttgttctgatttttctgggaactagatgttactgggagatgactcagagcaggccaagccctgatcctcactgtggaagcaaaagaggctggtgaaagtcactgtcctgacaacttggaccagaaacctacagacaaaactgaaatgttttcctgccctaggattatctggataacaatgacctttgatgttacaaagt

SEQ ID NO: 211259 - DNA, 221 bp, Homo sapiens
ttaaaatgccaaggataactttctttaaatcaacagagtcatggattttgtcacactgtcagtccactcacatagaaatagcttagcttttacatgaataagactcatatataagaagagtttaaaacaaagacaatgtgttcctcctcttgctttctgagaacacccttctctgtaactgagtagctttcaataaactatctgttctcaatgcactttga

SEQ ID NO: 211260 - DNA, 444 bp, Homo sapiens
aggtgtatatttcttcctcgtgcatgtctaaggtgctttgataggaaagcagtccacacaggaggctggaacaagtaactcctcttgtggtttggagcaggttggtgtaagaactgaaattggttacattttcacagtagtgggaaaatatgtttgtgtttaaggagtagaatagatgcaccttcattcagaaagtggaagtttatgaagtctaagccaaaacacaacttggtgaaaaaggaaatgagagagaactgaatttagaatggccaatgatagaacatttttttatccggtttccaaaatgtagcagatgttgaaggtgatagcagtgagttcagaagaaaaagatgtaagtgcaaagaacgcacttgcatttggtataggagatgaagcgtggggtgacctagatagtgaagatataaagataactcacattgggca

SEQ ID NO: 211261 - DNA, 506 bp, Homo sapiens
caggaaagttcgtgctgctaggcagaggaactgcagcttgttggcaggtgaagggagcctgtttagctgtgtccagcaacaacttacgtggtcctgcttgtgttccaggtgaagcgtctggccgccgagcagaggaatcaagacctgctcattctttcctcgggggatccatccagcaatgacatcatctcatgctgccacaaggaccccaagtctgggctgctggggaccagccacgctccccactgctcattccttcatcctagagacattctgactctcctccgactgcgctgtgcacaggcgtgacaagctcttttacatctcagtctgcacaacttcaggcacttagcagattgatatgcatccaacaaatattgattgaatatctgctaaatacccagtaatgtttcatgagtgattgggtgaataaaggaatgctggttccttctggccatattaactcctgcacaatactaagaaaaataaattgcactagctgtgga

SEQ ID NO: 211262 - DNA, 693 bp, Homo sapiens
caggaaagttcgtgctgctaggcagaggaactgcagcttgttggcaggtgaagggagcctgtttagctgtgtccagcaacaacttacgtggtcctgcttgtgttccaggtgaagcgtctggccgccgagcagaggaatcaagacctgctcattctttcctcgggggatccatccagcaatgacatcatctcatgctgccacaaggaccccaagtctgggctgctggggaccagccacgctccccactgctcattccttcatcctagagacattctgactctcctccgactgcgctgtgcacaggcgtgacaagctcttttacatctcagtctgcacaacttcaggcacttagcagattgatatgcatccaacaaatattgattgaatatctgctaaatacccagtaatgtttcatgagtgattgggtgaataaaggaatgctggttccttctggccatattaactcctgcacaatactaagaaaaataaattgcactagctgtggaaaaaaaaaaatcccaatgtcatctattgaaatattacctgactattaagaggtatttatttttgtatcttttctagcaaagtaaataaaattcttaatacagcatatccccttattcacggggggtatgttccaagacccccggtggatgcctgaaactatggataataccagatcctacatatacc

SEQ ID NO: 211263 - DNA, 529 bp, Homo sapiens
caggaaagttcgtgctgctaggcagaggaactgcagcttgttggcaggtgaagggagcctgtttagctgtgtccagcaacaacttacgtggtcctgcttgtgttccaggtgaagcgtctggccgccgagcagaggttgttgctgcttcacattcgtagaatcaagacctgctcattctttcctcgggggatccatccagcaatgacatcatctcatgctgccacaaggaccccaagtctgggctgctggggaccagccacgctccccactgctcattccttcatcctagagacattctgactctcctccgactgcgctgtgcacaggcgtgacaagctcttttacatctcagtctgcacaacttcaggcacttagcagattgatatgcatccaacaaatattgattgaatatctgctaaatacccagtaatgtttcatgagtgattgggtgaataaaggaatgctggttccttctggccatattaactcctgcacaatactaagaaaaataaattgcactagctgtgga

SEQ ID NO: 211264 - DNA, 565 bp, Homo sapiens
agtatcctcacacttgctgggtaatagtaactgtgctattcctagcaagaaaccctaaggtttctaggcttgttctggaaaagaggatattgccagagttggtaagtagaggaaagtgattagtatttaagaaactgaatcaagaatggttccaaaaatcttaagatccagggaaaccagcttaaggtcaaaggcaagtgctagataatgaaattaacaccatatgagtacaaatttacaaaatactgtacttcaccataggctatggaactcagtggaaagccaaaaaagcactggacaggtggtgggagtgcttgacttgtggtgaatttatttcatctgcttatacatttgtacacagcacagttcttctccagaatgttgtttctgtggctgggaccattggactgtggctccaaaagaacaagagtctgaagatgggatgttgacaagttttggaatgtcaattggggaatcataatttgtatttatttaggttttttttggtgttcataaaatgcttgtgtaatatttacatatgtcaaataaatcttaaaattttata

SEQ ID NO: 211265 - DNA, 519 bp, Homo sapiens
ccaggtcatgtaggacagtatagctcaaggtaagcagtggggatttgaagtgtactgagtaatcattgttttactgagtaatcaaagctttaagtggaggtgtaactttgtctggtttacactcttgctgccatgtgagaataggtggtgagaggcgagaatgaaagcagggaacctattgtagtactccagatgatcaagttagagatgtattttggaagtagaactaacaggctgatgcactgtttttgaggaaattgaaataatctggaatggctacatggcttttggtttgaatggtgggcaatgatgtttattgagaaaaggaaggcttaggaaagaacagactggggatagagtgagggagaatcaagagttctatttggaacaggttaagtttgattttcctgtgagttcctatgagacatttaaatggagatgccagataggcacttgtatgtgtgactgtggagcttcagctgaagatgtggggccatcagctgttccacctctgttagg

SEQ ID NO: 211266 - DNA, 465 bp, Homo sapiens
ttgaagaagctatgacaggcatcgttgtgttgcagcctgcaaaacggtgccccatcccttagaacctgaatacgagcaaacatcactggagaaaagttacatgtttaaaatgtaaataaactagcttttatttttagctttttactgcgaaaaaacaagtgtttggaatgattctttaaaaatgtgtggaggatgggtgtggtggcttatgcctgtaatccaagcacttcggggagggcggatcgcttgagcctgggaagtcaagaccagcctgggcaaacatgcaaaatcttgtctctataaaaaaaatgaaaaaattagccgggcatgtgcttgcctatagtcccagctactctggaggcagtggtgggaagatcgcttgagctcaggagatcgaggctgcagtgaggtgaagtcatgccactatacttcaacctgggtgacagagagataccctgtctcaaa

SEQ ID NO: 211267 - DNA, 812 bp, Homo sapiens
cgcagcagtccccgcaggcttttgagacacacattaggagaggactctgcccgctgtctgtctcacaatctgctcgaaatatcttggtcaggaatctcaggatgtctagtgaccccgagtgaggtgctgccttttattcctgagcatctttggaagcaggaagcagggagcaacggtagcgagaggtattcggatctgagtatcagcaggaagaagaaacagaggaagaagtcccccataaggaaggcgtgaggagcgcaggaagcgctgtttccctgcctgagatctttattctactaggtctttattctacgtagccgatacgctgtaaaattctggaagagaaggctaggggtttaaggttggtaatctctcagaagatctgcgtctcggtgacggaaagaactaagggtaagtgctgagaagcctctctttacagccagagaacgagccagagccgagcttgagaatgacgggatagatctagcagttatgcccaaggaagaccctcggccctttgaatttgaaggcactgaaaatcgtataaatgttttcatataaacgtatgcatctttgatataaataacaaaatggcttttagcacaaattttgttttggaaattttgaaaaacgtcttaataagaggaatgtttactcttaagtctgcagtagattttgaacaccggcagtaactgtacaaatatatcagattagttttaatagccatctccccttcccctacaagtaaaggagagtactacagcagtatgtactctgaattgctgctattgaagaacccctgagcctgtgca

SEQ ID NO: 211268 - DNA, 438 bp, Homo sapiens
aggaaatagagtgatggggtgatggacaaggaaagagagctcaaagctgcctgggtcccagattaatttttcccggtacagtgtcttgtttggaaggaggaaggcagaattcttagatgattttctggtttaaatttaaaatggatctaatttggagacctagtaagtgataatgaagactgatgctgtcacatggtctggcctcatcacaaaaataattgattagtttttagttccttatactctgttcccttagtaagggaaactcatgttttttataaagcagatgctgagtgaattcacagttctcagcttttatgccactttctgactaagtcttgaggatacacacttgtggtcttgagttcaggcatagagggaagcatagaccattttctgttgctccttatggctttatttatgttaagatttgtttga

SEQ ID NO: 211269 - DNA, 466 bp, Homo sapiens
cagaatcatggataagactagcgaacattatgttaagtggaataagtcagacacagaaaaattaatactgtctgtccttacccatatgcaggagctaaacaaatttgagctcattaaagtaaatggtagaattgtggttattagatgttgggaaggatgtgggagcagaggttggttaatggacacaaaattatagctatattggaggaataagttctgttgtagtgctctatagctggtcacatggaaataaccataatttatggtatattttcaaaaagctagaagagaggattttgaatgttgtcaacacaaaagtatgataaatgtttgaggtgtttgaaatgctaattaccctgatttgatcattacgcattgtacacctgtatcaaaatatcactctgtttccataaatatgtacaattattgcatgccaactaacaataaaaggacaagataaagattc

SEQ ID NO: 211270 - DNA, 434 bp, Homo sapiens
ccactacaggcgtgagcactgtgcccggcttgagacacttcattgtcacaacttgagtaaagggttctcggtccacatttaaagtgatattgctttggcagtgtgttgagagccagatgttgggaggtgataaagctgatttccatctggctataatcttggctttgcactaggaggataaacattacatctgtatccgtatttaaaattttgaatgctgcagaagaatggaacatgtataaatgtagttataagtcaatttctaatttctcctgacgatgaatatctctagcagaaagctgtggtttctttaaggttaaatgaaacctttacttttcagtgtttttctgtttttccttgtgaaaaaaaaatcactgtagtaacttcagtagtatttcatagtattttgtagtattcattaggagaaaactcat

SEQ ID NO: 211271 - DNA, 605 bp, Homo sapiens
tacatctgacctcttttaatattacttcctgaccccagaattcttttggcatataatcaatgcagtgatcaattcacatgtgactatagatacaaacagaatgacgaaagtttaatggaggatgaaaaagaagacaaataaatattttatcctttatatggtaagacagattcactatcatactgatgtcagtagcccatgaattaatttacagattctacctaacaaaattctaataaattttgtaaggttttaacatgtatgtgtgaacatacatattcatgctgttacacatataaagaaaattataacaaaagtgacctataccatcagtggtttaacagttttggaaaaatttatcgtgctctatacaacaattcattccatatgtgaaagttactttcaagtgctttatctaaatgtggaacaaacagtgattagaggagtctgtgacacactctaatcatggaatgagactggccttcctaaacatgagattcagaagcctccccacctcctgtcaacaagtcatagatttgactgtataagaactttataaagcttttatatgatcaaagatagtaaaagatacaatattttttaaa

SEQ ID NO: 211272 - DNA, 895 bp, Homo sapiens
  misc_feature (753)..(753): n is a, c, g, or t
aagagttaataactgtcagaaaaaagaatgcaaatcttgactatcagttgcttgacagtataggttattttaaaagtattattaatattaactttccacacctttttataaacacagatatgttcttctaagctcaccaaagataacgccttgtccattatgctttatctgtattccaattaacatcaatctcttcctgaaggcaatcaacacttccaactttcacggagcacctgtcaagttcaggcgcacagggttggggaatgtaacacaaagacaaggccttaagccctcagagtttacattccagagagggcaagaaacatgtaaatgcagaattttacaaaggtgatgtgtattctgatagaattatgcacaaaagggcagagaacactctcttaccccaggcttggcagatcaaagaatttctggaagttaacacctgagctgaatttgaaggaaaaggcgtcaccccctagctgaaagaagagaagtcagaaaaggcacggaacaagtgtctgggtagaacgtaaaatctacataggcaaggaggagacgcctctgcggcagggagctgtgccacattcacagggagcacagagttgaggctctgggtcagtttcccaaacttgaatcattaggatcagctggagattctactcagtagttctggggtaggagccagcaatctatttgaacaagcctaggaaatacggcatgggaaactggtgcacggaagaaccgggttaagcngaactgtgggtcaacctattccaacaatggatccatcactattgggccaaagtggatgaaatgcaaacggcaaaccctggactaaagggagcccaaagtgccacaaggcccctgccactacccgaaccaggggaaggcgacc

SEQ ID NO: 211273 - DNA, 585 bp, Homo sapiens
ttttccctaaacagtataaaagaagcctgtattgttttgaatttgaacgtcggttctgcactactgctgaaagatgtactgcagtcagcttcagggcagcttcctgccacagcagcattaaatgaagttggaatttacaaactggctcaacaagatgttgagattctacttaatttgaggacaaattggcctaatactggaaaataatgtctttcagaaaaaggtttctttggtttttgtttctaagaaagaggaagccaattggatttcaagttatatgatgaaattctgaattaatgaaactggaaaactttatagaattacttattatcttggatttatggtgttattaaaatgctgaccatatttccttcatcctcttgttcctaaggaaacaaaaacagaaaacgaaacaatgaaaactcaattctatttacaagtataaatgctgagtatgtctgttgaagacaagagcagagatattaaattataaccaactttcaatttcctgtgctaattaagggaaattctgttgtggataatcaaacatagccaataaatttttttaaaactcccaaaaaagca

SEQ ID NO: 211274 - DNA, 432 bp, Homo sapiens
ctgtctcaaaaaagaaaagaaaagaaatactgctgacttttgaatgttgattttgtatcttgaaactttactgcagtcattacagttcaggagacttttggtggagttttagggttttctaggtatagaatgatagcatcagcgaagagagattgaagggggccagccccttcacacctgtgggtatttctcgtcaggtgggacgagggactgagaaaagaaataagacacagagacaaactacagagaaagaacagtgggctaaggggaccggcgctcagcatacggaggacccacagcggcaccagcctctgagttccctcagtatttattgatcattatttttactattttagcgaggggagtgtagcagggcaacaggtggggagatggtcagcagggaaacgtaagcaaaggaatctgtatcacgaa

SEQ ID NO: 211275 - DNA, 355 bp, Homo sapiens
aggggaatcctgcttttgctccctacctaccaccatatctggcagttaaataggtcctcaataagtattatttaaaaagaaaaatgagctgtgcaaggatgctgatacaacccctggcatatacgaggtaccccactgattctctctgccccaccctcaggtaatgcctgttatgtacatggtaccctaagcttctggggctaaaattggctcaatttttaacatttgggaaacaagtgattaggttgtgttttctaataagctatctacctcccagaataaggatttttgttttgcccactgacatacatgtagccgaactggtgtccaggccactcgtcgcctgaaagccaaa

SEQ ID NO: 211276 - DNA, 604 bp, Homo sapiens
ctctctctaaagtagcaccaaggggaatggtgggaaaggatgcaactgttgccctgatatcaaccacagtgttaggatatcctcaaacagccttagtacctggtatacatctcttatccctgaaataagttaaagcatttctgcagctgttttagctgtagtctgcatatatttgggagaatgattccatttagtgcctcttttatttcaggccttcatttcaaggcttgtagaccttgttgtatggtgccagcaatgtagtgaagacaactgtggtcactttacccacacctttcatttaaactgcagatttaggcagggtgcagtggctcacacctataataccagcactttgggaggctgaggtaggtggatcacctgaggtcaggagtttgagaccagcctggccaacatgttaaaaccctgtctctactaaaaatacaaaaattagccaggtgtggctacttgggattacacacctgtaatcccagctacttgggaggccaaggcaggagaatcggttgaacccgggagatggaggttgcagtgaccaagattgcaccactgcactccagcctgggcgacagaatgagattccatctca

SEQ ID NO: 211277 - DNA, 555 bp, Homo sapiens
agaagatattatatgaaggtacccacctcgatcctgaaagaaaacacaacggcggcagcagcaattgaacaatcttgagcatagaaaagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcagccttattactatcccattaaaaaacagcaaatacttactgagttcttgtaagagctaatgtcattgtaagatttaaaactaagggcttttatccctttgcaaattattttttaaatgcattcatcatttgaaa

SEQ ID NO: 211278 - DNA, 476 bp, Homo sapiens
tgtcatgtgtcttagtcccctttaatctggaacagtttcttggtctttgtttttaaattgactttttaaaaagaatactggccagggttgggcttagctgatgcttcttcatgagtagattcaggttgtatgtttttggtaggttatatatagtacctaagtgatgatgtatccttttcagtacatcacatcattaggtgattgatgctaattttaaccagttggttaaggttgtgtctgcccactttctccacctaaaagttattattttttcttctgtgattattaagtaatttgtggtacaatcttttgagactatgcaattatcctcctcatcaaactttcacccagtaggttttagcatccattgatgattcttgactgattcagttattactgtgatgccaaatggtgatttttctaactccatcactccttggaaatttattaattggcattcttctgcaaaaaaaaaa

SEQ ID NO: 211279 - DNA, 421 bp, Homo sapiens
gccaagtcatgggcttgtttgctttcagtcactgccttcagaaaaagacaattttacaatgacttacttctaataatcactgaaacagcctcatgaggacatgcaaaactgctgtctatcttcagacctggcccattgtcaaatggcagacttgcagagcaaataagggacctggcctagttcacaaggcagtcagaagtgatccaaagttcaggctccccctcccttttatcactccaccctgcctctactcctccgcctcctattcttccggcctttccatctggaaaccatgagcctcatggattccaggcacaaattctcagatttcagatgtttgggaaatttctcagcttgggtcattcttcaagagtaagaaattgaatttgtgagaaaaaaaaacagctgagactgtttcaca

SEQ ID NO: 211280 - DNA, 914 bp, Homo sapiens
ctcagctcaccacaacctccgcttcccaggttcaaggtggaaaaaactcaaaacttaaatttcctgttgaatgcaatttgaaaatatagccaatgattccacttttcttctctagtaaggttggacattctgatctacttggtgttttattatagaactcctagtgtgcctgagtcttacattgtgaagatacttttctgaaactttacatgtaagagaatatatatgatattggatgagatcaggctggatgagaactgatacctgtagatatactttttagacaaaatctccgattgccactcgttttcttatttaactcataaaaataaaacacattggatggagggtaggagtaggaaggatatttatatgttttaattgcaagtcattgtttcatatcaatacagaacatatggtatccctggctttggacctacagaaggaaacacatttttctacctggcgtatgccagaggttcttgaacacctggagggattactgcagccctggggtggtgagagccccatccagctggggccatggcctagggatcatgccgggtatggggaggctccagccaagagccgaaaaatttgagtccttgttcttctcctgccatagaatcctctagagactgctaaaaatctacaaattgaggccctgccatggacctggggaatcagaatctgaaggttagggcttaaaattttttttcataaagcatcatggatgaaaaccattattttatagattacatttatatggctagctcatgagtctgtttatttccttctgaggttcaagccaacactttcactatttcctggtaatagagttgtgatcttttttttttctttttttgaggtgaggtctcgctctgtgacccaggctggagtgcggtggtgctatc

SEQ ID NO: 211281 - DNA, 383 bp, Homo sapiens
tttagtaaaagtctgccgtggagacacgaaggtgctgagaatgaagagagagggctgtgtctgtaatggaagccgcgtggaaaggaggatgggcggcagccttcgagggtgtgtgctgggcagggagtaaagcgacaggcaagcccgcagatggggaactccctgggaagccccctgtatccttcgggacagacattgtatgagttcccacagaatcagagagggtgactggagccactgaatttggagtgaaagaaaaaggtgagagtaggaggaacgtgcgttttcagtcgtggcaggctagataatttcaaccacatttcccactggataagacctttttgtttttttaaattaagccaacaaagcaaaaagaaaaaaaa

SEQ ID NO: 211282 - DNA, 971 bp, Homo sapiens
ccatcttctcgtatgttctcattacttggcttaagaattctggctgttgatgactatagtatggcatatcatacattttaagctcagtcagcttttaaatatcaccagtcctgtctgcattgttccattatgagacacatagctgtggtttgagaactcaggctttgaagctagcctgcctgggctcgaataccaggttggtgacttactatgtgtatagcattggggaagttactctctgtgccttagttttctcatctgtaaaatggtgataataacaaatagcttctattttatagacttattgaaagattaaaataattaatgtattacctgggcatggtggtgcatgcctataatcccagctactcaggaggctgaggcataaaaattgctaaacctgggaggtggaggttgcagtgagctgagatcatgccactgcgcttcagcctgggtaacagagcgagactgtctcaattaaagaaaagaagaagaaaaagaaatatgctattaatagtatcaactcacagttggagctcctgagagtgtttgtgactatgatgagttctgtatatttgctgagtaacagggcatgattgacatttaatgttatattgctcaggagcttgaaaatatcttgtcttgaggacctgtagggaaagttcttgtgtagcgtgttggatttaaagctaaaggttatcaaggctacaggcccaacttttaaaatctctcttaggaaccacttgttatttgggccgtaatcttaatagttttaatggtttgctatttgggaaaacttaagtggagctagttagtgaattgactttcattcaagaccagatttctttcctttttatctttggtgtaagatatttatttattttatttttctttaacaaacacttatattatcctgtctgatggagttttgaaggggtaaataaatttggagaaataaaacattaataaaa

SEQ ID NO: 211283 - DNA, 747 bp, Homo sapiens
tggagtagaaaaaaactatatgtttaaatgtggggacagcaagggttaaaggcatttttatttgttgcttgaaatctgtggagcctacagaaaacagtggttggtatcctgttgatggaagaactaaaggaatgctgcattctcagcatttcttatttcctgtagaatacagcaactgcagtttttatttgacattctgctagtttccaggaagggctcaatgaagtgactgctgtcagcatcttttttcaccgcgactgatactagagaaggtagaggatgtttaggagcttttaaaggaaattatgtttagtgaaatacttgggttaggaagttaaccaaatctttaagtactgacttaaaaatgcttgtattgagagatgaatggtatcagaatgacatacaagtatcagcaggtctctcagattgttgacctattaactctacagtggtaacacttctaaagtccttggtaagatacaagattcatttgcagaaaatagctccatctgaaaaacagtagctcatacatacttcctttacattttccctattcagatgaaacaaggaggatctggaaaatgtgaagccaagcaataattgtgaaacataagtccttagtaatgctgtcataaaccagttttcatgtagtttgattttcagctgataaagctggtaaatgagttatactacaaatctatgattcattaggaagcaaactccttaggtatacttacagagaagcca

SEQ ID NO: 211284 - DNA, 1458 bp, Homo sapiens
  misc_feature (1366)..(1366): n is a, c, g, or t
  misc_feature (1457)..(1457): n is a, c, g, or t
gagaaaagaaatggattaaagaattaaaaggttgtaggctgtgaaataggtataacaggactggcatgggataggaaaaaggaacaaagactatggtcagaaaaatgttatttatttattattttattttttattcttgagacagggtctcactttgttgccaggctggagcacagtggcacaatcatgctgcagtgagccatgaactcctgggctcaggggatcctcctaccccagcctccctagtagctgagactacaggtgtaaaacaccatgcccaactaatttttaaaaattttttgtggagacagggtcttgctttgctggaccagatgtttgaggcccaggatggcctcaaactcctcgctccaagtgatcatcctgcctcaacctcccaaagtgctggaattacaggcatgagccactgggctggttggagaaattttagacttcaagaattcaaaggcagagcagttctcagctgatatggtttggctctgtgtctccacccaaatctcatcttgtaagctcccataattcccatgtgttatggggggaacccagtgagagatgactgaattatggaggcaggtcttttcctgtgctgttctcttgatagtgaatgggtgtcacgtgatctgatggttttagaaatgggagttgccctacacaagctccctttttgcctgctgccatccacgtaagatgtgacttgctctcccttgccttctgccatgattgtgaggcctccccagccatgtggagcccaagtccaacaaacctctttcttttgtaaattgcccagtgtcaagtatatctttaccagcaccctgaaaatggactaatacatcagtagagaccaggtccaggccagtgctcgtaacaaaaatataaaaaatacaatacaaaccacacaagtaagtaatttaaaattttctaggtcaccagattagaaaaacttaaaactggtgaaattaattttgtgttttacacttacaaaacatctcaatttgcagaaactatgtttcaagtgctcaaaagccacagtggctctaatagcgaccacattggacagtgcagatctagactgtgtccatatagattgctgaatatgtgtctatatacagttgctattgggaggcaaagaatgggaagaaaaaaggatcagccgggtgtggtggctcatgcctgtaatcccagcaatttgggaggctgaagtgggtggatcacttgaggtcaggagttcaagatcagcctggccaacatggtgaaactccacccctactaaaaatacaaaaattagccaggcagcgtggcacatgcctgtaatcccagctatttgggtggctgaggcaggagaatcacntgaacccaggaggtgtgggccgcagtgagccaagatcacaccactgcactccagcctgtgcagcagagtgagactgtctcaaaaaaaaaana

SEQ ID NO: 211285 - DNA, 606 bp, Homo sapiens
ataagctgctggagaagatgcttacaaaacactgaaatgcccaaaatataaataacaaatgaaagaaggacaacaaatactggaaaacttagaaactccaatcagtgctgaaacaggagctgctaacacatggcgtctctcaaattctgggggtgaaggagtgactggcatggcactgaatggatggcaggtgtgagggcccaggagggtgacacgcagcacacaaaaaagaaacagcacttacacttgaggatctcgagtaactttaccctactgagaaaacacaggctttggaaggggccacaccggtttacagggcatggctcatcagtaacacacgcagacaaaaggacaaaggccaggaaaattcagactggtagaatgatttaatgtatgcatctacacaatgcccataaggaattcagtaatgtccacctgaggcctgccagcctgattgcctctcaccctcacctcttctcagaaatgtgtggctggtcttctggcacccccagtttccccaagagagtgcacggtgacaggagatttcatgttggtcacggcagcaagtatagaggaccacatcctagggagtcccaggcaagcccc

SEQ ID NO: 211286 - DNA, 177 bp, Homo sapiens
cgaagacatactacttttggttgggattctttatggaaagccctaaaatattttgtatgcactatatcagcaatgtttacaggctgcactgtgaaacaggtgtgttggaggcagacagactttgaaatttctgtgtatggacttaatttaagtcagacagggagggtaaagagagca

SEQ ID NO: 211287 - DNA, 553 bp, Homo sapiens
ataaaaggactttggcaaatttatgtgcacataaatatattctgttgtcaaagggttcatgtctcaaactctcaaactgagcaagttcatactagtctttcctttaactccagtggcctttgtaggctgaatgactttttgaaaggaattctgtctcatgttgtctaattgttccttcttcagccagtgtttgtgtgctaaatgcaaggtcctgtgctgggtattctgataaaaaaacaaaggtggaaccatctgagtgctttccttgttcaccactttaattgtaggaaactaatatcttttaatgagagtcttcaataaaagatgctctacaaagttgtattgtggatgctgtcttattatctcaattctaggcagtagaatttagctcaattttttacatacaaatgaggaaccaattttcagtaaggttaagtaaacttgttttgtttttcgacatgacctagccctcccctcccactctgaaaaatgcagatatagaccctaggtaggctttctgaaaccaaaactatactgtttctgtagctgcttc

SEQ ID NO: 211288 - DNA, 484 bp, Homo sapiens
agggatcttgaagaatgactatggactataataaacttaactaggtggttacattaactgtagtggcagcccctggaacttgatatgcagctactgacctcactaactcctttttctccaattaacaagaaccactcaaagcaagttgttacctgaaatgacagaagtataccttcgtactcaactaagtatgaatgctttagcactatgctagttctcctgtctctgccataaggtagttgtattggttatctaatatctcacaatttctgtggattcaggaatctgaacacagctcagttgaatcctctatttagggtctcattaggctgcaatcaaggcacttaccgtgctgcattctaatctggatgctcaactgggaagaagcgatttctaagctcacttaggttgatttccttgtggttgtataactgaagcccttgacgtcctgctggctaatggctagagacaaacctcagggcca

SEQ ID NO: 211289 - DNA, 345 bp, Homo sapiens
ctgtaccctagcacccttcctggtacctacaaccttcgtactcaactaagtatgaatgctttagcactatgctagttctcctgtctctgccataaggtagttgtattggttatctaatatctcacaatttctgtggattcaggaatctgaacacagctcagttgaatcctctatttagggtctcattaggctgcaatcaaggcacttaccgtgctgcattctaatctggatgctcaactgggaagaagcgatttctaagctcacttaggttgatttccttgtggttgtataactgaagcccttgacgtcctgctggctaatggctagagacaaacctcagggcca

SEQ ID NO: 211290 - DNA, 192 bp, Homo sapiens
acaatctaccattggcctggctaatcccagggccacatctaaccattaaaggtgtatactcatctcctcagtgaaaatgaaacagaccactatcacctgaatatcctattttcaaaagtttattacaccaagtaagttacgagaaactatgacacttgaaacaagctgaaatgtgcaaatgagccacgctag

SEQ ID NO: 211291 - DNA, 481 bp, Homo sapiens
aagtcacagctccacagggtagagctgagcaagctgtcctcccagctcgtggtcccccagcaaggcagcagtaagactcacagcagagaaaactctgcccatgtttaaacagtgtgtgtctgagcagtaggctaataacttctccgtggcatgcctgttcaaacacaatcaaccacagatcttctgttttccttttgcttctaatcgtacctgtattctctctgtattttaatcttgtttaatttcctcagtatatccctacagatgtagtattggggatataaagacatgagctagtggagcgggagggggtctgatagggtttggctgtgtccccacccaaatcttatcttgaattcccgtgtgttgtgagagggacctggtgggaggtgattgaatcacggggtcaggtctttcccgtgctgttttcatgacagtgaataagtctcatgagatctgatagttttaaaaatgggagttt

SEQ ID NO: 211292 - DNA, 545 bp, Homo sapiens
ctgaagaggagttaatgggaatgcaagcagggtgaaaaaataggacgatggtgtctgtctaccgctttgatgcagacagctccttaattcataaaggcagcttatacgagggcagttgaaacaaaagggctatccagtgtgagctgctgagcaggctctgatggatgtctctgacagggtagtcccatcatgagattgtctctgccagtcagagtcattctgtggcctcttatttatttcatgtagtcaatagctcctaaaactgtgttcctggtttctatccccactgccaccatcacatttcagccctcatttggctaatgttacttaaatattctaggttttctactggttcatgggtgtccagggaacctttctattgttacttatctgatttctcacagctaaaatcactttcctaagcaccgctctcatcatgtcaccattctaccccaaatcatcaattctctactagtctcccaaattagaacaaaactctttgtctgtgcaggcactgcccagacagcacagcctcagtctcccag

SEQ ID NO: 211293 - DNA, 303 bp, Homo sapiens
tcagaatacagttctcattttcctcagctttactgtttagggaagccgaaatgattatgtataaactgtctcatataaacgtgaaattgtttcatcttgactttaaaaaaaaaaaaaagttttcctttaaaaaaaaaagttttcttggtgtgttcaaaaagttcattatacacacccatgtatgtataataatttagtatagataaagatactatttcaattcataagaaaatattctgtaagtggtatgatatgactttttttaaagggagagaagtaggatgacaaagggaggagggagag

SEQ ID NO: 211294 - DNA, 387 bp, Homo sapiens
agcattttagaaacacttccttttgaaggtggaaatatttatatgttagcacttaggctccttatcccatgactaagtgacgcacgggaaaaagagaaaccgaggccgggtgcagtggctcacgcctgtaatcccagcactttgggaggccgagccagatggatcacttgaggtcaggagtttgaaaccagcctggccaacatggtgaaaccccgtctccactaaaaatacaaaaagttagccaggtgtggtggcaggtgcctgtaatcccagctactcgggaggctgaggaaggagaatcgcttgaacccgggaggtggaggttgtagtgagtggagattgcaccattgcactccagcctgagctacagagcgagactccacttca

SEQ ID NO: 211295 - DNA, 254 bp, Homo sapiens
ggcgctttcctctgcatgtcactggttgggggcgggagttcaattccagagtatgaaataggaggcctgtggcattattctttcctgtgttccagaaggcagatttcctcatcccgccaacccctttaaaaggcttcaaagtggggtgattctttaccctgtacacattatactgtggtggtcattagagctgtttgccaaatacttccagtggtacaagagcactttcctggtccccttgtgattgggtgggg

SEQ ID NO: 211296 - DNA, 317 bp, Homo sapiens
ccagtcaggaatgttggccataatccaatgaaaggggaaaataaacagaattctctcaaagtcaagtgtttctgggttatattaaaaaatttttaactttaaatggtaaaaaaaaaaaaaaagtaacagttttaacaaaactttcaattaatttaagttagccatcttagaaaagtagaaatctacttgttttttttgtttgtttgttttgttttttttgagacagtcttactctgtctcaaaaaagaaaaaaagaaagaaagaaagaaaagaaagaaagaaagaaagaaagaaagaaagaaagaaagaaagaaaga

SEQ ID NO: 211297 - DNA, 267 bp, Homo sapiens
caatgctcttagtggtggtcgcctgtcttcagcatccaaagtatcagacagtgtgtgtagttttccgacttgagtagtattttcttttctttgtacagttgtgcatgtgtgacttggaaggagcatatttgactagatgacacatgggcttctctggagttcctgctctgatcgtaatagtgtattatttttctgaggctgtgtctgtattgtgctagaaagcaaatgagttattatggatcattccaagtgtattatcccatgtat

SEQ ID NO: 211298 - DNA, 353 bp, Homo sapiens
gagtcctctagttcagcctgccacatgcttatgaaggtttatgaaggtttaatgagcaaatacttgtgaaagtgccttgaagactgtccagcagcatacaggtgtaaggtagttgcattgtttgaggagtttcacatatatcagacaagactgtcaattacaggggtaggcactgggttggactgaagttggttttcctctttttgtagtaactgattatcttttcatcagaagactgtaggggccaatccttttgtagttcataaacataatggttgggtgttacgtgcgtgtgtgaaatgtgccaccctccagccttgttacgatgttgacacattacccatctgacatgg

SEQ ID NO: 211299 - DNA, 287 bp, Homo sapiens
aaagctacctcatatcagccagcctttcctgtcccctgccaatagagcatgtcgttgggtgtgccattttaattattcacttacttggttgtacttccagatttgaaatagctttgggtttgccttggacccagagggattgggaggactttccgtggatcatgaattgtggtgggggccccggggatggagttgttgaagaggaggtgtgggtctggcggcataccatgggtggagcgccctcgcggcactgaccaacaagtggcttcagaggatctcaacccaga

SEQ ID NO: 211300 - DNA, 289 bp, Homo sapiens
gagttcctctgatttgaatcatgaatgatagtgaagcatttttctatacttttgtcttttaacacttacagtatcactataacatatttatctcctattttacagatacagaagttgacacataaaaagtgaagggtaattcaaaccaacattatcatatctgctaaaacttctaagtgtccaattcttgattgtgaaaatcatgtatttgcaccagtccatagactcaccaaaatggcccctccactgataaacaaaaaaataaataaaaagtgcaggtaggcggtgt

SEQ ID NO: 211301 - DNA, 739 bp, Homo sapiens
agctgggggtggggcgtggcggagtggccacgtgggccgcgcggagaacgcgccaggctcatcacctggagcatcgtgcctcagtttccccctcggcaaatggggcttcagcggctcgcgacgcacattgatggagcgtatgtccaggcgccggtgcaccgcaaggagcaaaacagacacagttcttggtcctagggctcacgtcccggggcgaagaggatcctccataaacgatcagccatagcagctgtgattggacaagagactgatttcagtgactttctcctgataagagaccaccgaccagctgaccatgccgaccagctgacccgttaatagagagagatgatgcacctgcatgcctttgtgtcctgaaaagacgttttgccataaaggccctaattgtaagatgtgtaaatgttaagtctccaccccaaagtgaacatgggtcatatattacatgctttgctcaataagagggcatgtgtcaggaccaccttcatgaatattcatagctcctcctgttacctgttgaatatgtatgtttagccaatcccttcagcatagcgctcctgccccaacccctcctccttggacgtgcctgtctctggccttggctggagacagattcccagcctcagacagatggccgccaccttgcaggctacgaccgtttacaagaaataaagccttctctttttcccaaaaaaaacacaacgaacatttctccagcggcgtg

SEQ ID NO: 211302 - DNA, 479 bp, Homo sapiens
acaagaaataaagccttctctttttccaaatttgtgaattgtgtgtttttaaactaacatgaatgacagaaggaaggatggcctcttcaagcaacgatgatgaggcagttatttatatgggggaaaaatggattctaccgtgggtggactaaagaggaaatgtgaaaaaataaaaagtgagaaaccgctggtagtgaatcggtgcaagcgccctggagaagagacttggcaatatttagtaaagtcaaacagcacgaaccctactactctgcaaagctgctgcaggaactggcggaacgaggtcacgaaggaaaccttgccggaaaggaaattgcagcagtgcctgtgtgcgtgcgtctgttggcaaaacgctgctaataacgtcaatgcccatccgctattgaataaacctgctttactgccactatggaataccaaactgcagaaaaataattaaaagaacgtatctcatattacag

SEQ ID NO: 211303 - DNA, 204 bp, Homo sapiens
catacctgccgccagccccttgtgcccacagcacctgctcctcctctctcagccctcttcttacttgattgtgatgcattgtgttactgccatccagactgcccatttcgagttcccgtgtgcagcctgcctggacggaggccttagcctctgcctgagtcccggttgcatgggaagtcctctgggtctcagtttggatgtttg

SEQ ID NO: 211304 - DNA, 430 bp, Homo sapiens
ttgtaagtgagaaataaatatgacttgggacaggctaggaaaccttctttaggagctaggaagtaagctgaactttaaaggtgatatatagacatgaagaaagaagccaggtaagaattatagaaacggaaataggcaacatcaaggtatacagaggcataaatatcttgcctttgcctctcctcggtcttgtgaaaatgttttccagaactttggtactttgtaactgtggttgttcaactagataaatacaacttggacctaaagataggcagttggtcgtggataaagcctttacgaaagtactttctttttagagaatccttgtaatatttctctaggtattttatactaaggaacaacaacaacgaaatatgttcagactgtagtgcaaaaaaatataaaagacctttcatttccctggtgtcac

SEQ ID NO: 211305 - DNA, 535 bp, Homo sapiens
ttaatatcaggcaaaagggaaattaacacaaggcatattgcttggaatatagagggacattacatatagtcaaaagggtcagtttatcaagaagacatagcaatcttgaaagcttttgcacctaataacaacagagcttcaaaatatgtaaagcataaaccaaaataagtgaaaggagaaatagacaaatttacagttacaagtggagactttcagattcctctatcagtcattattagaacaaatagacagaaaatcagtaaggacatagaagacttgaacaatcaacgtgacctggtcggtacttattgaaacttcaccctggaagtgctcacagaatacacagcaagaaagaccatatttggacccataaaacaaatctcaacaattttcaagtaaaagaaatcatataaaatatgttctctgatcacaacagcacttcctcaaggaatcagtgaaaaaagatgtctgcaaaatttccaaatttttggatattcaacacacttgtaagccctacaggtcaaagaaaaacatc

SEQ ID NO: 211306 - DNA, 364 bp, Homo sapiens
aaaatacttatttttgtgatttttttttctgaaagtggcacagtatgttctaagagtataataggccagctccagagcattaaagcaatgttgaaatgaagcatattggtgtgaatgatgcatagtaggctatttatgaaaaattacttcaataaaaaacttcatgaacatgtaaacatgattttatgtataaacacactataagatttatgaaagataatcatactaatatgagaatatgaagctgaagcaaggtattttttaaaaattacattgttgaacaaaatggtctgaatatttctgcttttaggtaaggatctatgctttgcagctgcctccttcagtttgtttttatgacttaagc

SEQ ID NO: 211307 - DNA, 457 bp, Homo sapiens
tgcctgcttgctcatttacgtaattactttcttaattatagttatcacaaaacaattgcttaattttctgttaactcattttttgtccccactagaatgtaagttccatgagggctggcacctatccccaatgtctagcaaattgccttgtgcagagatgttatttatttaatttacctgttggataaataaatgcatgagtgaataagtgaatgaataaataagtctatctatcttctcttcaaactcccttgaaatctgcacttccaatgctctttccaacccattctggcttctagctcactgctccactgaaattgttctttcaatgtttcccagtgactcctttgttaccaaacccagtggccttgccatttctgtggtgtttgataaaccttccttgaaattttctctgttactggtttctgagacaatacagtgacatggttcttctctc

SEQ ID NO: 211308 - DNA, 373 bp, Homo sapiens
gtggctccaaagaggccacagaagagagctatgtctataccacacacttattctactttaaacggcaatgggagcaataagcacctaccaagaaaaggcagaggacagattcatactcacctgcccaccaggctgttgtattttagagatgatagaaacataagaggaaaaccatggggcccgtgttcttgagggtcttgcagtcgggttaagagcaaggcagtttggagtcagacgggctgcgcctgcatccctgccctcatcacggccagctctttgatcctaaactacacaacctcttccgagactacacgggcccacgatcccttatctccaattccaaagtgaaaacccggaatccctcaagtgtctt

SEQ ID NO: 211309 - DNA, 522 bp, Homo sapiens
ctgttgattgtgttaacacattttaatactgtcaagtagtaactaatactgtatctaaaataattagtaatttaaaagatacctaaaaacttaatggaataaaattagaatgctaataaatgtaaagtccacattaatatttcaggggagacgtataacctctcacacaaagtaactcgtatatagcaaaaatagaggacattaggaaaaaaagtaatgctatcagtggtgctattttcttgctatagttaatggtgtattaacacttcaattataaatgtatactctgaagggtttatcatctacttaattttacatgcatttcctttactaaaacttagattaggtaatagtgaagaacaaactcgaaataaatttctaaatctgaatagcattaaatgtatttcttgttaaaagaggtttactggttttggatgcttttttgcactcagaacagatagaaatggcactgtttttaagaagcattgttactttgcttttgaaggcaataaatgtaaaagt

SEQ ID NO: 211310 - DNA, 497 bp, Homo sapiens
cagggattcagtttaaccttttcttcccccaggctatttgcttcatttctttaacattatattttcagattaatttggacttatacaagtatcacagagataggaagttcctgtttacccttcacccatcttcctgtaatggaacagcacacacaatcatggtgcaatgaacaaaactaagaagttaactttggtacaatacagtagttgaactacaggcctcatttggctttccttcgtttccccactgatatccttttttcattccagaatcacacattgcatttagttgttgtgtctgcttctccttgaagctatgacggttcttcagtcttttcttatctttaatgaccttgacagtttgaagaataccagtcagttatcttgtagaatgtcccacagtttgggtttgtctgatgattagattgatgttatgcacagaagtcatgttttgtcctcagtacatcatttcagggggtacatgatgttgatatgtc

SEQ ID NO: 211311 - DNA, 446 bp, Homo sapiens
atagatagatagatagatagatagatagatgaagcgatgtctaagatatctggaaggatggatggatggatggatggatagttagatagatagatagatagatagatacatagatagacgattcagagatagataatgttccaaactcttgagggccaagaactggtgacatcttgtatcaacacatctaggtctacaatcttggtttctaaacaacattcattaaaaggacccaagggttgaagttagaaaatacaagttgagctagagtatcttgtaaagccacaaagaaaaaagtgcttaataaaaatgatggggacttttcaaagggagccaacctgaaagacctcccaatggtccaagctccaacaatatgagcaataagttatgatagctttggattatggcccacagaataaagtaatactcatctctactgtgtgaat

SEQ ID NO: 211312 - DNA, 283 bp, Homo sapiens
gacagagagactctgtctcaaaaaaaaaaaaaatcatacaatgactaaacatcttattttgtctcacactactcttcttgctgctgattaactgcttgaatttcattacaaaataatgcaaaacaatgaccagcctgtttgggaatttcagagcactagtatgtattgtaatataaaatcaatatattaatagagtcatcccttgttatcctcagaggattggttacaggaccccccaccccacccccaacagcaaaataaatggatgctcaagtctctgata

SEQ ID NO: 211313 - DNA, 186 bp, Homo sapiens
agcaatatgatttcatgtccctatttgtaacaaaacagagcccaaatgttaatattctactgaggccgtttaaacctctttgtaagctgtcaactccataaatcctcaaattccactctcccctactcctacctcccccagataattcagctggcaaagtttctgagaaatccctaaggttagcag

SEQ ID NO: 211314 - DNA, 1378 bp, Homo sapiens
gaagtttctttctgtctcttaagtgatgtgtgagtggatggacagattgccctcagctttaagggcagttcaggatgatctgtcttaagatcgatgctctgtggaatgagaaaaatgcgctctgcagggcatgcccactgcatgtgctgggaggctctcctacatccaatgggcagatgcgcagtctccacggaggcctcaggcctcggtgtgagccagggctgcttcaaacatgtcggctatctaaagtccagcatcttccggtgactctggaggaagaggtgggcccccgtgctggatagtgggaggttctacatcattacctggtcctgagagctgagctgtagcctcctggtggactggagaagttcccacctctgcactaggctctgttgctatggtgagctgcatgtctggaggcttaacagagacattgggcaaatctgaatgctgagtttgatggtgacctggaggtgaaacggtgacttcatgatgttctggaggctgagctggggtctcctgctgggctggagaagattcaacctccccagaaggctgagctggctgctcctgctcactgggggaaagttcaggctctacaggaggacctggaggctcagttggggcctcctcttggtttgcaggaggttccatctcttctggaggctgagctggggtctcctgccgagtctgagaagattcaacctccccagaagactcagaaggctgagctggctgctcctgctcactaatggaaagttcacgctctgtaggatgacatggaggctcggttggggcctactgttgggttgcagaaggttccacctcctctggaaactgaactggagcctcctgctgggcttgggaagattctttctcattggtaggctccgaagttatggtaacctccacatctgcaggtttaactgtaatgttgggcaagttataatgagcttgatcctcacctggaggttgaactgtcacctcatgatttggtagagtttgagctagactctccatagaggactctggaggcagagctggggcctcctgctgggttgaagaaggaggtgtggaagctgctctggggcttcttcctggagtgaagaggactggatatcttcaagggtctctggattttgagtttcaggctctagatggaattgagaaagtccaacttactcagggggccctggaggctcatctgagttcacccggagttctggaggcaggctgccaggatactgtgtatccatactcgaatattcatcctgcaaagtctgtttctaacgctgtggtttggataattgctgtggaattccaacaatatcagcaatgctccaatgctgagctagatctttcttcaggttcctgggtg

SEQ ID NO: 211315 - DNA, 275 bp, Homo sapiens
catggcatacaaacatgggctgcaatcatgaagtcacagagagacagagggatctcatctattagcattatccttaatgatggaagcctgcatgatttctcccctaagatcaggaataagacacggatatctgcaattgctacttcttttcagcctataatcgaggttccagccagaaaaattaggcaaggaagagaaatgagaaaacaaggtaatctcagccaggcgtggtggctcacacctgtaatcccagcactttgggaggcccaggctgg

SEQ ID NO: 211316 - DNA, 301 bp, Homo sapiens
ccttcatctccacagagatctgttgcaggtatcttgaagggagagaaaattacttacttgtatttcttgttctctgcagatatacaaacccagtagatcatcacttgcctgccctctgtcctccctgagttgaggataattggcttgttattattagatactattatagttattattttcgtttcaaaaagacttgaaggcctacagttcagggccccagaaggaaaggcacattcagacagatgcatacctcctgctggtaggcaaagtcaatagctgagaaacttaagcctttaatatc

SEQ ID NO: 211317 - DNA, 657 bp, Homo sapiens
aacttagcagcactgtctgcttggggcagaatgtaagctcctttaccaccttatagtatcttcaactcttcaatgtccttaataagcactttgtaagtatatgtcgaatgaatatgtggatgaaaacatagtactgaaaaggtaggttgggagcaaattgtagagaatcttaaatgccaaagtaaaggacttggcagcaggcagtttggggtttataagcaaggtttatttatgatctaaatgataagaataaaatgatagagttgtacaaggtggattagagtagggagagacgaataaccaagggagttactatagtccagaaggttagtaatgaaaatctaagagacaggaggatcgcttgagtccaagagttcaaggctggcctgggcaatctagcaagatccaggtgtggtgacgcatgactggagtcccagctactcctgaggctgaagtgggaggatcagttgaacccaggagttcaaagcttctgtgagttgtgattgtgccactgcactctaacctggttgacagagcaagaccctgtctcttttaaagagaagaagaaaaaaaaaaggcttgagagaaataaaattgaagaggttgattcaagagaggctctgaaggaaaaattgacaagatctacctacagcaggg

SEQ ID NO: 211318 - DNA, 598 bp, Homo sapiens
atgcatacacagtatttgcacatatcttgatagaatacttattatgtcacttagtcttatatgagagggtttttttctttgtaaactagcaatttaaacaaaagagtcttgtcttgaattatttcactcagaagctgcaatgtgcaaaagacattattagtcttgagggtaatccattgtgaatattttcaatttcatataggaatgggaaatatttacagctaaatggatatgctacctaatcctatgtatgaattataaacctagttctcctctaccaaaggaatgatatcagaatgacaactggttcttatatgtgtctatcatattttatatggtctagtctacttgctgctttactaatacataagttggttggttggttagaaatagagaagagtggtatttaaggactgaggagagacatgcactacaattttaatagcacttagagctattagtcgtaatacagggaaccgaatatatcagcaagaaatagacttggactaaaaatgatgagcatcacctaagtggaggctactttttcttgatttttatttttgaatgctactttcatagtaataagcaatagtaaaaa

SEQ ID NO: 211319 - DNA, 481 bp, Homo sapiens
agatcgcaccactgcactccagcctgggcaacaagattgacactgcatctcaaaaaaaaaaagaagaatgttctcccttgaaagtgggagctaaacattgatgaacacaaagaagggaacaatagacacttgggtctacttgaggggaaagggtgaggattgaaaaatacctattgggtactatgcttattacctgggtgataaaataataagtacaccaaacccccacaacatgcaaaatccacatgtgagtatttaaaaaataatgttggtaaagatacagagctactaaaattctcacacattggcggtaagagtgtacagtgatgaaaccgctttaggaaaaggtatggcagtttcctaagactttaatcatttaccacataacccagcaattccactcctgggggaaagagaattgaaaacatgttcacatagtcttgtgtacgaacatctatagcaaccttattttataatagct

SEQ ID NO: 211320 - DNA, 380 bp, Homo sapiens
ataaccccctttactcacacactttatccatctttctcttctccagagaatgtttctctccctagaacctctgctgagaatgctcttcccatggaattgtatgtccttggcttcttttgatactcaggtgtgagattagatctcaccttctaagagaagcctagtgcttttctcaattctttctatcattgaacttatcactacttggtgatttcttatttatttacttgtttgttttcgtttccctgcaactgtatcataagcttatgtgagctgaggccttgtcttcatgtccaatgttgcagcctagtgcctagaagagcccccctcttctagtgcagtgatgctcaatgactgttgaataaatgacagaaccaata

SEQ ID NO: 211321 - DNA, 791 bp, Homo sapiens
accaattatatagcgacactgtgatattggtggagggattgacagatggatcagtggaggagaatggagaacccagaaacagacccataaaaccaagcccaactgatatttcacaaaggtgcaaaagcaatacaacagaggaagaatagccttttcaacaaatagtgcgagagcaattagacatcctttggcaagaaaagcaaaaacaaacaaacaaacaaaaacaaaacaacaacaacaacaaaaaaaaaaccttgaactaaacctcatagcttttacaaaaattaagtcgaaaatgggcatcaggcttaaaaagatgtaaaaaaaatataaaaagcaagatcgttttcaaaaaaatcaatatattgtacttcatcaaaactaaaaacttttgctctctgaaagaccctacgaagaggatggaaagacaagctacagactgggagaatatatttgcaaactacatatctgataaaacactggtagtatttaaaatataaaaagaactctcaaaattcaataataaaaaatcaatttagaaaataggcaaaaggcatgagcagacatttcgctgaagtggaatagatggcacatgagatgctcaaccccgttaaccatcagggaaatgtaaattaatactacatggataatatgactatagatggttatgtagaattgggaacctgtggtagggtgagacaggataaaataaggaggaataaagagaaaatgaggatttataacaataatacaacatttctattgacataaatacaaagttatcaaggggg

SEQ ID NO: 211322 - DNA, 380 bp, Homo sapiens
tcacctttctaatttaattcttttcaaaacaaagacagcaaagccacattgtttactgagaatcttctagcaagtctttcttagctcagttttggcagaaaccacatatctagtttccacttgtgttcctggacttagacttgtaagtttcaattatgcatagtatgcatttcattaggtctctcaacccctgagataaggtgtgccaaaataataatttaacagtcacatccttcacaggtagagttagagtgtctggggaatcagcctcattccaactccagggagaatatgagactggtggtaacttttatttttttattaagatattcatatacgacttcaaactctttcaaattccttaaactgaagtttaagga

SEQ ID NO: 211323 - DNA, 303 bp, Homo sapiens
cagggcagaccatggatagggaaaaaggcccaggagggtgagaaacacaggtggccatgaactttttataatccagcatgaactggcccccatgggcagcctctgttattgccctgtgtctccaaaaggcaaaaccgagtccaaagtatgagtttgtaatgaatgtttgactgaaggttttacagagtgagtgaagttacatcaaacactacacattatagattactgaagctacttccattggatgccttggttttccttcccaattactttggccaccagccactcctggactacccttcc

SEQ ID NO: 211324 - DNA, 96 bp, Homo sapiens
tctctaatccattattcagtaactacttataaaatgcctgtggtatatttatcatgtgaaacacttgaaatgatagtaaaacaaaacgccaaaaat

SEQ ID NO: 211325 - DNA, 531 bp, Homo sapiens
cgagatcgtgccactgcactccagcctgggggatagagtgagactctgtctccaaaataaaaaagaaaatagataaattgtaccacttcaaaattagaaactttggtgcttcaaaggacactatcaagaaagtgaaaataaaatgcacagaatgggagaaaatgtctgcagatcctgtgtctagaatatgaaaactcttacagctcaataataaagcaacaactcagctacaaaatggcagaggatctgaacaggcatttctccaagaggcatacagttgtcagtaaacatatgaaatgatgctcagcgtcattagctatcagagaaatgaaatcaaaactacagtgagggccgggcgtggtggctcatgcctgtaatcccagcacttcaggaggccaagtgggggcggatcacttgaggtcaggagttcaagaccagcctggccaacatggtgaaacctcgtctctactaagaaatataaaaattagctgggcgtggtggtgcatacctgaagtcccgctacttgggagg

SEQ ID NO: 211326 - DNA, 455 bp, Homo sapiens
cagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagatgtactggttcatgaagatgtgcttatgggtttctactctaatccttgaagaatcgccacactgtcttccacaatggttgaactaatttacattcccaccaacagtgtaaaagcgttcctatttccccacagcctcaccaacatctattgtttcctgactttttaataatcaccattctgactggc

SEQ ID NO: 211327 - DNA, 416 bp, Homo sapiens
caaccaccactccccacccacctagctgcagcaggtggcccagcctggggcagctcccctgttccctcaggtgggcaacagcagggactggtgggagaatcccagtgacacatattagccaaacagaccaaaataacaccatgaaggctctgaaattaaattgccattggaatcacagcccacaaagtagaccaagacctacagactaaacctaaacaggaggactgcctgcaaaaataaaaaaattacataggcagatgttggaaccacctgactcatcacttataacagtcagtataaaaatgctcaacaagcaactacaaatcctatgtcaacaatcaaagaactgaaaacgtcagcaaagaaactgaagaagaatcaaatggaaattacagaaatataaaatacagtaacag

SEQ ID NO: 211328 - DNA, 572 bp, Homo sapiens
taggcctgtatatttctctctgtacttgcataatcatctatctttatgtccttgcattgcatgtgaattatctgctcacataaccatttccccatccagaatgggagcttcttaaacttcttgcttgggatggggttgggactagatctggttcatcttggtgtcccagcccccagttcagaactgaacatagaatgagtcggtaagtgttgattgaatgtcagcccaccccctacccaacacacacaaagatagataaggcctccatttacagagagaaaagcccaagaggagttttttgacctgtttaatgtcccagggtgagttagtatcaggacagggattagcatccagctctttgggagcttagactagttcttatgcacgaaggacagcattcatagagcagccagccaaagggacccactcaacacctgtgaaaagaagaggggggcagggaagaaaagaaacaaagggatcacttagcctgagccaaactgggcatattcattgtcaaatgctgttgtaacaaatcaccacatgggcgcggtgctcatgcctgtaatcccagc

SEQ ID NO: 211329 - DNA, 596 bp, Homo sapiens
gagtctgtgtggttgaaattttcacagggagcctggggtgtggtcagtactgcctaatcctgcgactggcacactttttctgtaaagggccagagggtcaatattttaggctttgctagccagatggtctctgctgaatattctttttgtattcttcaaccctttagtgacataaaaattattcttaactcagagttcttacaagcacagaacactcaccagatttagccccaaggcttagtttttgtttgtttgtttgttttgagaaggagtctcactctgtcgcccaggctggagttcagtggcgctatctcagctccctgcaacctccacctcctaggttcaagtgattctcctgcctcagccttccaagcaggtgggattacagatgtgcgctaccatgcctggataatttttgtatttttagtagagatggggtttcgccatgttggccaggctggtctcgaacttctgacctcaagtgatccacccgccttggcctcccaaagttctgggattacaggtgtgagccactgtacccagcaaaggctacagtttaaggacccctgatctagactaaaggtaccctagagttg

SEQ ID NO: 211330 - DNA, 674 bp, Homo sapiens
catagaatttgttagtatcaaaacatgaactaaaattaaggtttcttgattcctagcaccacccatttcaacaatagttgagagggtttttctagctcctttagtgtgcttgccttggtttttaaaaattacagtgattcaagtcagtctcccacatccctcctttttaaaaatggtgttttgcaggcctttaaaatttaattaatttattccacatgcaaccagaaaaatttgaaaatggcatatacatatgcttctaaaaactgtgtgactcctactacttttcagatctttagtgcttagcatggtgcctggcagtaaggttaggtattcaataaatacttgaagtgatctcttaagcctttgcactttggtaaagcatgcaaagtactggtttgcatagtagctgatgttgcatttttatgtgtctagaaagtttaatagcatatgaatgtcttagaaaaaaaatttcactggactttgagtgatctccaaagttgattatctttagcctgtttctgaggtagcttttactttctagagggtttggaagatacgcatctattttcatattatcttgtcacttgtacctataaaattctctccctgctttagtttgactttttagttatgcgttttctgtgggattctctttattatttatttgctatttt

SEQ ID NO: 211331 - DNA, 208 bp, Homo sapiens
atctacagtcttcaggatactcttcaaatacactgatccaaatgttttaaacaataaaaggaaaagctttattcttaggaatttctgccccatcgcacccccaaaattagccacgtataaccatgtagcactatggtcttcaatgtgttaaaaaaaatttaggccaagcgtgatggctcacgcctgtaatcccagcactttgggaagc

SEQ ID NO: 211332 - DNA, 446 bp, Homo sapiens
ttttctttctcggaaccacagaggacttactactcagtaccaacctaagtatatcacagcaatattcaggccctttgtgtagtagggagtaaacaattaaatatagattgagcatgccaggcagcagctggtgagcctaggcccaggaaagcctccaattggcctggtgcagtggctcacacctgtaatcccagtactttgggaggctgaggcaggtgagtcacctgagctcaggagtttgagaccagcctggacaacatggtaagaccccatctctactaaatatacaaaaattagctgggtgtggtggcacatgcctgtagtcacagctgctagggaggctgaggccgaagaatcgcttgaacctgggtggcggaggttgcagtgagccgaggttgcaccattgcactccaccctgggtgacaagagcaaaactccatctcaaa

SEQ ID NO: 211333 - DNA, 363 bp, Homo sapiens
gcagtaaggcggcatcagaggagcaatttaactcacaagaggtaacgcagatggagagtacaactgaaagataccttgtgtggaagggtacagaaggaacctcaagctggacgttgatttcttttatcagtaatacaaattcactactagctgcttcttggatttccccccttgagagctgcaacgtttcctaaatgaacagaggtctttagggaatgcctcaaaccacagctgaatggggagtggctttagaaatcgccggtggaacttgcctgttaccttcttacaattccccccgcccctgggcaacgcaaaagccgtcctaagtgcgataagagcatggagtgaagggagttatttctg

SEQ ID NO: 211334 - DNA, 426 bp, Homo sapiens
tagggaaaggagttgagtgatttattgagtgcttacttggtgccacggcatgtgctaggtgcttacctaaatcaactcattggatcctcacaacaaccctgtgaggtgggtttcataacccccactgtttaccgatgaggcatgcctatcagtggccattctgtgaacacagaagagagctgcgctggccacagagaagatagtccaatgatccttaaagttcaggcgtgtgggttggagccaaaggggcctgtcccctggatataacttgagagtagctctggagaggaattctagaagccagtatgccactgtctggcctgaaccagccccacagcacgcagcacaggtaacctgcactcaggaagccaaaagatagaagcatccatacaccccactgccccccatgaagcccaggagtaagag

SEQ ID NO: 211335 - DNA, 353 bp, Homo sapiens
acagagcgctctggcaaggcaggatctggctgcctctgcggggcccacaccttcctctggaagggctcgggacagagatttattaacgaatcgcttctgcttggtggtatgcggtctgggagttcaggctaagagttaatgagaggtgggtaacagtcagagggtctcagtcagaccattcaaccgcaactgcaaacccccattagtaatcaactttcccaccacaaatcacgattcatttttgctcggtggcaagtctcttagggaggcaggggaaaaggattctactaacattcctggtaatctacctgattatttccctttcaattaaaaataataatttatacctttat

SEQ ID NO: 211336 - DNA, 587 bp, Homo sapiens
tctgatacataaagatgtgcatctatatgtatgttcacaaacatacatacagtttgtagctccagctgctgagaaggcttgacacaatgatgcccagagaacaatgaactcacctagcattccaatcttggtgtctaaaacctagaatacttggtttctagatattcctttataaaaggaatcaggaatttttggagaaatgagtgcttccatggccgtgtgtgagaaaatataagatgaactaggaacatgttgaaagtggttccagaaagtaaggaagtgcttaaaaaattacatggtcaacttgaatggatacaaaagcaaacctgaaagagttcccaatggccaaagctgggatactctgggcagcagaataagtaatgacagtattggattataactcagaatagagaattatccatgagtttgtacagagcatctatatctatatcatctgtatcatctatatctgtatcttaaataaatacatacatggggaaaaaagatagctctcctttactgaagaatttcagttaacaaatgtaaatcaaaatagacttgcctcatcttttctcacacttaggatc

SEQ ID NO: 211337 - DNA, 686 bp, Homo sapiens
agacaaacagcaacttgaaagaaaatctgaaaactttgaaggcaaagaactatagagtttttccaatagatccagattgaggccaaaacctcactcatcccctaaaatccaggtcaaatgtcatttcctccaagatgccttcttggtaccttcccctaggaggggtgatcttcctttcaatcatgttttgtccctaaatctattatagcaccctccacagtacagtaattcttatgtttccccatttacttccattgccccaacagccaaattgtgaccttcttaaaagcacatccctgtaaacctagaacctaatacaaaccctagaactaggcagatgaacagtgtgaaaacgacagccaaatgaaggtgtccagtctttttgaagggttctaccttgctgttcataagagtctactttggcaaaacctgccattatctagacagtgaatcaagttcacctaggttttaagggaataaaagggaattgattgttctagtatttgcaaatcttaaatttcttataacttagaaaataccatcattttaaagcttccaaagatattttctccttgttacatacagaatttgagctaattcatggatgaatgaaaaacactttctgtatttttatcatcatttcatacatttagtgaaggttaatttctgaactatatgcttagctg

SEQ ID NO: 211338 - DNA, 610 bp, Homo sapiens
  misc_feature (535)..(535): n is a, c, g, or t
cttaatctttttttcttacttcaaaaaaaattggatagtgatttaaagtgttaatccaaattgcattaaaacttcaccatttacatgacctttgaatattttgtagaaaaataattttacagaagtgctttcaaaatgagaagttacttctctgttatgtaggattttggttattagtaaaatttaccttaatagttaattaataaaacattgtcctttacttgatattagccttttcaggctatgaaaagcctggataacatattatgaagtaggcctacatagtaatgagattagttgaattaacatacaagacctgacctaaatgacttttccaagtcactacttaaaagacatcacttttttttttttttgagacagagttttgctcttgttgcccaggctggagtgcagtgcgtgatctcggctcaccgcaaccttcgcctcccgggttcaagcaattctcctgcctcagcctccctgtaataccagccactcgggaggtgaaggcacaagaattggtttgaacctgggngcaaaagttgcagtgagcttagaatgcactgctgcactccaacatatgcgtcagaatggctctgtcttgggtttc

SEQ ID NO: 211339 - DNA, 334 bp, Homo sapiens
ctgctctgatgccccaaacttccctgcctgggaattggatctggggtaatgagtgacccagcaggcagagatgacagattcctgcctaatgtagcaatgctgggacaacctggagtatctggtgtggcgggcaggcacaggcaggatgggagaggcagcctgagtgacaactgcccctgacctctcgctcctgctctttccatatgatgtgctggttcccctttcaccatgaagctttcacctgaggccctggccaagaggagatgccatcaccatgcttcctgtacagcctgcataaccatgagccaattaaacctcttttctttataaatta

SEQ ID NO: 211340 - DNA, 319 bp, Homo sapiens
aaatgtaatctccagtgttggaggtgaggcctggtgggaggtgtctagatcatggaggtggatcctcgtgaataacttaatgtcatccccgcggtgattagtgatttctagctctgagttcacacaagatctggttctttaacagtgagtgacaactgcccctgacctctcgctcctgctctttccatatgatgtgctggttcccctttcaccatgaagctttcacctgaggccctggccaagaggagatgccatcaccatgcttcctgtacagcctgcataaccatgagccaattaaacctcttttctttataaatta

SEQ ID NO: 211341 - DNA, 487 bp, Homo sapiens
cctttggatatcaaaagtttattatgacaatgttctttgtgcgtttttattcgatgttgtcagccattcatctaatacctcttcagaagatttttgtctctgggcagtggcattttataacttcatatatagaagaaaacttttatccaactgataactgatatgccaatgtgttagtatgaaaaaattttcccaacattcttaccaggtgtggtggctcaacctgtaatcccagcactttgggaggtggagtcgggcggatcacttgaagtcaggagttcgagaccagcctggccaacatggtgaaaccctgtctactaaaaatacaaaaattagctgggcgtgatggcaggcacctgtaatcccagctacttgggaggctaaggcaggagaattgcttgaatccgggaggcagaggttgcaatgagccaagattgcctcactgcactctagcctgagcgacagagtgagactctgtctcaaaaaa

SEQ ID NO: 211342 - DNA, 551 bp, Homo sapiens
agctgcccccatcaaaggcatggacactccctggttctcctcggtgctctctggcagccccgtcccttgtagcacctcacttgctctccccattcccattacccacccacactttagacaagtgagtgtgtgactgcttacattattgggcctaccctgttggaggatctacactcgaggaaaagtttatcatagtagatcatagcatgttgaaatcaaacagtcctgaatcctaggactggcagaattcagctccaccacacctgagcaatggtgttataactttaggcaggtgacccatgagccctcccctcccgtaagtgaaaagagagtgacgtaagcgtttgcaaaatgggaaagatccctcctcatttgcagtgttgtgagcattgaaggctctagtgatcgtaggcagcattatacattattaccatgtgacattgtaaggctcagtttgttagaaggggtgtaagaaagcagaaacagaaaaagtgaacttagagttgagaaccatgtttgagtagtgactgataacagaagactggagttca

SEQ ID NO: 211343 - DNA, 248 bp, Homo sapiens
ctctattagaatgtgaaatccatgacattagggcctttgtctattttgtttactgacattattctcagaaattggacctgtgcctgacacctaatgatgcccagtaaatatttgactgcaaaaaaaagtacttcacaaaaaaggcaaggttggtaatcatttatagatatcattaatatattagatgcataactactgtactgtacaatatttagaaatataaacatcgactactttttttttttttt

SEQ ID NO: 211344 - DNA, 337 bp, Homo sapiens
agatatggtggtgcacacctgtggtctcagtacacaggaggctgaggcagaaggcttgcttgagcctaggtcaaggctacagtaagcagtaatcgtgccactgaactccagcctggatgacagagcaaaaccgtctcaaaaaaacccacaaaaaccctgagtgaataagaactattaagtaggatccattgtcaaacatttctctattaatctatagacaggaatatctgctgttagttcctggagattttgtcctgagctgagtctccagggacactcgcggtgggtgtgtgctgtgcttggctgagctgcagtgcttgagagcaccaccaataca

SEQ ID NO: 211345 - DNA, 467 bp, Homo sapiens
tcaagaaagttactcttaaaaatgtgaaattgatctggcttctaaattattgttgctatacttagttttaataaatctcttcagaaactaaatttatctatttacttttggctgtatgaaaactgtgcacaagaagtcaattcttatgttcagtgggtgcatggtcttaaagtaaaaatacaaacaaactggtcatggtggctcacgcttgtaatcctagcactttgggaggccgaggtgggtggatcacgaggtcaggagttcaagaccagcctgaccaagaaggtgaaacctcgtctctactaaaaatacaaaaattagccgggcatggggacgggtgcctgtaatcccagctacccaagaggctgaggcagagaattgcttgaactcgggaggcagaggttgtggtgagccgagatcatgccactgcactccagcctgggggacagagtgagactccatctcaa

SEQ ID NO: 211346 - DNA, 395 bp, Homo sapiens
aactttacaagaagtatttttttttttgagccagtatctcgctccatcacccatgctggaatgcagtggcatgatcatagctcactgcagcctcaacctcccaggctcgagctatcctcctaccacagactccacagcagctggccctgcatgcatgtgctaccgtgcccagctaatttttgtattttttgtagacaagggggtttcaccatgttgcccaggcttgtcttgaatacctgggcttacatgacccacctgtcttggcctctgaaagtgctgggattacaggcctgagccactgcatctggtctcactgtaaatttgatgctcctttttgtttcaattttagcaggatttatattgctttgatagagtctcttttcttttcttttctt

SEQ ID NO: 211347 - DNA, 558 bp, Homo sapiens
taacacagtgtacaaaaagggaattgaagaggaagtcaaataaagaaaagaaaatactacccgtgcaacttgcaacatgtacggcctgtgtcaccacacaatctgtgaataataagaagttactttaaataatacttcagcagttatctcaatcatgtgatttgtttgaacttccaaggctaatactttcagctcaacagttatctatattataacataccgtaatgccttatggagagttaaaaattctcatttcaactgtcctcttctgcaaagctttaataagtaatgcaaaaaactcaccccctttcatgtattgatgaatataggtagataaaaattttagagggaaaaataggggctgggtcaccaatatgagaacatagataagtaggcacatttgcctggtgggtggtcagctcatttgcaggggcatctgtagacagaaacttggagattatgtgcagtctataggctgatctaatgactgccatgaatgatagtttcacatagatgtaccaactgaaaaatgacatacagatggtccccgatttatga

SEQ ID NO: 211348 - DNA, 1096 bp, Homo sapiens
atcagagagttcacactggggaaaaaccatatgaatgtagtgaatgtgagaaagccttctcccagaaatcacccctcattatacatcagagaatacatactggggaaaagccctatgaatgtagagtgtgggaaagccttttcccagagtcacagctgattatacatcacagagctcatactggagagaagccatgtaagtgtactgaatgtgggaaagcattctgttttatacattaaagagttcacactggtgagaaaccctacaaatgtgctcaatgtgaggaagccttcagcaggaagtcagaactcattatacatcagataattcatactggggagaaaccgtatgaatgtacagaatgtgggaaaacattctctcgcaagtcacaactcatcatacatcagagaacccacactggagagaaaccctataaatgtaccaaatgtggaaaatccttctgtcagcagtcacatctcattggacatcagagaattcacacgggagaacaaccttatgtatgttctgaatgtgggaaagccttctctcagaagtctcacctcccagggcattggtgaattcatacaggagagaaaccttacatatgtgctgaatgtggaaaggccttttctcagaagtcagaccttgttgtacatcagataattcatactggagagaaacctgatcgatgtactgtatgtgggaaggccttcatccagaagtcccaactcactgtacatcagagaattcatacactaatgaaatcataagaatggtctgaacacagaaaagccttcagggtcagttcaagccttaatagatagtgcaacaaccaatggatttgatgattttggggactacatctttgttgataaaattttacaagtgaagtcatgttcctaatgtatttcattctttatcaaagataatagagaagtcaatacgtaaatgatggacattttcactatggcatataaaagtttttaaattgagaaatgaatgattagcataacagaacgaattgcatgtacatctcttttgaagttatgtgctcctgattatactacataacaatcagatatgtgtaagattgtta

SEQ ID NO: 211349 - DNA, 537 bp, Homo sapiens
aatttgttaattcactgattgttggacatatggttgtttctaaatttttgctactatgaataagctgctatgaacatttgcctgcaagagtggaattgctaggtcatacgttaaggacatgtttcactttataagaatctaccaagctgctttccagtgcatcattttgcattcccatcagcaccttctcaatatctcagtatcatactgacacttggtattttcaatcttttaagtttgagccactttagtgttaagtggtatcttgcagtttaaactgctcttctctgactgctaatgatgggggctttaatctttctaagttaactatcaatacatcctcagctttaattatggataaaatcaaagtatattttaccatagtttggtaatattaacacgctattgtaatagtattgtaacactattgcatgttatagtgcttttactttatatgttctgggtggtagttttggtctgttttagaatccactactttaaatctgcatcatatattatcaggcaccttggcggccg

SEQ ID NO: 211350 - DNA, 842 bp, Homo sapiens
ggtggtgcagtgcctgtaatcccagcgactcaagaggctgaggcagaagaaccacttgaacccaggagacagaggttgcgataagctgagattgcgccattgcactccagcctgagcaataagagcgaaactccgtctcaaaaaatagatagataaataaataaataaaataaattcatatacagaaataaatgtctcatctgtgtttgtctaattccgggtatccctgtatacttattggccatgagagtgtgagactctgtagggacttgtgagcccacaaattcttttctacatagaacaagtactaaggatgccatcttatataagagccaacatgtgcacacactaggtcctgaagatttgtatcttacattgcagtctgtggccagttactttgggttagaacaccccagatttgaatgaagcggagcatccagatggcttcaagggtgggtttcaggtacctctgctccttggtcactgagggctcccaccagaacagtgtaggccagtctgtaaatagccatccccactttagaaagcacatgcgctgcactaaacacttaggtatctctgactcacgccctgctcgtactgggagagactttagttaaaccaaactgtaaatttaacaactgagaaaatgaaaccgttaaaagataagcaacttgcccaaagtcataccgccaatgagaacagctaagtctcaaaatcatgtctccagactcctaggacagtgccctttagagcatactgtgacattcagtcatattcttggtgcctgtacagcttttagttcttgaactcctggcctcaagcaatcctcctgcctcagcctc

SEQ ID NO: 211351 - DNA, 562 bp, Homo sapiens
tataggccttttgactggcttcccactctgagcaactggccagctcctgagcaggttgactgtacggaccacattatctcttagaaattagactcctcatggacagtcaggataaatgccgaatgattggacaagtctacaagactatttgttatctacctaacctggatttcttggatgagatatgttcccagtcagaatgacaattgaatatcctccattttagaaatgacaaatagttttcatcttttgtcttagttgcaaatacttgctagtggcttcctatcctgctgatatattatgttctggctcagaaggaaaaattatcaattaaaagttgtcaggctgggcatggtggctcacacctgtaatcccagcactttgggaggccgaggcaggtggattacgaggtcagggcttcgataccaaccaggccaacatggtgaaaccccatctctactaaaaaaatacaacaattagctgggcatagtggtacatgcctgtagttccagctactcgggaggctgagacaggagaattgcttgaacctttgaggcagagg

SEQ ID NO: 211352 - DNA, 432 bp, Homo sapiens
acttggcaatttagtacagacattttctcgacctgatatgtgcgatagaagtagacaagcctcacacacatgcatgtgcgcctacacacacacacacacacaaatttttctccaacagttaaagattcttttcaatatactattctacaattcaaattaggtgctattctgagatatatgtggattaaggaacctaatataagatataggtagctatatttctgttaaaataataatacctcatacttgaatgactatatatgtattttcaagtaattttaaaaacatgatccctgccgggagtggtggctcatgcctgtaatcccagcacttggggaggccgaagcgggcagatcacgaggtcaggagatcgagaccaggtggctaacacagtgaaatcctgagatcgcaccactgcactccagcctggac

SEQ ID NO: 211353 - DNA, 293 bp, Homo sapiens
gccttatttttcagaaaagctctagactcagagtcaggaagcccaggtttaggtccttggccttgcacaagtgagttcttccagttataaaactttgattttctgggtctaaatcacttaaacttttctatctcagttttcttttctgtttaagggaacatccttccttcttccttccaagcctctatttgacaaggatgataaaatatctttcttttttaagcataaggaattctacaaaccaaaagaattattacattggttgatgtgaataacacatctcaacaccatga

SEQ ID NO: 211354 - DNA, 743 bp, Homo sapiens
gttaataacttgattgttgtattcattttgcaatgtatacatgtatcaaaacatcacattgtataccttatatatttttattgtcaaacatatctcaataaagctgggagggcaaatctcaccctttataacatggaacacattttcacaagaattggtaagccaatgttttaataggataaaacagtacgcaagaaccatgggagaccctttgtttcacactaatggtatcaggtacatttattaccaagatgacttcagcagaaagtggctcagaagatggtgacataaattttcccagtagtttgggaaggttgagtggtgaaaataaagaattcctgcatgattaagaaacatttccaactttcaggttactgaaaggcagtggttttgagctgggatcctggaggagggtagaatagagtggtgttgtgacaatttaggcttagccacaaaacaccagcatattttaaagggaaggagtgaacacacttggcgataaaagctaaaaattgagagactacaaattaaggctctgcttgcccagccaatgtaattcattctctattttggcactggctacttcactatttcccctttgtgctgttcctatcttctgccccctgtttaactcatgaaaaaaaggtgatggcactttcagctgctataaacatgaagctgctgaacaaatacttcatataaggaccttcgctgtagctttcaatcttccaacagtgttgtgg

SEQ ID NO: 211355 - DNA, 217 bp, Homo sapiens
cctgtgaccaaggaggcagagcctggagtggtggagctgcaagacaatgaatgccagcagccatcagaagctgcgaaagtcaaaggatggattttcccctcagcctctgagagcactggctctgctgatacctagatttcagcccagtgatactgattttggactcctgatatccaaaactgtgagaaaataaatttctgttgttttaagtcaccaa

SEQ ID NO: 211356 - DNA, 491 bp, Homo sapiens
cttgtacactgaatattttaaccttagaattatataactatacatatatgatatgctgtatattaaatttaacatttcaaataacatgtatagcacacattcagccacatactctcatgaaaaggtattattcgtaaaaagttaatgaaaagcttatttagatagaaatgtctagacataaatactaagcctatgaaacttgaaagtaaagtctgctgtgctattaaggaaaagaagattggtttttaacctattgaattgtgcagatacaaaagtgcttagcatgagaaaattaccaaaataaaaacattttagaggttatttggttctagcaatgttaattattttgtgtttctggataatttaatgtttgtattttaaatgttatataaatttcctctttataacaagttttaaaaagcacgcaaaaatagttcaaactatatataatctgttatttttcatcctagttagctcatcacaagtaactc

SEQ ID NO: 211357 - DNA, 412 bp, Homo sapiens
agagcattgggtctcaactgggggcaagcctgccccctgggggacactggtaatgtctggggacatttgtgggtaccgtgacttgggggtgctcctggcctggagtaggtggagaccagggatgctactcagcactgtgcagtgcccagaacggccccaccccagagaataatcaagccccagtttaatagtgtcaagatcaagccacgttgctttagtaggaaatagataaaagccagtggatttgttcagttttaaaaactggtgctggcatgcatatcttgataatttgcaaaatgccaaaatgaatcattttcttggcctggtcattcttctgatttgccctcagtgaatgtaccttatccatctgggcttttgcatctctcccaattatcaggttgatagatattgg

SEQ ID NO: 211358 - DNA, 557 bp, Homo sapiens
caggtggagaataaatttatgtcttcaggaagataaccgtatcatccttttagggcaggagattcaatcatatttggaaagaaagaacgaagaccaatacaaaggaacaacttgaaggcatgagaataatggaaagaagagggtgccagggagtcttgtggtcatgggactcaagaaataagtagaaggatttgctttaccaaggaggatactggaagattcccaaagacgtagaacagaagtcaaaggagctcatgtgaaatagatggagttttcttagaaagtgtatatagcatctttgacataaataacttcgtcttagaaatagattctaccttacgtttcctaaggcactttgccaaaatagattctaccttacgtttcctaaggcactttgccaacagggaccagatgctttgcttaataaagactgtgcttcaggcgtggtggctcatgcctgtaattccagcaatttgggaggctgaggtgggcggatcacgaggtcaggagatggagaccatccttgctaacacggtgaaaccacgtctctactacaa

SEQ ID NO: 211359 - DNA, 229 bp, Homo sapiens
gcacccagccaagaagtgatgttttaaaaagtcatgaagctttagaattggatggaggtagaagaagctatgacagataatgttttgcaaccgtggctatagaaactgtcagtgactgtagcattttattctccaatatcatgtcaacaccagtggagcccatgaggtgtaattgtatttattattgcttaattgagccacagatggtgtggttattcgttttgcataa

SEQ ID NO: 211360 - DNA, 446 bp, Homo sapiens
tggaaccacaggagtccaaatagctaaagcaatcctgagcaaaaagaaaaaagctgaggtatcatactatctgacttcaaaatatactacacaaagctatacttaccatatatagctatatgagactggtataaaaagacacatagaccaatggaatagaatagagaattcagaaacaaatccacgtatttacagccaactgattttcgacaatgatgacaagaacacgcattgggaaaaggatactctcttcagtaaatggtgcttggaaaactggagatccatatgcagtatgaaactagacccctacttctcaccctatacaaaaatcaactcaaaatggattagacttaagtgtaagacatgagaccacaaaacccctagaagaaaacatagtgagaaatgctccaggacattggtctaagccaagcttgtccaaccgagag

SEQ ID NO: 211361 - DNA, 808 bp, Homo sapiens
tacagaatagtataaaaccataatcatggtatgtaaactactcatattttgagtattttgagtagagggactaaaagatgaaccaatcaaaaataagtactacaaccacttttaagacatagacagacagtataataagatctaaatagaaacagcaaaatgtttaaaaatgggaagagttttattggtttacagtgtagagttttattggttttctctttgcttctttgttagtgtgtttatacaaccacagtgttagcttatcagtttaaaataatgggttagaagacgttatttgcaagcctcatgataatctcaaatcaaaaagcctacaacagataaaaattgaaatgccagaaattaaaatgtaccaccagggaaaatcacctttatgaacacgaagactagaagaaaggaaagaaggaagggaagactacaaaacaatcagaaaacaaataataaaatgacgggatatcaaagagatttctgtactccagtgttacatcaagttaaaaaagcttttacacagcaaaggggtggttaatggatacaaaaatatagtaagattgaataagatgtagtatttgatagcacaactgagtgatacagtcaacaataattgtacattttaaaataactaaaagatataattggattgtttgtaacacaaagaaaagataaatgcttgaggtgttggatatcccatttgccctgatgtcaccattacacattgcatgcctgtatcaaagtatgtaccccaaaaatatatacacatactatgtacccacaaaaaaatttttaagaaaac

SEQ ID NO: 211362 - DNA, 323 bp, Homo sapiens
taatgacctcattttaacttgatcagctgtgtatactccccatctccaaataaggtcatattctgaggtacaagaggtttggccttccacatatgaatttttcagggacacaattcaatccataacatacggcaggatgaaaagaaatctgagggtcagatccgacctaccagctgccgtgatgtagtctactcacaaattttataggtacggaaactaaaactctcaaagagaagcaagtggctctccaaaggtagtgggccgagaaaggtggagacaggccttctgattcccaggccagggcctctctatgccacttttgg

SEQ ID NO: 211363 - DNA, 1658 bp, Homo sapiens
  misc_feature (1395)..(1395): n is a, c, g, or t
  misc_feature (1401)..(1401): n is a, c, g, or t
  misc_feature (1472)..(1472): n is a, c, g, or t
  misc_feature (1553)..(1553): n is a, c, g, or t
  misc_feature (1562)..(1562): n is a, c, g, or t
  misc_feature (1565)..(1565): n is a, c, g, or t
cgcgcgccgagcttccgcgcggagccctcgcgggctgccgggagcggcccagcgccaccgcagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccagctctgggccagtacccctatgacaggtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctccacctggttcgccaacgcgcgccggcgcctcaagaaggagaacaagatgacgtggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcctggaggctaagccgcgcatctggtccctggcccacacagccaccgccgccgccgccgccgccacctccctgagccagactgagtttccgtcgtgcatgctcaagcgccaaggtcccgcagcccctgcggctgtgtcctccgcgcccgncacgtncccgtctgtggcccttccccactctggcgccctggacaggcaccaggactcccggtaacagtctcagaaantgggtgggaggggtcttccagacccatctcagcaagagttgaacaggctgggcacgcagggcgctctggaccgggctctgngagtgtggnggnggggcgaagtgtattgacctggccggctttcgcttgggtccaggagccgttggggcgaggatttcctgcaggcgggaactttgtgaggggggc

SEQ ID NO: 211364 - DNA, 521 bp, Homo sapiens
accccatccccttcatacacacctcattccaaatgctatcctgtcacagcagatgccacatcacttttggggtgggctaagagatcaaggacatatgccgtgcccaaatttcatctaataattaaaaatacgggaagtgacacaaaagggaaaacacaggatgctctggaaacttgttataggcagcgagtgggaaggagacctagagtcagaggaagctactactggaaagagaagcagaactgagccaggcaaataggagagaaaatgtatttcaggcagaagaaacagcactctggaaacccaacatctagcctttgagaatgtaaaatgaagccaggatgacactaccaattccaagctgtgtgtgtgtgcatgcatgtgcatgtatgtgtatatatattagatgtatattttaacattctgacttaacattaatattaacatattaatatttatttattgaaatatttaacgtgtattttaatattaaattctggatttccaaaccaaatcagaaa

SEQ ID NO: 211365 - DNA, 419 bp, Homo sapiens
tccattcctctttgtctgcttgtcctcttttgcccttcattactttatgttcattttctgtctccctacctcccttcttccctttcttcctccctcccttccttcccttcttggggcatggaaggaacatttgctttcaatttccttaagggcctggggaaattggggcatgacttgaacaagctagttccctaaaatcccataactgggaactcatgcaatgatctatataaataccttatctcattggggaaaagcaaattagagaattaaagcaagtatctggaaaattgagaggaaaccaaaagcttactttttggtgtaaactttccctctagaaatcactgttaaaatgtcccactgttctacatcaactctgtttgctaaacacccactggtttcagagccctgataggaaa

SEQ ID NO: 211366 - DNA, 441 bp, Homo sapiens
tagagaagggtttcttaccccaaactcaaggaaacacagattgtaaaggaaagattaataaattcaactacattaaaatgaactttctctttatcaaaggataccattaataagttgaaaagatgcaagccacaactgagaaaagtggtctgcaacacacacattgctgacagccgattagtatctaaaacatttaagaaagataaattgataaaaggtatgaacaagcatttcaaagaaaggaaaacatgacttgctaatatacatgaaaaatggtcaacttcagttgtaattagagagctagaaattaaaaccatgtgacagcattttatatgtaccaggttggcaaaattaacatttggaacaatacagtttgtgggcaaggatacggagccacagaaactctgatggtctcaatctaattccctgcaaagaccaagg

SEQ ID NO: 211367 - DNA, 166 bp, Homo sapiens
gaggtgtttcagcgatgggggcactgccgtcatgaatggattaatgctactgttgtgtgagtgggtttcctaaaaaaggacaagtttggcctcttcttgctctctgtttcgtatgtgtgatgcctttcacggtgttataatgcagcaagaaggccctcatcagatg

SEQ ID NO: 211368 - DNA, 496 bp, Homo sapiens
ttgtgcaagtgcatttgacggagaccccaactcacacatggaatcctagctgcaggggattctgggcagtgcagttttcagcttcccagctccagtaaggaaggcagcaagaaggggttgggacgatgctgagtgccgatcactctatctgacgcagctgccactgaaagtcatgaggaaatcggggagctgctggtctatgtgcatggcacgatccttctctgagggacagtagcatgtggcagaacacaagtggatgcctgagatttttaggaagtttaacgagtgttaagtcattaagatacaaaggggaggtaggggagaggcatcagaatagttgcctgttttaccacattagaagttactctctggaggatacccccatttatcttgatgtaattattatttattgtgtgcctgtatcaaaatgtctcatgtaacccctaaatatacacacctactgtgtacccataaaaactaaaaaataaataagtta

SEQ ID NO: 211369 - DNA, 695 bp, Homo sapiens
ttttctctacccgggtggtaatagcccaaagccttcattgtaaagtttcccattaacctttcacttaggaatccactgatgactactgtgtgcatttattatgtcattaaggttgtgaaatgatgactttctaattccgttactccttccatatttattagctgaaattattcttaaggaattaatatcatctgattatcctaaaatttatcattcacattggtaggataaatgcagaatttatttcttctaattgataattgtcagagtaaggaattgttgcccttgtcattttcagtgttgtccaagagtttttggggtttttttaaaagtattttactgaactctttttaattgttggcttcaacttttagaatcattgtgttttaggcagttgtttccattctttatgcccaatttgtccctttggttccttcatattggctcctgtattttttcaacataatcctgttaggttttgatagcatccttgttttctggcacaacaaagtgttctaggcttatcttgtatatgtctatcctctgacctcagaacaactgtttctctaaggaattctagttcctttttgtggggattggtatttggagaccacaagctaggtgtcatttttgaaaatgtaatataccatgcaagccacagaacacatttgtgagcagatgcagcccatagcggc

SEQ ID NO: 211370 - DNA, 235 bp, Homo sapiens
atggcgagaggtgggaggaagagggggcggggaggatgccaggctatttttaacaaagatttcacagaaactaacagcaagaagtcgctcattaccacaaggagggcaccaagctattcatgagggatccgctcctatgacccagccacctcccattaggcctcacttccaactgttgatcaggtttcaacatgagatttagggggcaaatatttaaactatatcaaatggccta

SEQ ID NO: 211371 - DNA, 277 bp, Homo sapiens
attaaactgaaactaataattttagactaaaacaccattttagtgtgaccagtcatgttttgcttagagtgaatgtaatttcttaaatgttcatacaaaagttggtgacttttatatgtttctcaatagtaaatttgagaagaaaatcagttttatcttctggtattatgtagaaattaggcaacaggattttaataaatgagataagtagttttttaatgataaactttgatgaaatttttcaaatgttctttcagtttcagatattgcaagaaaa

SEQ ID NO: 211372 - DNA, 551 bp, Homo sapiens
ccctcttccctgccaccctctctcttacagagtctctctatgatgcccaggatggtcttgaacttttgggctgaaacgatcctcctgcctcagtctcccaaagtactgggatttcaagtgtaagccaccatgcccagccaatttatgtgcaatttcatttgtgagaaacactaggtgaatgcagaaaactgcacctagctgaaatgagttgcccaggaatctacaaaacacacatacctaagacatctaccagtaacatcacttcactatgtgttataataaaactatagccttttgcatctgatgttatacttttctgatttcagataaacctccttctgccaccacaccataatttacaaactacaattctctgcttccacagacaagcttcaggtctttttcagtataaaacgccatagttaatgcagtatttatgtatttcttacttatttaacatatgtcaaatggcgctcccatttttaataaattcctatcttttttaatgcatcgctaatgaagtttttaatgtatgtctctaaccccatatt

SEQ ID NO: 211373 - DNA, 147 bp, Homo sapiens
ttgatgaacatagagtaacacgctgggatggttgtggccacttgtctgtctcattggtccatctctcccagtattccatttgaaatccttcttcagccccttaccacagcttcaggttgatattgaaatacaatggtaatagtgagg

SEQ ID NO: 211374 - DNA, 279 bp, Homo sapiens
ctccagcccccaatgtggaaaatagacccagcaagtaaactaaagagacaacattacctttaaaggtactgtagaaaattgctacttttcaagtatattaccagttgtaaacagagcagggagaagtttaatttttattttcaattctatcctcctcctgactgtcttggaagttagagcccaatattctacattgaatgctacagctcagctttatctctaagtcaaaacaaatatatttacagagaaatcactttggtaacacagcttaagaaaata

SEQ ID NO: 211375 - DNA, 681 bp, Homo sapiens
cagcccagctctccagccctgggtggtgatgaagcagggcccgtctgcccagggcagggcatgactgggctgggaggattcccacttggagctgtgtccctctgagtgcagacctctgcctttcccgttcagcagggtagggctggggcagtgtgtccaaggtcagagcagaacactttgcaggatgacaggtaccacagtgggacacagcctgtgggcaggacggcatgggacctgcgccccagcaggtggccacaccagtgcccagcctcaccctgtagttagctggcgggaatctagtcggcgggggggcccaagtgccctgagagcccctcctgccagtttatttatattatattatattatattttatttcatttttgagatggagtttcactcttgttccccaggctagagtgcaatggcacgatcttggctcactgcaacctctgcttcctgggttcaagctattctcctgcctcagcctcccgagtagctgggattacaggcatgcgctaccacacccagctaattttgtatttttagtagagacagggtttctccatggtggtcaaactagtctcgaactcccgacctcaggtgattgacccgcctcagcctcccaaagtgctgggattacaggcatgagccacagcgcctggcccagtttgtttatttatt

SEQ ID NO: 211376 - DNA, 230 bp, Homo sapiens
aaagatttgtggggtgttaggggacagcgggaattacagactctttgaaaatgtaacaaaagctttggaccctttcactggaagaatgctggcaaacacatttggtatgctgtttcagggcagtcgctgacactgtgtgtgctcaggagatcagaggcaactatattaaaaaacacctgccattaatatgaggaatatattattaagaaggatctcatcaacttttaacc

SEQ ID NO: 211377 - DNA, 919 bp, Homo sapiens
ctacacctcctttgttggttttcaaccttaacttcttactcaactatgaaatcttggcagttttaaggttcagtctcagaacattaatcttctccaccatactgtctgtcaagatgatctcatccacacccaatcacgtacacaaaaatgtctcacaacaaatttacatctttacctttgatctctctgtctgaaatctaaactttatatccactgcctactatatgatagctccctttgaatgtctcagaataattctacttattatacacaaagataacgtcggaatctatgaaaaaacatcctcttctagtaaatgtcaccattcaccattcagatgcacaaactcaatgtcatctctgacaactccatttatctcagctgccatacccctatctatcgccaagtcctggtgatttatttcccaaatatatttcaaatatgactcctttccacttaaactagcactacaaacttaatccaagctacttactgatcctttcaccaagaccaccaaaagagcctgctctttgggttcctctgatctacttggttttttctccagacattctttacagtgtaaccaatgcagacataatcatgccaaaccctggttaaaattcttcaatagtttaccatggctcttaggataaactcctaaaatgacatggctatgcttcacctagaatcttgctctcctggaggaccacccttcactcattgtctatgttttttatgctaaaggacttttgcacatgctctctctgaaatatacttccttccttcttacactcatccttcagataggcactcaaaagttacttgctaagggaagccttcccctgaccttcctgaccagatcatatcaggatcacagcctgtcctaacatcttgcatatagccttcattgacttgtcat

SEQ ID NO: 211378 - DNA, 278 bp, Homo sapiens
cagcacagacagacagagagatagataggaaaagagggaaagaggaagagcaggtcagagtgactttttaacttcattcttgctcatcctccccttcccagttggctgtgtgattacaaggaagcattggtagaatgactgatctctcgtgcattccaacttctctttgccctttagaaagcaaaaaaagtcacttcaggtggctgtgcccaaagctgccaactaagacccctactcatgcctggtctactccaggcatattcccttaaatttcagtc

SEQ ID NO: 211379 - DNA, 725 bp, Homo sapiens
ccacctcggcctcccaaaatgctgggattacaggcgtgagccactgtgcccagccagaagattagatattacaggagaaaagataaatgattttgaagacagcaatagaaagtgacatcctgttctaatgaagtcttaggtaattgaaatatcaggtgatgtcactgtgatttttgagatttaattagagttagcttttgctccctgttctatttatgtgaggattttaatgtctttctcatactttatagaaatttctaccctttcagattttcctcacagttgctcacatttcctactctctgtccctttcctgaactcttatggttgttatcatctccccttcatatagagctttaaataaggaacaatatacatttgcaacaagataaattctaacagtataaatcctttaaaattactgctaagaataacagtgatagcaagcattaaatccttagtatgccttaagtgctttgctttgtgtgttttgaccagtttaattcttaggacagtcctgtgcatgtatatatgatgattgttctgtattttactggagaagaagtgagacacagagggttgtcaaagtcatctagcttttaactatgaaaatagtagtagtatctaagtcattaagtttttctaaaggttaaatgagagaatgcatgttaagatacttagcccagtgcctgaaaatgtagtaagttatcagaataggctattgc

SEQ ID NO: 211380 - DNA, 122 bp, Homo sapiens
ttcagccctagaagacacgggaatatggaaggcgtggtggcaaagttaaaatcctaaagttagggctgtgaatcccagctttgaggagcgtgggtccttggccctatggaaagtatcaaagc

SEQ ID NO: 211381 - DNA, 858 bp, Homo sapiens
ggtacttagtccttgtcagctttcctgcccgtctgcaggggtggcagtggtgccagggggtggcgtgctgaactgcaagttcatctgggatctcctggttgtgtttggatttagctggggtgtgtcctctcctcctacaccttgagtcaccagccaaggtggaggagagaggatggggtgtagcctgtgtccagctctctcttggacatggttgggaggtgctgaccacaagtccgaggccctgaaaagaagtgctgcaaggaggatgtttctttccccattggcacagcatcaaggttctcaacagctggacacaaacaagctgttctgggagccgtgtctcattccccttcacctcctgcttgctgcctgctacgctcactggtcaccagggctgacgtatggggaggaatggagagtggtctcactgacagtggatgtcattgtttgctctctctggaaggaggatgtctgaccgaggccagagaccacgctcaggggacctggacgcccggggagttcaagcgagcctctgtcctcagtgatggagtcctgggccactggggcagtgtttgggtgctgcttccactctggctcttgacaacagagtttgttccctttgaaacaagtttgtaggaaccagagtgtgtgaggggcctttggcagcgctgaaggaagggcagctggaatctttgaccccctcaggcccccgctggcctggctagagagctctgcctggaaggggacctctgttgctgggcaagggaaggcacctttggctttaggaagcctgagggtcttgtccctgtcctggttgccagggctctgcctagtgccatggaagggaagaccagattg

SEQ ID NO: 211382 - DNA, 528 bp, Homo sapiens
gaggggtatctcatctacataccgacactaaaacgtaagactaggtgtgtcatttgcatagggcactaatctccagcagcacccctgccaaccttttattgcacagatgggcccttagcctaagttactccatgtgtttatctttattactgcacatgtgctaagtgggcagaaccatccatggtggacatgcccagcccaaggtagttcctcttattggtgcagctgcagacacccccattctgtgcaagcttccttatctgagtatgtccaaaaaatgaaacgaatgtgctcactagggcccactgtgtttactgggggccaccatatgtatgtgaagcttgctgattacataggaggctgcctctctgtgctggaacttgcttccttatctatatttgcagtctgatcttccaggctgttctttgttagagagggaattctgccaagggactctgccctcagtatctgactagctagtttcttccttctctctcactgtcatttccttgtataaggatttataaa

SEQ ID NO: 211383 - DNA, 336 bp, Homo sapiens
tcatttggttgtctgccttgcatagacttattatctgctgaaattgcatgtgaaggaaagattattaataaaatatatgtgaagaatggctgaaaagatgcttttgtcagtgcccctaaatacttttaagagcagagctgcagttttctaagagtggtgttgtataggccataaaaatacataaaaatttaagcttttcctttaaaaggttattactgcccacttttagcccacaacaaaattttatttgagcagaaaaccttctttgttagcttgctgtgcctgccgtcacaaattaccacaaacttgatggctaaaaacaacagagatttattc

SEQ ID NO: 211384 - DNA, 571 bp, Homo sapiens
cattaatgagaactccaccctcacgacctagtcacctcccaaaggccccccctcctaataccatcaccttggggattaagtttcaatatatgaattttgaggggacacattcagtccatagcacaagtcaataaatatttctttagagtagcttttgtcagataatctattaaatactttatgaacaaaactgtctaattgtctttatcagtctagtatggaaacaaaaataattgtgtaccaggagaacatggaaatgtagtatagtataacttacaaatgttgtaggggtgaatgatcaaaagccacctggcattttgctgctggtattcctgcccttactcctctcttagccccagttttgtcactttctggctttggaattggtaatgactcccacaccaggtctgaactcaacatgacatttagtgtctgagcccaccttatcttttaatgtcttttccattacttcttagcaagaactgcccaggtcaggctggtcttcaccccattctcataataagtcccaaatgttcctgtgtgtctttaaccacactgttcctcctggcat

SEQ ID NO: 211385 - DNA, 386 bp, Homo sapiens
ctgtctcccctacctaactggcaaatactaaaaataattatagcactggcaaagctgcaattggccacgcacactcatacacagtttatggtaacataaactggcatagactttatgaagatgaatttgaccgtatgtgtgaagacgttctactactaaactatccaagaaaataatttaaaatgcagtaacactaagtagtcagtgaaatattagaatcaacttaagtgctccaaaatagaatgggggacagggaggaaggatgcttacatttattatcataagcctaaataaaatgaaattctctttgagaggccgaggtgggcggaacatgaggtcaagagatcgagaccatcctggccaacatggtgaaacctcgtctctac

SEQ ID NO: 211386 - DNA, 228 bp, Homo sapiens
ccttcctcccagcatgagtggagcccacagtgatggtggtgcccatgagctctattgtaaacacctagacagggttacggatgtagccatagctagagatacagatttatgcacctgggaattttactcatatgtttgatgttaacagaaaaattcctgaaaggacgcaaactaaactaaggacagtggttacctgggtgagtcattcctactttttttttttttttt

SEQ ID NO: 211387 - DNA, 1058 bp, Homo sapiens
tttctttttacggggactctacatagccattatattttattacaaagacaatatcttagtcaccaatgaagatcaagtaccaatgttgaaatagatgactctcacaccagttctattacacaagattttctgtggttcacgaagctgtcttgtatgtgggaagatataaggtggctgaggcaaagcataccaatatcctcatcctcatccacagtgctgcaaactcggcagaagatgctcgcagcaacagcacagctacagaatttacttgggacacacaacttgggaagagtttactatgagcccattaaagatcgacatggaaacatactcatagtcaccatcagggaggtggagatgctttattcattttttaatggcaaatggatgcagatctcaaagctgcaaagccagagaaagtctctatcaacacctgaggagccaacagctttagacattctactgataaccatccaggatattctatcctatcacaaaaggagtcatcagcgtctctttcctggattatatctgggttacctaaagctctgtagctctgtggatcaaatcaaagttcttgttacccaaaagttgcccaacattctctgccacgtgaagatccgtgaaaacaataatatttctagagaggaatgggaatggatccaaaagctttctggctctgaatctatggaaagtgtggatcatacttctgactgccccatgcaattgttcttctacgagctccagatggcagtgaaagctctccttcagcagatcaatatacctctacaccaggcaaggaacttccgcctctacacacaggaggtgttggaaatgggtcacaatgtgtcctttcttctcctgtccctgcctcagacgacgtctgtacagccccaggacagaataatccttaaacccaaactcagggtttcttaacctccctcttcagatgtttgaactggtatagtagcttgtttcacctagaaatattaacccagcctccttataataaaatcacaaagttatatctgttcccccttgtcccagtggagggtcaa

SEQ ID NO: 211388 - DNA, 528 bp, Homo sapiens
acgtggaaaagaacaccaagttgacaaagtggtcgaacactcatctcaaactacctggctgagcacaaaaacaaattatttttggtctttcatattataaaaggggctgttatttaaaaattctaaaagcacactttgttacctctaatatacacctaccccaatctcacttatatactgtttcctttctgcccacaattagatattcaaacacattcacacccctagttgtacacctacgatgtcccaggaaattagtgcatggtgctacagggatataaatatgagtaaaacacaatctctgagtaagacacaatcttagcccttcagaagtgcttatattctagtcaaatgtaacaaggacccagcaaaaaattttcagtgacataagagaaatgcaaacagcaaccaacaggaataggagtcataaatctttgttacacagcaaagatagtccaagttatcaaatttatcatgtgtgatgctcttgacaggaaataaaaaatacacaatgcatgttgggataaa

SEQ ID NO: 211389 - DNA, 387 bp, Homo sapiens
agtaaagtgtactgattgagaactagagttgtggggtcagacagacctggcttcaaatcctcctcggccacttacagctatgtgatctctctgagctcaggtttctcatctgcaaagttgggttaataatacaagttcttgctcattgttttgttgggaggagtgaatgagataaatcacgtaaagcacggaccacagtgactggctgataataagcctcagtggatggtcgcccttagaattattttgtaaccctttgcttttgaggcagctggtgagctctgtagcctcagagattactaaagcaaggccaaggctttcggcttgtggcttacttacttacttgtttatttatttcagctcggcacatagttaaagaaagagaaa

SEQ ID NO: 211390 - DNA, 124 bp, Homo sapiens
aatgatagtaagtcttctggatttttattagaatgaatcacattttccatccttgtttttatttactaggaatttcatcttatgactaaaaagaacaagccataagctcttttggtctaaattt

SEQ ID NO: 211391 - DNA, 1437 bp, Homo sapiens
ccaaaccagtcttaaagttgtggcacagggtgaggaagatgaagctgttactgaacctcagagagtgactggtgttacagcaaaagttagcaatggcctgaagggagggtttctgaaatcaaatatgaatgattccccctcagggaacccaaccttgggaactactgcatggttctctgtatgggaaaatatcattaatgcaggataaattgtgaaatatcacaggaagcatcctgcatctagtcaatcttctgtttctggggtggcctgtgcagctgtgcaggcagaggcccaaccatcctggtgagtggcacacagggactgagatccagccacacctaccaggccatgctctgggaagggggtgggacctgggcaaaggacacctctctaggactgcacagaagcctttgtgggtgggtgggacattcctgtgatggccttctggctgggcactatgaaatgctctgaagatttttccttgcactgttgcactaaccccagtcctctatcactgccccttcctcctgggcgacttcactgatgttgtggccatgtgaattctctggccaatgaaatgataaagatgatatggcctctgccaagcagacactgtaagtattattgtatgatgcttttgtctctttttttaaagttaaagcagtttattaagaaaataaaggaataaaagaatagcactccataggcagagcagctgcctctgtctcttatattttcccctctgcctcaagcccaacatgcccaaaattggggctgctggttcagcctgggtctcagaataaagacatgagccacagatccattgctgacccatgatggagatggacacaagagagaaacacatttttgtcatgttagccactaagattttgatttggaggccatttgctacagcaatataacctagcgtgaacagagagacacagcgatgttccatttcttttcaacctggaacaggagaatttcataggtgggcctcaatttcactttagtatcttatttagacaagaaagttcatactgttcaaatgtcatgtttaagagtgctggcattatcactgctgtggctaccccatcagatgttgctcactgactaatcttctcatgttagtgaggatggacaacatatcaggccataattcaaagtagcaaataggaaaagagcttcatcctagcattatgggaccttaattaatgtcctttcctgacaggtttcagaggcttttgcaggcagcagcagagctattcatctcactgacagtggggaacatggccaaatggttgcccccacaatggaggcagagtttcaggacacttgtctgatctctgcccttgaaggaacagtctcaccctgattgacacttttgcctgttatgtccaaagaaccaatggaaaagcaggaaaattattccttctt

SEQ ID NO: 211392 - DNA, 251 bp, Homo sapiens
tcaaattattatttttggggggctgagttttaggagagatacattctgtacgttaactcctatcaaatatctaataggtcaatattttcacccatttctaaggtgacattttcattccactaattggttcctttaatgttcagaaattctgaagtttgatgtagttcagtttttttgttctttgttgcttatgcatttgacatcatatccaagaaaacggtgcaaagaccaatgtcatgatcttctctata

SEQ ID NO: 211393 - DNA, 1095 bp, Homo sapiens
agttagcttgtgttagctcaattagacccctgccttattgcaaggacagagggctttctgtatccctgggttcttgccttggtgtaccaggagaatcggatcacacctgggcttgaagaacgagtgcaaggttttactgagtagaagtagctctcagcagatgggggagccagaagggagatggttttcccctggagttgggccgctagactgcctgggctctcctctgattgccccggccaaactccgccaactgttcctccttccgccagtcgtggcctgtcggcatgctgggatctgtcgtgtgctcttcctctggcgtgctcccatccacatcctctcgctgtccagctgcttgtgtcttctgcgatgtgttcctctccacgtccagctgcttgtgtgtctgcctgctagaatcttggaggtttttataggcacaggatgggggcgtggtgagccagggtggtcttaggaaatgcaacatttgggcgctgaaggcaggggtgcctgtcctcacttagacccgtgggcacgggtttgggggtggagccctcgccagggaccacgccctcctctacccagcacttcctttccctcctttcctgttatttaaagggaccacgcccttcccagcacttccctcccgttatcacttacaaaagctagtttatcaagttctagctccttccctgacttgctgtccaacattggtatctttttgttttgaccatccttataaatgggatgggaggcagctgatcctgtaaattaaaaaggactggaaattagaagacctgaatgtgcatgtttgcttgttggtttacaagctgcatgtccttgggtaagtcacttatcttccctgggctctattctttcatctgtaaagcccatctcacagagcagctgtgaggatccaatgaagtgatgccagcaaaaggtgcttgcttcgtacatgtttttgatgatgtctttgccatttgattgcagtgttaaacttaataaattttgcatgtaaaatgtatactttttataaaaaatatttgatattcatcttgaaaacattatgctgaataaaataaagcagacgcaggacga

SEQ ID NO: 211394 - DNA, 489 bp, Homo sapiens
tgggggtgaaggacaagtagacttatcaattataaagtgattaatggtatgtttagggttcctcaggaacatgaaggagaaacatctaattcagaatgcggaactgagaaaggctgcatcttgaaagatgatttgtagttagccggaagtgtgaagggagagggatatcacagagagaaggtgggaactgttattaatgttttatttctgaaggtggtaatgagttcttggaagttcattgtattatttgtatcactgtatatcagaagactttaataataagcattgaatcattaagccttagaggtgatttctgggtattgataacaaaatatgaaaggattttctattgtatagaaactagaggcaggggtactataaatgagaaataataatagatgagtgaaagtaagtttatatattacttgccttttcaggataagtttcatttgggggaaatagttttactatttttgaaattaagacata

SEQ ID NO: 211395 - DNA, 418 bp, Homo sapiens
ccatttttaagtgtatgattcaattttaaaaaatgtattcagttatgtaaccaccatcacaatcatgatagggagtattccattattccacaaaagttctgtgtacactcctgtagtcaatctactcccttaactcccgcccgtgacagccattgacttcgtttctagctgatagttttgccttttccagaatgtcatatacatggcttcctacaatacataaatttttgtgtctggcttcttttacttagcacaatgctttgagattcatcaagattgttgcatgtattcacagttcaccgcttttaattgtggagtagcatctgactgtgttgatataccacaatttgtttattcattcactagtagattgcttccagtgttttgagaaattaaataatgttgctttgaacactga

SEQ ID NO: 211396 - DNA, 486 bp, Homo sapiens
ccaaactgggagttcaaagattgggttataagtcccagctactcaggaggcagaggtaggaggattgcttgggcccaggagttttgggtccagcctgaagaacagagagaggcccatctcttaaagaaaaaaaaggattgggtggttatagtctcaaattggggaatattaacaactagtaatgccactaataaggttgttgtgaggaacaaaagagacgtgaaaacactatataaaaaacctttgtgaattttagtgttttattatcagtactggaaatagcattaatacttgctttctaaatggggaaacagtctctctgtttctcgtatttttagttaagagggcttttaaaatttgctgtcttctgtgatatctgtaacaatcctgcaaaagtggcagagagaagagattttgcttctttgttctatgtactggggggttaggagagaaataagaattttttaaaagtctgacaactgaaaa

SEQ ID NO: 211397 - DNA, 388 bp, Homo sapiens
ccaggtgatccgccctccttcgcctcccaaaagtgctgaaattacaggcatgagccaccgtgctgggcttcgaagcactgtttaatatctcctacttatgcacagaacagcataactgtatgattactttatgggccaggattactcagtgatacagttattttgggtttgtagcatagaagatggtagaaaattggatttaaacggagtaggataatttttatgttataaagtgtacagcataaaagcagattgctagcttgaattgttaaaattatttcattgatgttaatatatgaagtgtaagaattttcaaatggtaaaaatgactgatttggtcattaaactttctggttttggtctttaccaaaaataaaaaaacaactcc

SEQ ID NO: 211398 - DNA, 510 bp, Homo sapiens
gtaatcccagctacttaggaggctgagacgggagaattgcttgaacccgggaggcggaggttgcagtgagctgagatcacgccactgcactccagcctgggtgacagagcgagatttcatctcaaacaaaaaaaaggacttgggcaagcccattgcctgcaccagacctcagtgtcacaacccagaagatgggctggcagcgtccccaggcagcggatcctaaagaagacacacacagctcccgagggtcaggccttcctgatgaggggcccgggtgaggccccgagctagagctgctagagctgtggaggggaagatggggagtcgctgccaggcacactgtgttcaggagctgtggggaaactgaggcaaggagctgaatactgagggagtggaatgtggtacagccacaggggaacagggtgggtggtgggactttctgtgggcgctgagagggcgggtctgccggagctcccgtttacctctgctcggaataaaaccactttatgc

SEQ ID NO: 211399 - DNA, 355 bp, Homo sapiens
tcgacattagagctgaggcacaaacatcacccttgctggcccttactatgactccagaaccttccgaccacaaccaacaactgacatagtaagatccgaagacaggcagcccttttcataggacagctgtgcttctagtttacggaagaatctgcttctcaagatttatggaaaatgcttctcaggccagccacagcagttcacgcctgtgatcctaacactttcagaggccaaagcgggagaatcgcctgagcccagttggagatcggcctgggcaacacagtgagactccatctctacaaaatgttttataaattatattgtgtaattaaaaattaaatgtttaagtaatttt

SEQ ID NO: 211400 - DNA, 601 bp, Homo sapiens
ccatggatgaatggataagcaaaacgtgtcatgtacatacagtggcatgttactcagccttaaaaaagaagaaaactctggggtgggcacagtggctcatgtctgtaatctcagcactttgggaggccaaggcgggtggatcacctgaggtcaggagctcgagaccagtctggccaacatggcaaaaccccatctctaataaaaatacaaaaattagactctacctcaaaaaaaaaaagaagaaaaagcagaagaagaggaagaacaggaagaagaaaactgtgagacatgatacatgctataccatgtaggaatgttgacatgatgctaagtgaaataagccagtcacaaaaagacaaatgctatgtgatttctcttatatgagatgtctatggtactcaaatttaccgagacaggaagcagaatggtcgttgccaaaagctgtggggagagaggcatggagagttgttgtttaatgggtaagagtttcagatttcttaagatgaaagtcctggagagggagggtggtcactgcattgtacagcaacgtgaatgtgctgaacgctactgacttgtacacttaagaatggttacaatcgta

SEQ ID NO: 211401 - DNA, 338 bp, Homo sapiens
atccttgaggggttaagctattattatcattattttatcattaacttctgtgagtttgacttgtacagggcctcctagcctgcaaatttcaaaattgacgtcttttttttttgagacagggtcttcttgctctgttgcccagtctggagtgcagtggcatgatctccactcactgcagactccacctccagggttcaagccattctcccgcctcagctactcaggaagctgaggcaggagaatcgcttgaacccaggaggcagaggttgctgtgagccgagattgcaccactgcactccagcctgggcaacagagtgagactccatctgaaaaaaaaa

SEQ ID NO: 211402 - DNA, 460 bp, Homo sapiens
tgcacctagacacttcttgaaaggagacactcagtttcacaagtgagccctcttgcccagcacacacctatggctggctgggcaaggcgctcaggcatgcaaccatgggcaccaggcaatacccatccatcacccatctcactctccccagtcctcaggcagcagcttttccaccccaggaatctctgttccttctctgtctgcctctccacagcccgtgatcccctgcttctggctcctaccactggacagtcattgtggatagagcagcctgctgctctcaggaccagagaagggaaatgacttctccaggcagaggcagatctgagtctagaacccaggcttctaaatttctaggccagtactactgctctcaaaagagattaactgggattaagtgagatgacgcatgtaaagatgctgtgtaaactgtaattcttaataccattatcacgcatta

SEQ ID NO: 211403 - DNA, 233 bp, Homo sapiens
ttaactatccttcaagttctaaagatagttcctgtgtggtttcaggaaatcctttaaaactcattttccccagctataaaaaaggacaagtagctagaagttgagttttgggaagacgtaacaattaaagtagcttgctttaaagacacagtaaaaggtaaggacaccaataacatattcattcattcatgtaacaaaaacaaattcagtgcttactctgtaatgggccctgt

SEQ ID NO: 211404 - DNA, 336 bp, Homo sapiens
ggagttcagcccagcgcccgaagtaaacttccttaccgctggcagcaaggccgggcggcggaggccgggccgggtgccctggggccggcgccgggagcgctaggggccccgtgcggtcaggccggggcgacctccacccgcacccacgcctcatggggctcccgggtcttggccgcggctgggatccccggaaaagcagggacggagaagccaggccggcatgcccgccctccttcccccgggaggacccaacaactccggaaagatcctgccgggagatgtgctcgctttccccggggcagcgggggaaagcccagcaaaggcacattgaaaatt

SEQ ID NO: 211405 - DNA, 403 bp, Homo sapiens
  misc_feature (251)..(251): n is a, c, g, or t
  misc_feature (381)..(381): n is a, c, g, or t
  misc_feature (399)..(399): n is a, c, g, or t
agccaccacatctggcctttcaatcttattctagtgtaaaatgtgttgggagagggaacttggactaaatacttacaagttacgaataccctgctctcgattgtccccgtgttttgtgggctggcttgggagcagggcgcttgtggaaggatgtgccactgatcgggaggttgtgcagtcactggtgatgcctccagggtctgatcccttccatgtgctgcaggaaagtcctcctggtagccacacccacngatgcctgggcggatatctcgtatgtggcacccattgagctcacggatgaattgcttgctaggtctattactcgaccaagggcgctgcatgtgacaacagaattccttggttcacacaactttcttaagnctttctcgggatgcgacnctgt

SEQ ID NO: 211406 - DNA, 345 bp, Homo sapiens
ttacaaagagacagtggaatttgaaagtgccggctggcagcggtggacagacggcgccaccacgcggtagcttggtagcataggttgctagacacagtaccagaaggaaaaagtttgaccaggaaaggtgactgtgtgtcgctatccaaatctatgttcggcttgtacagaaggtgtatctgcagaaggctaaggaccatatatgtaagttacatgtaactttggacatgtccaactttgctttggatatttttcaaaatagtaacatccttatattctggctgttataccctgatttttcaccccccatttaattaagcatttataaagctcgttattgtctta

SEQ ID NO: 211407 - DNA, 602 bp, Homo sapiens
gctaaatataaagaatgcatcctatgtaaatgggtcttagtagctgtggttatctagggcattggatatattgtccttttgattttattctaggcagaaattggcagagaagacctagcgttcaagggttctagacttctcttggctatattattgtttgaaccatttccaggccagtagcctggggctttaggggcttaggcagagtttgctgaggtataaggcagcaagtgctgttagctgcctgaacagagaagcagtgttgtgttttgttgaagagcatagtcttcagagtttaattgcagctttcccatttgcaagctgtgagcctggccaagctatgtgagatctctaaacttcacacttgttatctccaaaatttttttttaaaaaaggataaggattaaatgtgataactcttgtaacagcacacagtgttagctatcgctgggcctagaatgcagtaaatgcccagccactgttaattgccaaattaataaaaactttttcatgtatatgggacaaaaaaggtaagtcttaaattaacttgcatagcattggaaattagctagctcacataacacaaaagtcatattttcaag

SEQ ID NO: 211408 - DNA, 330 bp, Homo sapiens
gtctttccgttagaatgcctcagttggccagatgtccctatccttggaatgcctgaggtcacatatttgtcttcatcgttacaatgcttaggtttggccaggagtctctctggttagaatgactgggttcggccaggagttgctcccgttcgaatgcctggaatcagccaggtgtctttatccttagaatgcctgaggtatcacaggtgtctctatccttggaacttttgaggtaggccaggagtctttgtcattataatgcctaggctttgccagaactttctcctgttagaaagctgagggtctgcaaattttttttccattggaatg

SEQ ID NO: 211409 - DNA, 413 bp, Homo sapiens
gagtggctttgagtgatggtgggttctgtgagggatgattgagggggtgggaaggaggtcagtgggactgaggggtctaatggcctgcctgcctccaccctatcccatctcagttggctcttcccactgggcccccaggcccctcctcacagggaatgcaggttatgaatctcctcttctctggaccttccaatgccctcttgcctgcctcagagaaaatctaaacccttcccgtgacccgctccccttccccctggtggactgtctcctgccactctctcctgctgtctacactgcaagtccactctagggtggcccttgctgctcccggcctggcctccctcccctcagagtctcatggccccctccctccctgaagtttctgtccacgctacctttggccttctctgtcc

SEQ ID NO: 211410 - DNA, 968 bp, Homo sapiens
taatgatcaaaggtttaatccatgaagaagacagcaattttaaaagtgtattcaccaaaaaataaagcttcaaaatatgtgatgtgaaaactgccagaactaaggcgggccgggctcagaccagcgctgcctcaggatgtaaagtgtaacaagagggccaggggaggtggtgggggacaacatgggcctgtgaggcctgtgggtgcccgcgttccccagctccccccgcagcccgctccacagtggtccgctccggttggttgtcacgtgcgcattcgggttccagacccaaggctgcgtgttctccaccgcttgttgtggccagtgttactgcggtgaccgccagagcagcctcgacgctatggaggagcctggtgctacccctcagccctacctggggctggtcctggaggagctaggcagagttgtggcagcactacctgagagtatgagaccagatgagaatccttatggttttccatcggaactggtggtatgtgcagctgttattggatttttgttgttctcctttttttgtggagaagttttagatcggttaggagtcggctttatgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgagcaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaaga

SEQ ID NO: 211411 - DNA, 256 bp, Homo sapiens
caaaaacaaaaaagcagaaagagatgttggcagaggagggattcattttttcagcaatgcatttctttctctttttttttttgtaatggcattagatgtatctgaaatatgtaatggcattagatgtatctggaaaactagtgacaaattttgctaatgacatatattggtcatgaataggtccaggaatcatacagcagatccaacagttcaatttcctccagtggcaacaatttgggaaagtttaatcaaagtg

SEQ ID NO: 211412 - DNA, 402 bp, Homo sapiens
aagcaaggaaggaatgaagggatttattgaaaatgaaagtacagcgtgggagtgggcttggagcataggggctcaaaggccctgttagttacagagtttttgtgagtttaaataccctctttttggggcacaccctatgtaaaaggagaggatgaagtaaggttacaaagtcatttacttggcctatgccctatggagaggatgaagtaaagttacgaagtcatttacctggcctatgccctatgaagaggatatttcctgttatagctgaagtgtgagattgccttagttccctgcctccagaccctatttttctgcctcagtggtgtgtgcctgttgtctcagctacttgggaggctgaggtgggaggattgcttgagcctgggaagcagaggttgcagt

SEQ ID NO: 211413 - DNA, 558 bp, Homo sapiens
ggagggaggcagtcggtgatggagatgggagggaagaaatccaggcaaatggcgccggtggcctgaactacagcactggagatgaatgacggacttacatcaaggagggagactctttggggctgaactggtggggaaggcaggaaggacatggatgtataagtgggaaatgtctggggtgaaaccctaggtttggactttcgggtaaacaatgggtgcttttcatcaggtagggagtgagaaagggaaacaaatttagcaaagaaacagtacatgtcggctgtgtgcggtggctcacgcctgtaatcccagcactttgggaggccaaggcaagtggatcatgaggtcaggggttcaagaccagcctggccaacatggtgaaaccccgtctttactaaaaatacaaaaattagccggatgtggtggtgagcgcctgtaatcccagctactcgggaggctgaggcaggagaattgcttgaagccaggagacagaggttgcagtgagccaagatcacgccactgcactccagcctgggcaacagagcaagactctgtctc

SEQ ID NO: 211414 - DNA, 490 bp, Homo sapiens
ataacttttgtatttgaaatctgtgcttatgtaaatatatatattaaatttcctaccataaaaagagcagaatattaagtatctgataatttcaggcaatttatgattctaaaaatttcccagattatcactatgatcaccagtccacagcgttcagtaaataaatatatagatatggaaggtgtgattcgttgaatttgatttctttcaagcacagtataagagatgtcaatggatttgggagactaaatacccaatattagtttatcttcatatagtttttctcttccaaggggaatttttgaaattcactttttctgtctaaaagttagcttactaataatgaatataatccaacaaaagaaaagctagggaaattttcagttaatagatggttcaacataaattacgttctggttatttgaaacttaacaatgattctaaaaaagcattcagaaagcgaagtagtaatattggttgataacaaatt

SEQ ID NO: 211415 - DNA, 318 bp, Homo sapiens
cccagagctgattcgccctcctgtgtacctccggcctgtggaagccagccctattccctaataccttcgttttcctcagtggaccccttcagtctccaaccccagggttagagggggttcggacgagcagaggattagattccggtgggttaggggtctggagtcccctctcctggaagtctctccgcttgctcctgtggagacctaaggggtcccgcacccgacagagaggggtggccggcgggatttttcacttgtgtccttcccctgcggggaagggggcgagagcccctaacacaagcctgagtcttgggggac

SEQ ID NO: 211416 - DNA, 434 bp, Homo sapiens
atgtcatcctcaccacaatccagtgaggaaggtttaattgcttctactgtgcagtcaagggaagctaggctcaaagagaagcgaagcaaagggccttgtctgagatcacacctaggaaatggatttgtgtgaggaaagccgagctcctccccggtggccacactgcctcctcaagctgaggctccaactacagaagctggtgcagagcctcctatatgctcagaggcctccttcacaatattctatacccagcccctgctgcactgatgatctccccaaagaaggaaagagacccaactgctgccagccacagaatcaacttgggcaacatgacttccttcctaatcttaacaatgagggttgaactagtccaaagaccattagagataacaggcctgaggaaatacctggcactaatacattcacagaaatga

SEQ ID NO: 211417 - DNA, 452 bp, Homo sapiens
ctttgccttgtcatgtggggcagctgccttctgccagggaggtcaaagggccagtgtgacagtctttttgggtacctgcacttggtgcaacctgaattcttgtctggtgcccaagaggaatggggtcacgtggatgaattgaaggacggtgaatgcagagaattttattgatctgtgaaagtggctctcaggagagaagggagctggaatgctggaatggggatgggaagggaaggtcgctctcccctgaagtcaagccacctctctgcctctctcttctgaagccaggttgcctctttccaatgtctagctgctgtctccgaagtcaagttgcctctcctcaatgtctagccatttctcctctctactgaacctgcagtctttataggcacaggatgggaggtggagtgggccatagactgttttggaaaagaaaacattcaattggaaaa

SEQ ID NO: 211418 - DNA, 168 bp, Homo sapiens
ataaaagttgtgcaaagaaaaactatgaggttcttgcttcaatttatcatgggcttgaaagaacagtttgacagggcactgagctggcaagggtttgaggatattgtcagtgtctcatatttgctagtgagagtgtgaactgttggaatcatatatgaaatatttaag

SEQ ID NO: 211419 - DNA, 161 bp, Homo sapiens
gtattgagaagcacaatcgaaggttatatggtgggatgattggcgaatgtgtgtcctggttctctctgcataaaaccctcctatgacatcccctcttaaaaagataccagtttaggcttgagttgtatgaaagagggaatgtttctggtttcctagtggag

SEQ ID NO: 211420 - DNA, 320 bp, Homo sapiens
aactgcgaacaccactttactattaaagaaaatgcattaagcatgttaaatcaggtatgacttctgcctcattatgtgatagaaaaccaaaatcttcaaggttcagacatcgaacaaaaactagactctaggttgggtgcggtggctcacgcgtgtaatccctgcactttgggaggccaaggcgggtggatcacgaggtcaggagatcgagaccatcctggctaacacagtgaaacctcatctttattaaaaacacaaaaaaattagccgggcatggtggtgggcacctgtagtcccagctacttgggaggctgacacaa

SEQ ID NO: 211421 - DNA, 384 bp, Homo sapiens
tgtaatcccaactactcaggaggctgaggcaggagaattgcttgaacccgggaggtggagattgcagtgagctgagattacgccactgcaccccagcctgggcaacagagtgagagactggatctcaaaaaaaaaaaagaatcttaaagaggagactgatctcatggaaacgtagaaaagaaggatatcaaggagggagtagccagtcgtgtcaactctgtcaacccattagtgatggttgcaggtcagagatgccattgacaagagctgttaagccttgctttataaagaggatcagaaacgtgtaaatgttttgggggacaatcccaccaaggtaaaagatactagagcatgtctgtgtgctgctgaaaatgattcagtaga

SEQ ID NO: 211422 - DNA, 406 bp, Homo sapiens
tttgctgtgggtcctggcaggcaggtacttgggaaagtgcacaagcgggaaaggcatgcagctggccttaacaggtgcaaaggaaaacaggtgcaaaggcacaccctcttttcaccatgaaagagtgagaagaacacctgctaaatgaatgagtgagcatatcttcacccatcaagaattagatgggtgatcaaaaacttgaatgggtgattcttaacttaccaagcaggaaaagcacagtcattggtagagatgtcaggagagtttggggcaagaagttttagctgagggtcatcagccagaggaaaaccaccctttccagtggatgagcaaaagatgatgtgtttcttatctgttggtcacataagactagattagaaggatcaataataaataattaaatcaa

SEQ ID NO: 211423 - DNA, 885 bp, Homo sapiens
gtgatccccctgcttcagcctccaaagtgctgggattacaactagccacatttcaagtgtgttcagtagccacatgtggctactggttaccataaaggatagcacagggggataggacatttctgtcattgcagagcattctatggggcacactaatataggctaaaagtggcccagtagaaagaagaattcataagttatttttaaaacaaatagactgcttatttgcaagttaaacagtctttcagcactgaagaaagatactgcattagcacttgataggatgctgagatgattaaagatgtagtcccagccgggcgcggtggctcacgcctggaatccgagcactgtgggaggccaaggtgggcggatcacctgaggtcaggagttcgagagcagcctggccaacatggtgaaaccccgtctctactaaaaatacaaaaattagccgggtgtggtggcgcgcgcctataatcccagctactcgggaggctgaggcaagagaatcgcttgaacctgggaggcggaggttgcactgagccaagatcgtgccactaatccagcctgggtgacagagtgagactctgttaccaaaaataattaaaaaaaaaaaaaaagacataatccccagtcctccaggtgttttctggtgggggagatagacctgtgcacaggtacccacaacccaaggcagatgcgagtggtgctttatgaaaggtacaaagagagttattgcagaggtgactgggaaagccttgtgaagggattagaattctagtggggacaggtaaagagagttggttttgtgggtactccaggtgccagaaacagcccaaggaaaggtccaggtggaggcaggcagttgtggatttgtgatgagggatc

SEQ ID NO: 211424 - DNA, 410 bp, Homo sapiens
ctcttcccaaacttcccactataccaccagaccctgctgccaggcatgggcagaccattgactggtagcatagggagggaaacaccctgtgcattttgcttggaattcattacaaaattaaatataattagtggcattccaagcaatttgaacttcccagtggtgaccagcagggctaaagtaactgctgggctgttcctaaggcaggagtcagatcctcaggctgggagtgggaagtcctgggggctgtcctagcctcatgaccactggcaagccaccacctctctgggcctcagtttcctcacccatcccatccagcactagcatttagctctactgttaatccctgcccacagaggtaaccatgcattgcaaagtaaaacttacgataatgggaataattaaaaaaa

SEQ ID NO: 211425 - DNA, 373 bp, Homo sapiens
gggtttcaccatgttgcccaggctggtcttgaactcctgaactcaagggatccacctgcctcagcctcccaaagtgctggattacaggtgtgagccaccaggcccagatttcccctttccatcataaaaggaaatgctttccaccaggtttccatgatcagggcacacagagtaaattacttacaggattttcctttggggctaggtgcaccccatagtactttgctctaactccaatcctaacaaccaccagatggtatttgcctgcctgtgctgttaaggtttccagcacatggggaatgagctgttcacactcaggcatgagcttacagataccagagcccctcccttaatggtgttcccaatcagcttt

SEQ ID NO: 211426 - DNA, 992 bp, Homo sapiens
  misc_feature (704)..(704): n is a, c, g, or t
acatctcctgtggtctcttccaggatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccntctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaa

SEQ ID NO: 211427 - DNA, 1172 bp, Homo sapiens
  misc_feature (884)..(884): n is a, c, g, or t
acatctcctgtggtctcttccaggatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccntctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaa

SEQ ID NO: 211428 - DNA, 999 bp, Homo sapiens
aaactaatactgtttacagggagttaaacttctacagtgggattaaaggtctgtaccacgttagcacaaatgtcacctctctgttaatcataaaacagggtcacaggccaatgttcaccacaaggagacaggaggacaacctgggatgggtaatgacaaattcagtgtgatggaagttgttcacattatattattaaatgaaaaacaagtttcagagaagtatgcaatatatactgtcctcctattttttaattaaaaaatgatatatacccatactgtttttgtgtctatataaacaaagagtaacaactctggagttacctctgaagaatggggtagggtggagagattctcacatttcttttctttttctttctttcttttttattttctgagacagagtcttgctctgttgcctagcctggagtgcactggcacaatcatgactcactgaagcctcgtcctcctgggctcaagtgatcttcccacctcagacaccaagcagctgaaactacaggcgcctgccaccatgcccagctatttttttttttatttttggtataaacaaagtcttgctatgttgcccaggcttgtcttgaactcctgagttcacgcgatcctcccaccttggcctcgcaaagtgctgggattacaggcatgagccactgcacccggccacatttcattttatacattctttatcacgcactttattacatatgtgtaacaagtaatatgtatataaatctggaggaaagttgtattaacaacagaaggtaaccacagaaaaacagagctacaaatgacctcagagatacctgcgtcaaccctgtcactttagagatgaggaaactaaagccagagagactatgtctgatgtgccttctaagttgtgatgttctaggattgcaagttacatcctattggcttatgacttagaattctatttctaatccttcagcaaaatagcaggtagaatcctatggtatggttctttct

SEQ ID NO: 211429 - DNA, 385 bp, Homo sapiens
gaaaaaaaacctgttttgcccattgaactgtaacttacagcccaaagacagaccttacccatgggttattcacacaaggcttccctctgcccttgtatttaatgaaaggagcagaagtgaggggcacgtacggtactagacggacagtgataatagtggccaccaggattaagtccttaccatggccaggcatggtggcaggtgctgtaatgccagctacttgggaggctgaggcaggagaatcgcttgaatccagcagacggaggttgcagtgagctgcgatcacgccactgcactccatcctgggcaacagagcaagcatctgtctcaaaaaaaatagtaagtccttaccacatgtcagacgtggtgctaagggctggatata

SEQ ID NO: 211430 - DNA, 538 bp, Homo sapiens
aaatgcccaacagcagattaatgtataaacaaatcacatatatacaaacaatggcatattattcagccataaaaaagaaatgaagtgctaatacctgttacctgttacagtgtggatcaacctcaaaaacattatgctaagtgaaagaacccagacaaaaaaggtcttagattgcatgatactatttatgtgaaatatggagagcatgtaaatctatagaaacagcagactgatggttgtcagaggctagggggaagcagggaggagggaatggaaagtaaccatttaatgggtatagagtttccttttggagtaatgaaaatgcttttgaactagaggtggtagttacacaaccatgtgaatgttgtaaatactactaagtgctcactttaaaatgattaattctatgttaaatgaacttaacctgaataaaaaaataaatgcttatgaaagagcttagaattaagagcaaaaaattttgaagagcaaggtagaagagcccacactatctgatgtcaagatatatctaaaggctata

SEQ ID NO: 211431 - DNA, 622 bp, Homo sapiens
aagaatacaagttacatggctctaacttggctccaatttctagctggtaggaagtcaatccttttacctgttttccaaagtctatgggtctgcctttagttggaaatacagaatatagaagctattacagaactcggggtcttgaattactgtccaactcttcacaaaattccatctgaaagaagtgatatttaaggaagactgtctaaggggtatgatataaatccatgcccctgcatattttaggctccattttctagcagatcacctgaaagctacacagatgtcattagctcagctcctcacagagtggttttcactaagttgcaatttcatgtaaaacatctgcattttgtctgcagtctctgtgagagctatagaaaaccaagactgcataagcactggttataaaaatagcaaggaaactgtcgctgtagtggtaaaaacaagaaaaaaataaataaataaaacatacttcttggtttaaaaaaagtaaaaattactattatatcattcaatattgccttacatatccatataaatttcattaaaacatgaaactcatttaaataactttgtcctttgagaaagtggtatgttgactgccaaggagaaggccatt

SEQ ID NO: 211432 - DNA, 243 bp, Homo sapiens
cagaagtctgaggatactgatcaaagcagaaaaggataaacattctttccttccccagttttgcctccagcatgatgcacaccccatcatatgtgtttgcctgcgtggctgtgggcaggtgtgcagtccacaagtgggtcatccacaagtgggcagcagacacatgtgcgtacagcttactctctctgccttttttgtaagctgggaaatctttctatgtgaattaatatatgctgtctatct

SEQ ID NO: 211433 - DNA, 404 bp, Homo sapiens
tggggctgagttagcaggctttagatcctggcttcatcactgacccgctttaagaccttcaaaaatttactcagcctctcttgcctcagtttccttatctttaatgttgggtgataataacaatagtacttcctttaaagggtcctgatgaggattagatggggtaacttgtgtaaaaatgctaagccccaaatcttttacacattaaatgccccatgaatgctggatgtaattgttactaagttaaggcccttggaatggaaaaaagccttgtgaccagggtcaggggcatgaaacagtggtctggtctttagtattcatgctctttaaggagatatatgagatacaggaagagagaaaacagacacctaaaacttgtaagaccaaactgaagaaacacacca

SEQ ID NO: 211434 - DNA, 254 bp, Homo sapiens
cctaaacttaatgcttgtcaccagttccttgactgtttactctccacatatcatgctgttctattcttccatgatacaagatggaatagaaagtgcagggtggccctcctggaacacaacatcatgctgtgtccagcactgcccagaacattttattcctctcaataggttgatgaaagaatggagtatcagatcctttcttttgctgacttttgacatgttggtttccttaataaaaactgcatctcacactc

SEQ ID NO: 211435 - DNA, 247 bp, Homo sapiens
ttcagacgctgaactatgtgccaggcagtgggatgctacaacgtataagatcatgaagctcacagtctcatgaagctcagtccattggggtagggagggcagaccatcaacaaatacactgcatggcagccagatggtgatcagagagcagtggagaaaaaggaagctgtgtgtccccaggaggcttccagcttgtttgggcatctgcaggtcaagtccacatagttcagcgtctgacgtcccctga

SEQ ID NO: 211436 - DNA, 578 bp, Homo sapiens
aagcaaatacccacctcttactcaggacaccccagtcagtggatgccttctctggcccctctcccgtcctgttcttggaaaagcagcctactttctctgtcctgatcatgcaacaagttgctctgaaatgaaccagcagcttgtggtgggaataaaagcccaggaaaaggaatgcagaaggaaagtgatggaacggcatgaaacccaaagcaattgataaaaatgagcaccacatggagaatgtggaaaggagaggcaagcataaaaatcacaaccacatctgacatctctagaaatggagagagacaaatgaaatctcacatgtggctttcctcaagtcagaaagattccgcttctccattcaggggcgggatgaaggagcctctttggaagccgtgggcctttctcaagttgttctaccacgcctttcatttctcccgcttcagccagtaagttcaagtgcttagagaaatgcttagcctctagcaccttctccaggcacaaaataatgggttgaccaaattgataattttttttttttttgagatggagtccctctttgttgctcaggctggagt

SEQ ID NO: 211437 - DNA, 444 bp, Homo sapiens
ggggacgactatacacgatgttaaatttctgctgtgtttttcctggagtcccgtctcagtttctggaacaggttatccgattgctgatgagatatttctgttattcatttttatttatcccaggaacactaactctagctgtgagtatgttttcccctccaagagaaattaaatatccctttcacattaatttcttcctgtttcatgtatatgtaagtggatgcatatggtaggcctgttgtgctgagaaatttctaagtataaactagtccacatagttatgagactgaacacctgacttaatagatgttccataagaagaactagggaaacaccatgttatacaagcaaccttaggaggtatttaacccagtcctctcaatccacagataaggaaactgagttcagagatgtgaagtgacttgcccaagattgtgaccgttc

SEQ ID NO: 211438 - DNA, 326 bp, Homo sapiens
atgctgctcatcctttgaaaaactgttggaagatttacagcaagggtcagcactttttttctatgaaaggccagatagtcaatattttagggtttgttgcctatgtatctcaactactcaagtctaccattgtggtgctaaatcaaagctagacaatatgtgtatgagtgagcatgactgtgtcacagtgaaactttatttacaaaaacaggtgtgaggccagatgtggcctgtagactatagtttgccaactgtggatttacagtactgtacatggttgtagtagtattgcaataccttctttaaggggatctggcctcccactt

SEQ ID NO: 211439 - DNA, 363 bp, Homo sapiens
tggggtgctcccaacagttagaggttgaagagctgaagaggaaccagtaaaggggaccgaaaaggagcagccattgaggagagaggacagccagacaagtgaagtgatccacagctacatgaagacagtgccaaggaggaaggagaaatgagaaatgaaaatactactgagaggttgagggcctgggctgagactggaacacaggatatagcagcatggagatcatggtgacattgacaatatcatgtcattgattgggtgggggcacaagcttgattgaagctggttcaagtgagaataagagatgaggaaataaagataggatatacgtttcttgagagatttttgctgtggggtgagagg

SEQ ID NO: 211440 - DNA, 186 bp, Homo sapiens
atcaattcccatggctttaacaacttaaccttctgaccactccaaaatctaccttcagccctactctcctaaatcccatttatttttagtcaaagcctttgctattaattttctgggattcccctagcagctcaaacactgttctcatcatcatcttctttaaagatccacttcctggccaggtgt

SEQ ID NO: 211441 - DNA, 310 bp, Homo sapiens
tgtttgagtgaaactatggttgaatatttatcaaaccaaacatttgagcactgcaagccctctattcaccaatcacctctccttcaattgtctgtgcagtatccaggatgccttaattcaggtcaatctctcaattacccccagttatgagcccctactttgatggaaccagttgaggtgggccagcattttgaagagttggcatctccctatccttacttcttcactgattctggctcaggttctctgcttacccaaactaaacttgacttcacttctcataatgaacttcctgtatttctgtcacgtt

SEQ ID NO: 211442 - DNA, 468 bp, Homo sapiens
ggacttccccactaagagaccacctgtttttcgagcaggagttatcaccattgccaccttggtggagaataagaaggctcagctggtggtgactggacatgatgtggatcccatcgagctagttgtcttctgcctgcccccagcctcagccgcctcatctggaaagtgggtgatgataggccgggtgtggtggcttacacctgtaatcccagcactttgggaggccgaggcaggcagatcacgaggtcaggagatcaagaccatcctggctaacatggtgaaaccccgtctctactaaaaatacaaaacaattacccgggcgtggtggcgggtgcctgtagtcccagatactggggaggctgaggcaggagaatagcgtgaacccaggaggtggagcttacagggagctgagattgtgccactgcactccagcctgggcgacagagcgagactctgtctcaaaaaaaa

SEQ ID NO: 211443 - DNA, 698 bp, Homo sapiens
gaataagaaatagcttgaaagtacagagattgctgatgtcacctgaaacttacttttaatcaaaagcatctttctagaaatagaagggcaattatcacaggtggatctggggtatctttcccttggcctgagtgtgaacatcaaagttagagaaaagaagttcccaatgaagacctcctcaagttgttatacatttggggattccatgaaaggagatggtgcttcgctctggaaattggtaattaacactatatatctctactgagaaatataccagacatgtatagctgctcctcagaatcagtaaaaaccataaagacattatcatcccctcactgagcactcactggctattgatttgctaaactggtctttagtttgccaatgcttagcttccttccggttactagttcaagatcctgctgttgcagagaagctccatttcatatctttatagcagtgaaaagtatcacctaactacttcctggttcagatagtgatgggtgtttcaagcatccaggcattattatcaccttcaatccccaggatattttacagcaagtaaagccatacctcacaggaggttcataatttagagcctcatttagttaaccatttccctgttacatacatatgtatatggaccagagctctcttcatagactccattcttctttaatctgactcagttctattct

SEQ ID NO: 211444 - DNA, 475 bp, Homo sapiens
ctaatcccttggaatttcctatgtaataggaaaatcttttgttctaatgaggcaactcttgatgggctcttgggtggtggctggccaccagaaagaccaagctatgactagttgtctggaacttgcagcacccctccccatcattttgataggggctggagactgacttaataatcaatcatgctgggtccactggcttacgcctgtaattccagcactttgggaggccgaggtgggaggatcgcttgagcccaggagctcaagaccagcctgggcaacatagatagtgagaccctgactctaaaaacaacaacaacaaaattagccattcgtggtgctgcgggcctgtggtcccaactacttgagaggctgaggtgagaggatcacatgagcctaggaagtggaagctacagtgagctaaggttgtgccactgcactctccagcctgagtgacagaacaagaccttgtctcaaa

SEQ ID NO: 211445 - DNA, 506 bp, Homo sapiens
ttttttcctgggaatttgaaatttgtactggagatataccaaactggtagtcatcaattttgaatcatatgaatgagaacagtttggaaaaagttatgtgaggctcagttgcttagacctctaaagctgctttgtatctgcccttcttaggtattatgtactcaaaactctcttggagtctgtgaaatggcctcaataacttacaatcaatgttacttctttctcaattatttagattttgttttatttatttttgatagggtttgttctttgatttacttgcaaccaaaaggaaaaagaaaatagtttaatactactagtcagcaatgtttactgagtctcccctagagctagtgtaataagtagtagtctcagaaaaaagcactaacactgggattttgataatttataatctatttcaaatatctgactgcagacaacacttgggtatatttaaaaaatgatgaaataataatttgataataccttaattcatcttatagaat

SEQ ID NO: 211446 - DNA, 484 bp, Homo sapiens
agtttatacggttctacttattttaatatgataattttaattaattaattttttatatgtttgagacagggtctggctgtgtctcacactgtttcctacgctggagtgcaatggcacgatcatagctcattgcagcctcgacctcctgggctcaagcaatccttctgcctaagcctcctgagtagctgggactaccggcatgtgccaccacacccgactaatttttttgtacttttagtagagacagggtttcaacacattggccagggtggtgtcgatctcctgacctcgtgatccgcccacctcagtctcccaaagtgctggtattacagatgtgagccaccgcgcctggccgatttaacattttaacttactaaaagatttttattacattattcaaagtcaacaaaaagttagcaatgatactggcttaagaactacttttaaatagtctaattaatttcctaactaaaataattgattt

SEQ ID NO: 211447 - DNA, 499 bp, Homo sapiens
ggtcggtcccctcacggattactcaccataccctgtaatagatacacgtcacgactaaggcagctcgtgtctcctccttcaactactaggtgtctgtctcacaaaaacctactcatccttcaaagcttaacttttagcagtcacttctacaaggcttttccatatattttcttatcttaggatataatttacctataccagtggttctcaaattgtggtccctaaaactacagaaagagcatcacttgggaacatgttggaaatacaaattctgggtcaggagttccagaccagcctgaccaacaaggagaaaccccgtctctactaaaaatacaaaattagctgggtgtggtggcgcatgcctgtaatcccagctacttgggaggccgaggcaggagaatcgcttgaacttgggaggcagaggttgcggtgagccgagatcacaccattgcactccagcctgggcaacaagagtgaaactctgtctcaaaaaaaaaaa

SEQ ID NO: 211448 - DNA, 464 bp, Homo sapiens
caggagagtgatgcaagtggcagtgtgatcctgaacttggaggggactcaaccgaactgaatcactctgaacccagctcagttgctctagcttctgagtacactcaggcagtgtacccacaagtcaattccacaactgccagggtgttgaagaaagccctggagcagtactcagggtttgggaaactgctctatgacattagagttgttttctttggaaattaaatcttattaccaaagaaaagaacctctctctttctcaagcacccactactgcaccaagaatcttctcctttcttagcttaaactgtttattcttttttatttgtattttttaagagacgggtatcaggccaggtgcagtggcttacgcctgtaatcccagcactttgggaggctgaggcgggcggatcatgaggtcaggagttcaagaccaacatagtggccaacatagtgaaaccctgt

SEQ ID NO: 211449 - DNA, 574 bp, Homo sapiens
tacaatttctcaatcccaatgccctctccctcaaacatgccccaacttcgcaggtaaccactactccaggattggagttggtcgtttccactgtatttatttattcattaaaacacgttgggcattcacaatatacagtatgatttgacatgtcacaaaaataatttcatactgcctatatcattcttcaacttgctttttgatattatatttctaagctttaattctataaagatggttctgtttcattcattgtagctgttgtacagtgtgccattgtataaatataccacaatttatccattcttccagctgacaaaaattgaggctgttttcaattttttgctgcaatgaacattctacctccacctgcatgtgtaagagcttctctaaaaagcaaaacttccaactcataaagacatacaacttcagcttgacaagatagtgtaaaactgttctccaaatcaattgtaccaattagtacttccaccaactgtataaaaaaagtccggctgggcacggtggctcacgtctgtaatcccagcgccttgggaggccaaggcaggcagattac

SEQ ID NO: 211450 - DNA, 148 bp, Homo sapiens
ttttggtctgacagttgtgagagggttaagaaagtcaatcattttgtaaccaggcacagcaatcttgtatgaaccatgtcaggatgttgtctgcatgccgtctttgctgatcacagtaatcgggtcataagagaaagggaagtaatag

SEQ ID NO: 211451 - DNA, 404 bp, Homo sapiens
tgtgatgggtccagtagtttgtgatgggtccccaatatgcttccccagcccagtagtttgtgatgggtgtagtttgtgatgggcttccccagcagagacggacccatcacaaactacccagtaattgtgatggttttaaaataccctttccaccaaaggtggagttgaattcccccctcttcccttgaatttgagctaaatagtgactcacttctaataaacagaaagaggctgggagacttcggtagctaggttaggaaacaaagcttcttttttttttctttttttttcctgttaagacacatcgtgacagacttaagccaatgaattaggagtccagttaccatgaataggtagctggaaagaaaatatggagagaactccagagatgtgagttcttccag

SEQ ID NO: 211452 - DNA, 289 bp, Homo sapiens
ttggctttttaactgacaagtacaaaatgtatatgttagtacagcatgatattttgatatatatatataaaacagaatggctaagtcaagccaactaacatgtattatctcacagttaccattttttgtggagagaatgcttaaaatatactttcttagcaattcccaaggatgcaatgtattgttattaactgtagttaccatgttgtacaatggatctcttagatttatttctcctgttaaattaaattttttatcatttgaccagtatctcctcaacccctccacc

SEQ ID NO: 211453 - DNA, 490 bp, Homo sapiens
tgcatcagagctccccttgaaggcaggtgcgcagctgggctccacgttggagggcaacagcagagctgccacttatagccggtctttcaaccctgctgtcccccagcccacccacaatggctcaaaaggctggtcttctgagaaagacttgctgctagccaatcatcacagtcactttccagttatgttaagtggcatcagagcattgattagcacttacggtatgcaagatatggtaggaggaaaagggaattatagacagaaaccatgtgaaagtataaaagtcactgatagactagatacacgaatgagaaacaaatcaagcattatcatcacagaaaaccaccaaatcgcaaaagataagaaagggatcaggcatggtggctcatccctgtaatcccagccctttggaaggctgaggtgggagaactgcctaaggtcaagagtttgagaccagccaaggcaacatagtgagaccctgtctcttatt

SEQ ID NO: 211454 - DNA, 619 bp, Homo sapiens
aagaaatgaccccagatgggctggaccacagcgcctgtggggcctggtgaggagggaacggatgcgaagatcagtggttctcaaagtgtggttccagcaagcagcggcaacatcacctgggaacttgttagaaataaaaatgttcagtccccacaccaggcctacaggatcagaaactccagggttgaggcccagctgttcgtacataacaagcctgacaagtgatgctcatgcatgctaagttgggaaacttctgctcttgatgtttagaaggtagaatcggtcggatttctggagtactgggatcatgatagggacactcagtggtagaggtcatcttcactgagacagggaaaatgggagctatagcaggtttgtgtaaacgcagtgatcagtttggttttcagcatgttgagtggaaccgtctaggaggctgttgggtgaacacatctgtcctgcagcaaagggcctggctggacctggggactttatagagttgtcggtgtgtaggtggtggtgcagtttgaagggtttcgccgagttaatccaggagagtttagacaatgagaagagcagagggccgagaagcaaagccggcggacacgaggcttggggtgaa

SEQ ID NO: 211455 - DNA, 304 bp, Homo sapiens
tgtgggtagcacaacataaaatggtctaataagcagataattatatgttaaggagaaggaggcagaaaaaatatttacataagtaatggctgagagctttctaaactgatgaattctgtaagcacacagatccaagaagttcaaccaatctcaagcacacgaaacataaagaaaaccacaccaatgcacatcataaactgttcaaagccaacaagagaaaatcttaaaagcagccagagaaaaaagaaatattacacacagggaagcaaagaaggctatcagatttattgttgctaccaattca

SEQ ID NO: 211456 - DNA, 601 bp, Homo sapiens
  misc_feature (19)..(19): n is a, c, g, or t
gtcgctctagaggatcccnatatatccggccttcctctgtcatggggatcagcaaactctttttttttatgtgtgtaaagggtccagatagtaaatattttaggctttcagggatcaggatgcaatattgaggattttgtgtaggtatttaacataacaagagagaaaacatttacggagaatttttactgatgaaattcaaaatataatgacaattattgagtacagttttttaaaatacacatttgctaatgagaagaatggattttgtttcagggggcataacattttgctgaattggagtacaaagttactgttttctattatcaagtcagttatagatgtttgtcagtaaaaaccattcttagttctcaggtaagagaaaaacagatggcagacctgatgtggactgcatgctatagtttgccaacccctagtcagtagcatagctctggtgatgttagttttggtgtggaaagtgtaaggacgtggtatggcccaggaccccatgttgctctttgaatggctgggaaggtgtttgaatgccacaacactggaattttgtgtatttaataaatagtggtagagaggccaggcaata

SEQ ID NO: 211457 - DNA, 850 bp, Homo sapiens
aagagaagtcagagaggaaataagggtctaaataatataaggcattgtaaagacttggtatttactctgcatgaaatggggagcctgtcacaagttgggttttcccaggaaacagacccagaaacaaagttaatcttgtagaaaatttattaagcagcgcccttggggtcaatacctggggaagaaatgggaaagcagcaggagcacaaagaaaatgaagctctaaaaagactcagttacagtgtcaaccacacccacaggaagctgtggaactagaatggcccttcagagttggggtaatatttacaggcctttcaacccctacactaatccgtctttggatatgggctgccccaggaaggggtgttgcattggacaaagttgctttcagcagctgaggcaatctctaatgggggtgagagctgaagcagcataataagtccatcactgaagcataacctgggtgttgcatcccatgtccacaaacccactgtggattttcagcagagaattgacctcacttatgtttctaaaaaaatctctctgctgttttaaggacgggctataaaggagagagtgaggaagcagggaaactagttagagtattgcagtatcccatgtgtgagattatatctgagaggtaacaatggagatggtgagaggtatttacttcggggaaattggacggaacgaataaacttccccaattgacggaagtcggacaaaggacggagggcccaacagcggaaagggccgctagaaaagcagggagaggccaaaaggcggacaatggcacattgaggggacaaccgcaacgctggaacaggggaagcgcagaaccgggcacagc

SEQ ID NO: 211458 - DNA, 339 bp, Homo sapiens
acagccagctaattttgtatttttagtagaggcgaggtttttccatgttggtcaggctggtctcaaactcccaacctcaggttggcctcccaaagtgctgggattacaggcgtcagccaccgtgcccagcctattggatagtcttaatggaaaattagagctgtcaaaagaaagagtcagtgaacttcaaaatagatcaattgaaattattcaatctgtagaacagggagtgaaaggatttttaccgaatgaacagagcctcagtgacatgtaggacaatttcaaatgggttaacatacatgtggaacactagaaggataaaagagtgagaatgaagca

SEQ ID NO: 211459 - DNA, 251 bp, Homo sapiens
cctatggtcagtgagaagccagtgagagtttttaaaggagtaattatctgaacacaaccccaagctgtcctgccttcactgtgagttgatggactaaatgtcttcctattgtaatgcatccatttcataggcttggattgagctcttcctgcttatgagcacttccgaaggcaggcgccatcttggtgaacaccctgtatgttatgtgaggggccatgctcccaatagtgtgtgcatgtgtgccctctgct

SEQ ID NO: 211460 - DNA, 232 bp, Homo sapiens
acaaggtgtttactgacctcagaccatatcccaggaaatcctacttatataaaactcctgatatgaatttattttcttgtgttttgctttttctcttaaaagctgagtgtgtaggcagggcacggtagcccacgcctgtaatcccagcacgttgggaggccgaggcgggcagatcatgaggtcaggagattgagaccatcctggcaaacacagtgaaaccctgtctctactg

SEQ ID NO: 211461 - DNA, 346 bp, Homo sapiens
tctgtacctcatgaaaatatttttccaaaattaattcaatatatttttcaaataaaagagctaaggaaatgttatcaccagcagatctatagtagaaaaaatgtgaaaagaggctctttaggtaggagaaaaattataccagttccaaaaccatattgggacattctatatcatacattggaacattatacaaaaataataacgatgaattgtgagccttaggacatatatggatataaatgcatgacaaagagagggcagggataagtggaaatatactgttgcaaggttctgatgctatacttgaactaatgtaatattattttaaggtgaagcaaccactaaa

SEQ ID NO: 211462 - DNA, 421 bp, Homo sapiens
cagcatagtggagacggagatgtaagaattgaattggaaaaatacatcagggtttgctcaataagcattaaagccttagggaataatactccttagaaacaggggcatcgtctgggcgcaatggctcccacctgtaatcccagcacttcgggaggccgaggcaggcagatcatcaggttaggagatcaagatcttcctggccaacatggtgaaaccccgtctctactaaaaatacaaaaattactcaggtgtggcggcacatgcttgtagtcacagctacccgggaggttgaggcatgagaattgcttgaacccaggaggcggaggctgcagtgagctgagatcacgccattgcactgcagcctaggcaacagagtgagactccatctcagaaaaagaaagaaagaaagaaagaaagaaag

SEQ ID NO: 211463 - DNA, 695 bp, Homo sapiens
cctgtttgttgtggtgtggagccaggtggcatgtgtggcgatggagtcacggggcgggtgacagaatttatgccagattgtaaaattcctggtttaagtttcccctggaaaagtttcgtaaaggttaagaaacgtgtctgttgaggtcctttaaaagccggtgctctgctgggagtaacgagcaaacgtttgttttagcatctacggcttaagcttccatagagaagtcggtatctcaaagttgcttgaaacagaaaaggacaaagaggttggtggaatagggtaacggataaggttactcttaaggaggttttagagagctttccccagttttaggagatgattaatggtcatgaaagtgtgtaaaatatacatgctattgaagttgcaacgaaagacataattactgtgcccctttagtgttttcaaacattttccagatctcacatcctataattttagagttttatcatctgaggcagaaacaagacgactggaatctgatgaccaggcagacttttaaacaataggtttaccaaaaaactggaagccctactagtttctccaacctgttgttgctcagtaaagagtgcccgaggccgagcactcacgcctgtaatcccagcactttgggaggcccagtcgggcgggacactttaggtcgggtgtccgagaccagcctgaccaacatggcg

SEQ ID NO: 211464 - DNA, 573 bp, Homo sapiens
aactcgtcaaccactgatttgttaaatgatcgtcttaactgccatatataaaatagtggatgaaaagaattttaaaaagtagaaattttaagtatatagttagtctttgtataatttagcagcaaatatggatgtacaggtagaggtgatagaccctatttctacaattggtcataaggctctggctggtatttgcagtttaaagaaattataaactaaaagaacattctttccaagtttgtaacgaaaaattaagaagtcagttgacttttcttccaaagtattttcatgtcttccttgaaacgaacttgctttatcttagcatgtcttgagaagtactgttatttatatggtaaagccatcattttgtctggatttatagtgtgaagagtcactaatctttttactatcttaagaccaaatgaacacaacttcagttattgctctatgaaatctgtgatttcttctaggcatctactcagaaacaagggagaactgaccccacagttctagggcccataatacattcagccccccactcaacaaatatttcaaaaattttaaattttcaaa

SEQ ID NO: 211465 - DNA, 431 bp, Homo sapiens
ttaagatttgtcttcttgctgatttcacttcttgctgacttaaagaaactattacctcaatccagttttaaataaaggtcagattagaaaagcataaacttatttaaatgttattttacttcccccattattcccaactttgtagtgtatttaggttacaaaaaatttacaaagtcttccttggatctttacctacttaggtgtcccctcagctctcagcactatctaaataaaatagttcacttctctgacagtgtcaaatcttggttctcctcctctgtgtacatcactgcttggaaatttttacatgcttttcctacttgtcccagagtttctttctctccaccagccctatacttctgtccaaagtgtacaatacttttcaagtatttacctggatatttaggaaaaataaaaccatctctttaggt

SEQ ID NO: 211466 - DNA, 467 bp, Homo sapiens
gcttgtcatgtgcttttcattctgtattgtcggtcacatgctgggcacaaactccacacttggagaataaatagaatgtgagcacctcctgtttgagaaactggcttcacttgtttttttaaaaaacataaagaagagacttaaacacatggaaattgtaatgatgcagggatctgagaaaataatgtacgggccactaagaactcatagacagaagatgatgactgattttcaatgcgctgactcaccaggcctttacagactgtaaaagaatgaaaagatggaactcaactgaagtcttgctcaaaacagatgcagggggcctagacaatttcaatgaggcagagatctaatacacagtcattctgtcaggaaatgattaaagaattctggttaaaaatgcaacaaatgcttactgatttaattaaatctttgggtattttactttataacttttagcttccaat

SEQ ID NO: 211467 - DNA, 411 bp, Homo sapiens
agggtttaaaaacataggccccacccttaccactttgccatgtggtgagacacaagtcaaaaatgtactaattacaaatgaggaagggaacaaatgaggccaatagcaccttcttggcttacacaatttgagctagtctttaaatataggttgagaatctctaatctgaaaattccaaatccaaaacctgaaaccttattagcactgacatgatgctcgaaggaaacagtcactggagctcttggattttggatttctggattaggaatgctgaatcggtaagtgtaaggcaaatattccacaaatctgaaaaaagtccgaaatccaaaatacatttggtccctagcattgtggataggggatattccacccacgtcaatcgcctcatcgtatgattcccaaagagggact

SEQ ID NO: 211468 - DNA, 892 bp, Homo sapiens
gtatcagggttatttgtggacagtttagcaaagttctctgtacttcactatacttgcagatgttttataatatatgagagtatattttcctttggatgctggtctcaaatgatttttttgacttatcgagagagacaaaatagtttaaatgggccatcattttatgaatcagtcattagagaggtttgataatcttctttaatgttaaagtagttcaggctaatcttaatacatgtatttttattgctgaccagtcttgaatatatactggtttgatgattgatttgcccctctaaaaaaatttgaaacatatgacattggctgttttagataatactttgtgtcattaatcatttttgtccaattttacaaaatatatgtcaatcttgaacatatattactttataatatatgttactttataatatatgtccaggtgaactcttaacatatttttttcagtgaactctgttctcttgtgggttacagtttactttcattaaaaatggaataggatttcttatatatataaaatataaaaaatatgtggcaccaccattccctatttatattttagttgtgatttaaaaatgagatttgactaaagcatttagcatacatgatcatccataatatgtgccctactccttaattcttactggttaccttagaaattttaagtttgactgacttctttagaaaaatgtacgtaaatcacagatgccccaatgtggtattgaaagcaaattaaaaattttaaattagggccaggcacagtggctcatgcctgtaatcccaagtgctttgggaggcagaggtgggaggattgcttgaggccaggagtttgagaccagcctgagcaatatagtgagactcctccatctacaaaaat

SEQ ID NO: 211469 - DNA, 623 bp, Homo sapiens
ggcaggagaattgctcccgggtgggaggcggaggttgcaatgagccaagattgtgccattgcactccagcctgggtgacagagcaagactctgtctcaaaaaaaaaaaaaaaaaaaaaaaaaagaaagaaacctggtaggcactgctagagacaaaaacctaagagagaattccaacaggaaggggagatctggccgggcgtggtggctcaggctcactgctagtggaatcccagcactttgggaggctgaggaaagaaggtcacttgagtccaggagttcatgagcagcctgggcaatacagcgagaccccgtgtctacaaaagattaataaattaacaaataaaaaataaagagcaaggggaatccgaaaagcaggctcccaggaggcaccagctttagacgtgccttgtggcaagtggggagagctgatgaaggggagggtgcagctggggtgggactgtcccgggggtgctaacagccatgtaggagtgtgtgcccacgaaatagttgggaaagcctcgtgggaggcggggagagctgcgcaggagaactgggagggacagctgcgcaggagacatgggggtgagagctgagggggagagctggctggcagagctgggt

SEQ ID NO: 211470 - DNA, 575 bp, Homo sapiens
ggcaggagaattgctcccgggtgggaggcggaggttgcaatgagccaagattgtgccattgcactccagcctgggtgacagagcaagactctgtctcaaaaaaaaaaaaaaaaaaaaaaaaaagaaagaaacctggtaggcactgctagagacaaaaacctaagagagaattccaacaggaaggggagatctggccgggcgtggtggctcaggctcactgctagtggaatcccagcactttgggaggctgaggaaagaaggtcacttgagtccaggagttcatgagcagcctgggcaatacagcgagaccccgtgtctacaaaagattaataaattaacaaataaaaaataaagagcaaggggaatccgaaaagcaggctcccaggaggcaccagctttagacgtgccttgtggcaagtggggagagctgatgaaggggagggactgtcccgggggtgctaacagccatgtaggagtgtgtgcccacgaaatagttgggaaagcctcgtgggaggcgggggcagaagcaggaagcagccatttggcagaagcaggaagcaggcagaagcaggaag

SEQ ID NO: 211471 - DNA, 371 bp, Homo sapiens
ctcacccccgtaatcccgtcaatttgggagacctaggcgagcggttggcgcttgcctgtggtccaagctactcaggaggctgaggtgggaggatggcttgagcctggaggtcgaggctacagtgagccgggttcgtgacactacatgccagcgtgggcgacagagggagaccctgtctcaaaagagacttgacaactaaatgcaaagcatgatgtttggttggaaagagaattttgttagaaagcagctatgagggatactatgggaccatggggacaatcggagaatgtttcatgtgatcatacagtagaaaattgtgtggtctccatgttacatttcctgagtgtcatggtggcattaaggttttgtgg

SEQ ID NO: 211472 - DNA, 383 bp, Homo sapiens
caattaaagccgtcttccctggtaatgctcttcgtctcagtcagtcattggctttctgtgcggccagcagcaggacgtagaccaaacccttggtatttcggtaacaggcacacccccaggaagggaccccggacacggctaccacctctaggcttaaagcgaatgcacttcccgcatctccagtcttccgtgtagcagctttaacctatgtatgtctgtgccacatccagtcctcagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttcc

SEQ ID NO: 211473 - DNA, 425 bp, Homo sapiens
ccttaggggtaagggatgaggagttagtatttataaagtaaaaattaaaggaagaggaagcaaattctcccctctatttccgtgcctcagagataagcttttgctatatcttcaactaggagatttttctggggaaaatctaaacttgtaacattattgattgaattttcccctattgatatacattggagatttccctgttgtttgttattacaaactgtgatacagtgggcatttgtgcacaaatattcttagacatttgctgcaacagttgtaggacagtccttgaagtagaatttctgaaacataatgcatgggtatgtgtattttatccagataatgataaattactctccgccaaagttgtcagattaacattttcaccactattatataaaggcacatttttctgtactctaacacta

SEQ ID NO: 211474 - DNA, 447 bp, Homo sapiens
accatgcccggcctgggtctcatgttttttacagtgcccaaatatagagtggcacatgcaatgcatatatcacaaacacagaaatgtgtttttggtttcatgaacgtaggtcaaggatccatttttctagcactgagttttaagggtaagagttgaatagtgactaatgatcatacttacctcctaaaaacaaaatgctgacgaacaagaaagggattgagcaaggggacctcttcaagtcagagcctgccatcagccccagctggacctgacaatagccttacacactgatgtccctcgaaagattaataaacaaagatattgggactaattcggcacgaggaacttctcactctttatccatgaaacgccgcatggcacagctgctaggggtcatggggtgacagttcatctcaccaaggagttccttccaagaagtgctgctgt

SEQ ID NO: 211475 - DNA, 92 bp, Homo sapiens
cacttccacagcttgagcacgaggagggcaattccactgaactgggccactaacttgggcagggctgcagttttgatggctctgggggctgt

SEQ ID NO: 211476 - DNA, 623 bp, Homo sapiens
actattgtttgccaaacaagagccatgttcccacctcaacattttccaggctaacggaatccttatcttcctcagagtcctgagcccttctagggggcgggcgctggcccctctttggccccaggatgtgaatctctgttgcttaagtcaaccacgatgctctcattcgccttcagcaatgaccctcttaggcctggtcataggatgcccagccagcccaggactcatgaggtggcctctgcaggaggacatgtggagaagggtctcctcaccaggaggaggaagcacgtggaggaagtggtttttttctgagacattatcttacctgcacacaatgcctgtaactatgtcctccctctatccaccaaagacggcagagaagaaagagggaaggaacctggatttaagctatgatgttactgagttagccagtcctggagttttctacctctgccccccttgttatgagacacaatgaatattcctactgttttagtcacttgcaggagggtgtcctgctgtacgtagctaaaaataccctatctaccagctgggtgtggtggtgcatgcctgtagttcgtttctcaggaggctgtggcaggaggatcacttgaacccaggag

SEQ ID NO: 211477 - DNA, 322 bp, Homo sapiens
cattaactacgataaaagctgtaaatgactcagcagtgggaactgacaggctactgtgctccagcgtgcaggatgtctgtgtgatgtgatgcatgtgtttgcaatacaaggcagcccacccccaaccttccgggcctgcagctgagatcaactgtgactaacctgattccaaaactagctgactcatttcattgcttcctgtttctcttattatactttgaagtgttttcagtgaagagcctagcactctgcccagtgtactgtaagtgcttggtaattattggttatatatatatacacacatatatatatacatttatta

SEQ ID NO: 211478 - DNA, 645 bp, Homo sapiens
taaatcttcacatcccctagctagataagtgccattattaccctcattttgcagataaggaaactaggcatggagagatgggcagtaaataaatatttgaggcatgaatgaatgagtgaatgagtgttaagagtcttatcatacttcaagttgcagaaataaaaacaataactgcaaccccttgagtaccaacaggaggctaagcacaggatgtgaattaggattctccttgaatcctcccgaatcctcccgatgaggcatatacgattcattccagtttaccagtaagggtaattgaagctggcacaggtcaggtcatttgccctgcaaactgagaggtcccagacttaaccccaggtgcgtctgactccatagctggcaatcctaatccttgaaagctctcctgcttccgtgcctatccaaaacaccaccgagaaggcaaaacccaaaacagcccaagcagcgaagcaggtatcacaacactcttagactcttgttttagatgcagttctaacaagctgctcagcttcatttctcaggcccagcagccggacaggaatggagtcagagcagcttctcttaataggaaggtaagcaaggggtgattaaagcgataatcaacgaagcctagaagcctgggtcact

SEQ ID NO: 211479 - DNA, 418 bp, Homo sapiens
cctcccagtggtcatcagtgtcctggtgtccctcctgcagccatgctgtcagacggcgggagcggccccaacttctttcacctgaagggatgggagagaataaaggagcaaagaggttgccagtgcagacactgagtcgccttctggcttctgcccccttttctctgggctcctgcttctgtgccctcctgtgttgagaaagtttgaggttttcccctgggtaaggaagaccagtgatgatgtcacagtcacatagatgtgcagctgtgaggggtgcatacacatctttacaagtcacctggccacaaagtccccagacccacagccatgcctctcctctcacttcaccagacaaaaccttaggctgatcccaataaaaatgagttgagaatttcagaaatatcaactcactcaatta

SEQ ID NO: 211480 - DNA, 264 bp, Homo sapiens
ttacttcttccgtgtcactgtagacattgatgactgtgtcctattagattttatcttctgagattacagatttgccttttgttttatctcctgtcaaggccacagtttttattctcctcatcttctagatttatttgcatcatcttgtaaacttaacaattactcctcaaaatctagtttgagttttctattctgcgtagttggtctgcccacagtgcttccttatatcacttcctgtgtcatggtatcattttgtgtctgtct

SEQ ID NO: 211481 - DNA, 241 bp, Homo sapiens
aaaccagtgataaatagaaaatctcaaaagcatccagagaaaaaagacatattatgtacagagaaacagaaataagaattatggcagacttcttgttggaacagtgtaagccagaagacagcggaatatcacttttcaaacacttttttaaaacaaaaactgtcaactagaatcctacatccagtgaaaacatcttccagaaatgaaggtgagttcttatgctcatcaagatgaagtaatc

SEQ ID NO: 211482 - DNA, 582 bp, Homo sapiens
ggcggttcaccaagagaaatgaacacagctgtctacacagaaactagcacaggaatgttcatggcagcaccagccaattcacagtagccaaaaaagggaaagagctcaaatgtccactatctgggaaatggaaaaataaagtgtctatctattcaacggaatgatattgggcaatagaaaggaataaagtactggtgcccactccaacatgggtgaagcctgggaagagtgtacttagcgggaacagccaggcaccaagccgcacgggttaagattctactcatatgaccgtccaggagaggcagaccctagagacaggaagtagatgagtggtttcctaggctggggggtgagagaggtgggaactgagtgcagacaggtctggagctgcttttgggtgattaaaatctttaaaacccaccgatggtacacaactctgtgaatatcctaaaaaccattgaattgtacactttaaatgggcaaatcatatggaatgtgaattatatctccaaaaagctgttattcttaaaatgaacagctgctagataatacgttcctttcctaaaacccactctttcatcc

SEQ ID NO: 211483 - DNA, 618 bp, Homo sapiens
tcacttctattcctgtgtctgcatttatactcccaagccttccacccaccctccaccttctcagttgtcatttcccaggcctgagagtctgtgcctgggggttgtgctatccatggatgttcatctacactgggtcagaactcaccaccacagcacgctctgtttactgataagaccattcctctgcatggcatatgaggtatctatgtcactctgaggcctcaaaaatgctaaacattcttttcttcccctataatatgacttcctcttcgcacttacaccttcaagtaagtagtttaaggaggagataaaaattttactgttaaaaaaaggagattgctgggtgcagtggctcacgcctgtaatcccagcactttgggaggccgaggcgggtagatcacctcacgttgggagttcaagaccagcctgaccaacatggagaaaccccatctctactaaaaatacaaaaaaaaaaaaaattagccaagcatggtggcacacgtctgtaatcccagctactcgggacactgaggcaggagaaatgcttgaacccgggaggcggaggttgcgatgagccaagatcatgacattgcactccagcctgggcaacaagagtga

SEQ ID NO: 211484 - DNA, 900 bp, Homo sapiens
atttaggattatataaaacacacatatacacatacacacacatatataaatacatctagtaaaaattaacctatttataggtatagctatagagaaagctaatccaatttatggtcttgagactctatgaccaacataatagtgtttgcacagaaataacagataatctgagctgtaacttatttatctttataacaacaattaaataatatttgatggaaatctttacaataaatatataatgcagactgtgacaaatactagtgttgacaactgaataatcacctataaaacctttcccaggccatgtatttttttaaagttttaaaacattttaaaatttacatatagtaaaattcacattctgacttacaattgtataaatcttgacaaatgcatacagtcataaaaccactaccccagtaaaaatataggacagctccatcatcctgaaaagctctctcatgtggctactttctagttaaatcctccctcaggtgttaacccttgaaaaccactgatctgtttgcctacagtaacgaagcatctgttaaaatatttaggttgcttttcttaattacaatatttgtttctcattgttaagttttaaaagtattttttcccagtctatggttttcccagtctgaaggaatgtggcattctctcaacagtctttcacagaaaaaatgtttttaattattttttcttttatggatcagacttttggtactgtatttaataactctttgcccaaaacaagcaaggtcaccaagatttttctcctatgttttctcctagaagttttatggtgttacattttgtatttaagtctatggtcaatttggagttaagttttgtatatggtccgcagtgcaggtcaagttccgatttttgcacatg

SEQ ID NO: 211485 - DNA, 427 bp, Homo sapiens
tcctgtgacctgcctactataaccctggcaaggctgagacagtccaagtttggggcagtcaaggtgggacagcagaagatttcagggtacaagtcatctattctcttatgccagctctcagatttgtatataaaatctgattctacacttcttttaacaaataataaataaataaataggaccatccaacccctctagagctctctaaggagactgtagaagacttgtggccactctcattttaaagattctaataatctccacaaagtaatcctgggaaacatacatctgtaagaccagggaaacatactggcaatagcaacttcccagaacattcctttttacactgcctgggatttttcaataagaaatttggcatttctgtaaatttaaagtgtattcagtaaaattaatgcgtttttttctt

SEQ ID NO: 211486 - DNA, 496 bp, Homo sapiens
atccaagtatcaaactagagatcatttacaatacttcattttatccaactgtaattttagaaaaactctgaattttgtattttctagcttgagaaatgttgataatttctgcattaaaatagtttcataaaaaggaaagcacgctatttcagagagccaaatattttatcacacaacacaatataagcacatgtcttactattggattttcatcttattatacaaaagactcaaacatttatagcccctgacacgttctcttcccaaaagaatctctttcacccagtgtgcctactgcttaccaagctccagataactcaagttcctcagagctatgaaaagcaagaagaggttcaggaagaaaggataagggataatagtggccctgtaccacagctatacaaatttaaaaggcatatatttaaattatttgaccccacagttccattactaaaaatatttacaaaaatatgtaagatatttttatgtacaaaga

SEQ ID NO: 211487 - DNA, 655 bp, Homo sapiens
gtttatagcccaggagctattttttaaagatctgtaggcttactagccatgacaatgatgacaataatgatgatgaaaatgacatcatcattaccaatagctactgccatctattgatcccataacatgtgatcatatctctgtcctcagaacaatccatttcacagatgaagaaacagactcagtgagcacgtgatcacttctcacaactaatggagccaagattctgtccttatggctccagagacctcttttttttcccactgtaccacaacactcaccaggactggagtgccacctatgacctcattgcataatggatggcttgtcctcaaatgggcccgggtatgtgtacatgtatacttatgtctataggggagaggggaaattgacccactttcctccactctaactccagatctcagctgccgagtggaaactccattctcacaccatagctatgggactgggggaaaggggaggaaataactaaagagtaaggaattgggggaggctttgaggtttggatgtgacaggtagtttgcatgtagttggaatgcagtaacattggtccacaaggtttgtcagaaaccctggttattttggaaggttccaaagttttgtcctcttcagatatcatgaaaacaggaaattc

SEQ ID NO: 211488 - DNA, 400 bp, Homo sapiens
gcttcatcctcgttgtcttcacgttgagtaggctaaggaagaagaggaggaggaagaggagaggttggtcttgctgtctcaggggtggcagtggcagaagaaaattcatgtattacgtggacccatgcagttcaaatccgtgtcgctcaaaggtcagttgtacgtatctcacagggctgtgggaacagttatataagacagtgtacataaagcttcaagcaaggtacttttgcataatgcctgccagagaagtgccaaccaaattacctgtagggagaaaatagcagagatcacaacctccgacagtttggttgggcatgcctagtgtttttcatttaactaatgctgaatgtcattcgacagggtcctctctccagcatattgaattcctaacactgcc

SEQ ID NO: 211489 - DNA, 457 bp, Homo sapiens
gcttgaacccgggaggcagaggttgcaatgagccgagatcacgccatcacactctagcctgggggacaagagtgagacttcatctaaaaaaaaaaagaaaagaatatgtataccccctttttcatgtggcagatgtttagctatttggggagaactttcatggctcttccctaatcatcaagtattcaaggtaaagattctcggttcctgtaatggttcctcaccaggcataatttgtccttttaccatcctactttctgtcttctgaaaaacattctttatctgaaatacagcaattaatattaagatatcttaatatgaagtgcctggagtcaaatataacattccaaagtagtctgactggaagactaggcacctgcctttcttcaacaatgcacttctgttaatgcagtgtaaggtaacatgagttgtttttggaactacatcataatggggg

SEQ ID NO: 211490 - DNA, 465 bp, Homo sapiens
acatttgacgcactctgatgttttctttttctgatttaatttctttttatgctgctctaaattgatttcacaaccattagccacaattgtaaaaaacaccataatatagcacactgcacaaagtaggtatactgttgtacacatttaattaaattgactcggctttttccaaaatcattatagaaatattactgatttgtgaatatataaaatatatccattttgatatatttatttagattttaactttaccaaaaaaatattttataacctcaaagtattgctgctttggttttaattttacatgatctgaaaaagcaaatgcagttcatttttatgtatttttaaagtaagaagatgaagatatttagctgtacgataattatcactgtaatgacaaaactcctgagattaatgtatttgacataccataaaattgctgtttattgaatgctgagtatgttc

SEQ ID NO: 211491 - DNA, 666 bp, Homo sapiens
tcacagcagtttgccattcattgactgcagaggattaggtggaatgagactaattcttttttttttaagagccagtcttttagatatttagtgttttcttgggtctgcttttttctcagttagactttctgtaataggattgtgtattacagctcccagtcccttctatttctatcacaaataagatctcattgggtgtgtaaatttaggccaaataaatcaagtggtaaactttgatgcaggaccacctattgattcttcattccatcctgagaagcaactccctcaccctccaggctaaaatcaaggatcaagaaagcctggctttccacagccacaggatcaggaaagatggaggaaacaccttagatttgtcacctgggtattggtaccagttctattggccacagcctagagagaaagtctggactgcaagtgaaattgagggcttgaagggaggaaaaatggagaaataattataagtcattctcttcatggaactgatgaagtccagtgtgaaggactctctaactccttaggtacttttttgaggaaagatgtaatgaaagccaggaactgtaggaaatattttaacacatgtaacctcattcaattctgtcacaactctatgatgtgagcatttgcaatgaaaaagatgtgggcttg

SEQ ID NO: 211492 - DNA, 666 bp, Homo sapiens
taggcagagaaaggttataggtgtgtaaatcatatgctgtaggaattacaaagtgctgtcactaacatctcaaaagaaaatgtcaaagtaagacaccaaagaaacttgcaaacaaaaaacagaatattgctttgacgttataaccaagttttgcctggctatagtatgtctattataattctggcataaaatatacgtgggtcaaatcagtgtttctgatgtcattgtgtgatatcttaggtttttgttttgtctttttggtttttatttttgctttttagtatctaatcttcaagcccttctaattatatagaagtcagataaaaattcagattggtgaagttctctctggtgaagacagtgtgatgactcacatttaattgggccctcactgttttcaggtattctgctagatacttacttcatcttcacagcaatcttgggagccgcttagctattgccagttactagatgagaaagctgagatgcaaagagattaaaaaattggccgagctgacacagataataagtagcagacctggaattcaaacctaggtctctctgaccacagtatctgtccttctcccactacaccattttgtcatttccaagcattctgtgtcacttcttcctaaaggggtactcactaattgaattttggggtcc

SEQ ID NO: 211493 - DNA, 374 bp, Homo sapiens
cattattctattccaagccttcctttgctaaaggtagtttccttggctatagaattgtaggttgactgtttttttctttagcactttaaagatgttgcttctagcttgcattatttctaatgagaaatctgctgtcatctttatctttgttcttatctatgggatgttatttcccatctgttggcttttaaatttttcctttatctcttactttaaaacaatttgattgtgaaatgctttgatggtgttttcttaatgtttcctgtgtttaaggttcattgagcatcttggatctgtaggtttatagttgtcattatatttgatatttattcagcatgattttcttaaaatatatttgtcacttccccccacct

SEQ ID NO: 211494 - DNA, 431 bp, Homo sapiens
cttttttcataccaaatatgccaccttttttgttttaaacttaattcctagctgttgtgtttgccagtcagtggtaagtaaagctgttagtcacacctaggttcagctgattgaaagcacatactctgttacaccatgatgccttctttcaagaggagctggttagggaagatcatgacttatatttgtggacataagagggtggcatttagaaattcaggtctttggctcaggagagaatttgagattacaaagagtgctgtcatctacagcgatatgaggaaatcagtcttttacaaattagattcgacttcccttcttgggagtgcatacactaattatgtattataacagtagcttatgtcttggttccatagtatactggcatttaaaaaccatttgttttattatcaccttattttaaatacaga

SEQ ID NO: 211495 - DNA, 415 bp, Homo sapiens
aaataggaatttcagactacacatttatagtaacatggtataaaatgtgcttgactaaacgaaaactatgtctaaatttaagtccacactctttaataacaatttttattaaaagaaaatatggctgtgtttatattgttagcccttctgctttctgagacagctgatgaaagtttgatctggaaagagaccccataacaatgttctaattctgtatgctttttctggacattagcaactttcatgtctcggggtccaacttgagaacagaaaatgcctctatgattcatcatcaaatgtagttaacacttgcttggaattttcaagaaactagctttaaaaaaggtacaagttgggggctgggcgcagtggctcacgcctataatcctagcactttgagaggccgaggcgggca

SEQ ID NO: 211496 - DNA, 502 bp, Homo sapiens
gatttttggtgaaaagggaatttgatagttaataggatttgtaagttcagaggtagggcaggcttcaggcagagttggatccaggggcttgtagctaggtctccctctatccctttgttctatttttctctgccttggtttttctcagggtgactttatctacatagaggaagtttcaggcttgcatcctgtcctcaccaaccccagtagaaagaggattttttccttttgctaattcactaatattgcctctgattgaattgcctgtggtaactcctcctgaaaccagtcactgcggttatgggaggggagtgagggaggctggtacttttttgttaactttaagccctgtgcctatttctggtcacaggatgatggagagttgcttaaaacacgctgggtgagattgggtgactgggatggccaccaaaggcaaatggcatggtttcccaaaaggaagagattagaagttgatctggattatggagaattcataactgtc

SEQ ID NO: 211497 - DNA, 777 bp, Homo sapiens
acatcatttacatagggttcatttgtatataataaaaatttcatcataatgaaaaattttctggaaagtatatgttagtttgtttaacatatgctttggatatacggctaaataggaatagctaaaattttattcttcaaatattccctttaacaattaaaaaaaacctcattcctaaatatttgtctgtctttccatttgcttttttgtttgtaataatcatatgtaattgaactatgcaaagattggatctttttatagttcagaatatatttgtatacatcaataaatttgttcattgcatagcaaacatgtaaactcacataggatctataaattttaccctagtaatctaaaaaagttgctgaaattttacacaatagtttattctaaggtttattttgttgtaatttgggttcactttgttttttatttttaatacatgtggcaattgaatacaacaaatgaaaataagtcatgaaaaggtaaaaaccaagtaagtaattttatcctagattaccagaatttaatctcactatgctgtttgtattttttcattagtataacaagttgtaaatgtactgtgctgcctctttaagtgttcaaaattaatttcaacagcatgtgtttaacataaagttaactatgtttgcatcaaataaatgtttattaatgaaagctatttatcatacaagaaacagcaaagataagtcatcatacagaggtgtacactagaggtgacatatgtaaaagtgcatgcagagatttctgtttaaa

SEQ ID NO: 211498 - DNA, 618 bp, Homo sapiens
tcattactcctcagacacttgggacattcatggtgacctattggcacccaaggaagagaacctgattttaatttggactgataagcgagttttctgaacaggtttatagggattagtttagtctggacagagtgagccggaatcaaaagatactgttaataccagaggactagaagatcccatgtggagatgtcaggtggcttagccattgagaaagaatgacagtagatctgaaatggtccagagcccagatattcaacaaaggctaagagccaaggtgagaggataaagggaaggtgtgaacgaacgggtgaagccccactgtgtgcttggccagccccacagagctctctgctggtgcttgggggtatgaattctacttctgacatgtcaatttatgtcaccatctcctgtgcctgggtctaaagtcttgacttgtaaaagaaaaaaaaaccaactggggattccaacagacactaccttgatggtaggtaagcggggctgggtaacaagtgagatctctgattccttccttccttccttctctctccccttttcttttcttttcttttttccttccttccctctctccctttcctttccttccttcctccccct

SEQ ID NO: 211499 - DNA, 522 bp, Homo sapiens
cattgggatacatattcaggcacttggacaataccaccagagatacaagcacaattaggttgtcaaggtcagataatgcaacaataaggacaacctttagagttagagtggaaagtgagatatgttggaaataattctcttaagaatataacctcaagattcatttagaagtcctagcctgggctttgcaccctagcgtctgttcaccatattcacacaaataacaaggtgttatttgagaaaccaactaaaatacgaccatcattggatagaacctatgttcaactatattccttctaaatttctgcattgaagtgatttcatatactacatctcactttatatgtaaaaaaatgtgttttcctacaatgagatagtataatcctaacagtcaatatcaatctaagtatttatttatgaaaatgcattttttaggccaggtgtggtggctcacgcttgtaatcccagcactttggggggccgaagcaggtggatcacctgtggtcgggagttcgagaccag

SEQ ID NO: 211500 - DNA, 569 bp, Homo sapiens
acttgcacatggaggaaagaccaggtgagaacagtgagaaggcagccatctgcaagccaagaagaaagggctcagaagaaaccaaccttgccagcaccttggtctcagacttctagcctccagaaccgtgagagatttctgtggcttaagccacccagtctatagtattttgttatggtagccctagcaaactaatacgacacatacaattaatgattggtctgctttctttagtttctttaggtttctctggacagcagcttatacattgaagctgactcttcacaatgtggtaatgaacccttggttgcagtgaccttacaatgtcaagggagctcagatactacctcatgcatcagccagtatcaccttttgcagcaaacttttgtttgattgtcttgctgaagtaagtaaattatagtgaatatagtcaagtagcttgataaatgcaattctacagtatctcagatcatcatagtgaatattatggatatcgtaaaacatagaaggcatagaggatttagattaagagtatttgaaatttcttcaaaataaaaacccttatcata

SEQ ID NO: 211501 - DNA, 297 bp, Homo sapiens
gggtatcacaaggtcacctccctcaagggatccttttggggattaaataagagaatgcgcgtagtaggtactccaagagggtggaccctacggtccaccatttcgtactgcagatctttgggaccaaaaatgagtgcagttctgaatttgggaatgttcgaaaaataccacagtgtcctaagcactttgtgctgtcagctgtcactcccagcgggtctggggctgccaccctactccagacagtccagtgcatgtctgttagtgcgtgcaataaataaaggctagaagtagtcttcc

SEQ ID NO: 211502 - DNA, 382 bp, Homo sapiens
ccctcttctcccctgacaagagcaggaagcagtactatcgctatggattgtaggacatagatgttttatatttttgccatgtgtagaatggttttaatttgcctgtcccgagttacttttctcttgtctgagaaatttagtgggggtagtaaggctggctgtgcttttcctgtcttgagctgcaaatgtctgttactttcttgcacttgaaaataaatgtcggtatttgataaagtaagtgcattttgtgggagactgagctgtcagttttttttttctttgactagcttatgtggggtggtgatgggggacgattttgtaaaatggtgaaatgagcagtgactgtggaagtttgtgtttaaagctctgtgatgatgaaaag

SEQ ID NO: 211503 - DNA, 782 bp, Homo sapiens
ccctattattaaaacccgggaaattttaaacaggccttaaaagagaatttttaagccctttaaaatgtcccacacatttatccttaattttttccgggcacccaatcacatgtgttaaccctatagtccttttaattaaggaaaattggcaattttcttttttttttttttttttttaagtgagagggtagtgagccttactttctgccctttttccaacttgttgattacggctttttttgtatttgcgggtgggttgtgtgtgtttttgggttgagtgtattaagtgttgggtgaaaagccttgtgttcgctaaatgatttatgggagggaatttttccaggttttcattttatttcaaacggacactggatttatttgacacttgtgtctattggcttattggtattggctggggaagagaggaagcagtactatcgctatggattgtaggacatagatgttttatatttttgccatgtgtagaatggttttaatttgcctgtcccgagttacttttctcttgtctgagaaatttagtgggggtagtaaggctggctgtgcttttcctgtcttgagctgcaaatgtctgttactttcttgcacttgaaaataaatgtcggtatttgataaagtaagtgcattttgtgggagactgagctgtcagttttttttttctttgactagcttatgtggggtggtgatgggggacgattttgtaaaatggtgaaatgagcagtgactgtggaagtttgtgtttaaagctctgtgatgatgaaaag

SEQ ID NO: 211504 - DNA, 1230 bp, Homo sapiens
caaacaagaattctgcccttcttcagtgcctgagtgtgatattttgcctcaacatccctcttagatgaagttactgattgaaaatcatttaagtttttgccccgtgataaaagatcgcgtcctcagaaagatctccaaagcatttactgtttgtttggtttggttttggtaagtttaccatgattttgcttgaattgctctccgctgatcttctcagctaagatcgaggtagagttgcacagcagaagagggctgcatgtaaggaggcagctctgtctcggaggacaaaaggcctgggagcatccagacaggcagtcactgtgtggaggtcactcccctcccagtggccactgtggaggcatttcatagaaatgctcgctggaccattcagttttagagttgggacaaaaccgagaactcatgaggatatcggataggagttaggaaatgactttttcacacaacccaggcaaggaggggagaaccctgggcttgagacttgcaatccactgcctgcccctgcagtgtggcccgttacgttttctgcaactctgccttcttgagtccaaatgtctttgaaaggggcaaatgcttcttaagtgccaacagggtgtgtttcagtgaatgttcacagtgtgcactggtccggctgaaggcctcttcccttccccaacacccacccatcagtgcaaaagactgctgcccagcagggagtgacatctgtgtctcagattttcttgctgtgctctgagtactcactcctcatctcctttgaccagtttcctaacactccccttgttcacaacacagaacatgagtgctctttcctgtcattttgacgctgataaacagcaattctgtgtgaaaatgagaatgaagatttttttaaagacaggctacaataattcccatgctgagaaccacatgtgatgacacttgtgatgaagatgaggacagcaacgagctgagagactccaaccaggattcacacatgcaaggggatgcatgagaatggggatgggacattggtggttagcatccttgcttgtctcagaatggacgtgggttgtggatttctaactcctggagaaaccagagttctaggaattgtaagccactttatgttaggaaagaaaaagacggtgttctgctctcctgtcccttaaaactgtgcgtactgccactaaacctggaagctgagaacggtataatggctactcctgacttcct

SEQ ID NO: 211505 - DNA, 485 bp, Homo sapiens
agaaaaagttatttgctctgctgtttacatttgtactggaaaggagccatctgtggaaatctcatattcctcccttgaaaataatttgtaattctcctcgcctaaaggacagaggaaaaataagaaaaccagtgactatattactttttagatgttatctttacatatttttcagtaggtaactatgagtataaaaatttcaaaaatataccagccttgtgaagctcagaacttttacaaaaataaggaaattatgttaggaagagtcagagtgatcgttttatttattctattcctccttgttatatctcccatgttaaaatcgggacattattcactaaggattttaatctaacatttcaaaggttttgttcagttatagtggttcttgatcttctgtggtttgtgattgaaaaactaaaatgtagatatgaaatggcattcatacataaataagtgtacatacatgtacatgcattctttca

SEQ ID NO: 211506 - DNA, 770 bp, Homo sapiens
tctttatcttgctctaccttctctggaatacctacatctctgatgtttttttaacattacatattcacaagctttaccaattcatggaaaggattcctctaggattttggtggatctcttgaagcactaagaacctcaagcaaaaatgtatgcaatctttgtactttaaaattaaagcatttcaaccaggagcagtggctcatgcctgtagtcccagcgctttgggaggccaaggcaggatgattgcttgagccttggagtttgagactagtctggccaacatagccagaccccgtttctttaaaagaaaaaaaaaaacaattagctgcatgtggtggcacacatgtagtatcagctttgggaggcccagatgggaagattgcttgatctcaggaggttgaggctgcaatgagctatgatcatgccactgcactccagcctgggtgatagagcaagaccctgtctcaaaaaaaaatttttttaatagataaacattcaggcattccaaactcctaatgtattgtctactattaagaatgcatgctggctgaggcaggagttcaagaccagcctggccaacgtgatgaaaccccatatctactaaaatacaaaaattagctgggccaggtggtgggtacctgtaatcccagctactcaggaggctgaggcaggagaatgtcttgaacccgggaggcagagattgcagtgagccgagatctcgccactgcattccagcctgggcaacagagtaagactccatctccaaaaaa

SEQ ID NO: 211507 - DNA, 373 bp, Homo sapiens
atcctgtgcttttatattcttagtgctagtgtatgacatgagccagtaacagggcttctggcccatagatcccttctgataacagctccttttgtttccattctcttccctactaatattggtgctctgactgacaagacaaaggactgtatcctgttgagaagatctaaaatctgagtaactcccactaaaatctgtatcctgtaaagaaataacacactttctaaaagtgctcttgggacatttaaaaattgaaagacaataaccgcccccccaacacatatactcttaacattctgtttttgatgccataaaatgaaaagaatcagaaaacaaaactaagactcacaccaaaaaattatcattatctaga

SEQ ID NO: 211508 - DNA, 360 bp, Homo sapiens
aaactgaatacgttatggaatggcaactgccaagatcatttgagagcacttctacaattgttagttactccacaactcagcaattctgctcttagacatatgccctagataaatgttttccatgtacacaaggagacatgtacgagaatttttacagaagcaggctgtaatagaaaaaactagaaattatctaaatgtctatcactagaacagaaatgatacaggccaggctcagtggcttatgcctctaatcccagcactttggggggctgaggtgggcagaacacctgaggtcaggagtttgagaccagcctggccaacatggtgaaaccctgtgtgtactaaaaatacaaacgttag

SEQ ID NO: 211509 - DNA, 409 bp, Homo sapiens
tcggctcactgcaacctccacctcctgggttcaagcgattctcctgcctcagcctcccaagtagctgggattacagtcacctgccactatgcccagctaattttttgtattttaatagagacggggtttcaccatgttggccaggctggactcgaacccttgaccttgtgatctgcccaccttggcctcccaaagtgctgggattataagcatgagccaccgtgcccagctgtatttctttttatgcagtatatgtttatccatgctttatacataaaaatagtaagttttgttttgtctatcaataaccaattttcacccccttggtggcaatactgcccccactgagaatacaaatcttttttttgctttttttttagacggagtcttgctctgttgcccaggctgg

SEQ ID NO: 211510 - DNA, 266 bp, Homo sapiens
catatattatattacataaaggtgttattatttagcatgcttttactgtaatgaacagttagctaaatgcaaaataaaattcttctctgaagtaaacaataataataataatcaaaaggaatataagactctccatagaaataaaagaaggtaaagttgtattttttcaaaatcatatttaaatcttttatttagcaaaataaaatagactgcttatataactatctagaacatctcccaaagccccagaataggaattaaatagt

SEQ ID NO: 211511 - DNA, 549 bp, Homo sapiens
ccaaagaattgatctgcctagacccactaacgctggtaccagataagctgtcctggggcccaaggacagcttatgctggcaccagtgcctccaaggggccctgaggaccagcccacctggcattccagtcttcaacaaaacgtcactactgcctccactaacaatgacatcctaacccattagggaaataacagacccactcacagatgagtaaattatgtagagactacactactgcatgcacccagaatcaaagccaaagtgcctcacccaaccaatactatagatacatcttcaggaaaaaagtcctcccctatgaaagcaaatgttaaaatttggaagaagtaattgttacaccagatgcacagatatcaacataaagacacaagaagcatgaaaaagcaaggaaatatgatacctccaaagaaacacagtagttctgcagcaacaatttccaatgaaaaggaaattaataaaattctggaaaaataattaaaaataatattaaaggagctcagtgagatatgggagaatacagaaaaataatac

SEQ ID NO: 211512 - DNA, 435 bp, Homo sapiens
ggatcttgggccagccaagaaaagtgtgtctgtttaatagtctaaaaataaattttcaagttccctttagaacttctgcatttctcatacttagtttttaacttttacttccaaatggtctactgaaggaaaagaaaagtcttgattgcttcgacttttctcaaaaaaattatgaaacttttaaccttggaactcactgatttagaatatttattaagatttctaaaaataataaaaaatttgattatgtaccaatagagcctcacagttgaaatctttaaaaattaagaatgttaactatcacagatgttttctgccaattacagtaaggatatgtattctctattgtcaactacaaagataacctagagaattaatgttttatatttatatatgtacatctgcatgtctgggtgtgtgggtgaaaggagagag

SEQ ID NO: 211513 - DNA, 417 bp, Homo sapiens
tgcaacctctgcctcccgggttgaagcgattcttctgcctcagccttctgagtagctaggactataggcacatgccaccacgcctggctaatttttgtatttttagtagacacagggttttgccatattggctcggctggtctcgaactcctgacctcaggtgatccacctgccttggcctcccaaggtgctgggattacaggtgtgagccactgtgcccagctgactccagttatttctaaaggtcaggccatcttacaaaagaatgaggatatgcttccttggagggatatgctgcagactagggctttttaccagccagagcattttaaaaacaagtgtctgatctcctctggggtgtctgctttggataagtgcagtctgtcttcagtcttgctaagtggtgagacagtgagg

SEQ ID NO: 211514 - DNA, 421 bp, Homo sapiens
ctgccactagcattttagttctttctttcttctttcatgtatgtttaatttttgaaaataattggagatttatggtagtatcagtggtattttttccattttttttctcttgaactatgttttctttgctccaaaaagcaaatggcagtcttcaaaggacgatttgtttctatttgtataaattgagtataagctgcatccaattcctagtgcatgcataaaactctttttgaggaaatgtgaccaatatataacattttattgaatgtttcttgaaattggtgtcaaactgttttttatttcatttcttttgggatgcctaattgaattgaaacttcattatttcattccatggcttaggccacctttagagggaatataccatgtgagctcctacttacccattaagaccagatatcca

SEQ ID NO: 211515 - DNA, 308 bp, Homo sapiens
tgtgctctgcatcttggcattgttgaaattggggaaatggccacaattcagatcactgatccaatgtgtaattcctaatttcttcctttggggcaattttagctacatctcatagcagagacttatatgggtcctgagattaataaaatattttagtgctatgtatacataatcctttttcctctaggaaacacagatacccccagagtgactggattataaagtttcaataataattggtaggctttagtaaagactatttctcacctccaaaaatcaggccctgttttacacaaaagctagataaa

SEQ ID NO: 211516 - DNA, 581 bp, Homo sapiens
attcatcaggtgtttattgagtgcttgctgtatgccagacctggtgccagggatcctttgaataagaaagacacggtccccgatctcgtgctcacattctgtttgtgcactcgtgggcccacatggtgatgcgtgcagttaaacaggaagctggcggaatgagtgcctgcgtggggacggaacagttccgcgtctcgagtacagtggtggggagatgtgtctgtgtgtgtgataaagcttcacagtttgtgtgtaactacacatgacatgtaagaatgttggtgtgtgtagaagatgatgcagcgtgctgaaggcctgcagtccaggtcatagcagtgtgcctgggttagtgtcctggttttgctcatgtccttagttactctgatgtgcccttgggggatggaggaggtagggtacacaggatctctctgtactgtttttgcaacttcttgggagtcttttattattttataatacaaagtgaaacaaagccagaggagctgtttgcaggtgatggcgtgtgtgtgtgtgtgtgtgtgtgtgtacgcacgcacacgtgtgcgggcgtgctggggaaggct

SEQ ID NO: 211517 - DNA, 443 bp, Homo sapiens
caaagaaggttctgtgtgtacatccacttagaccttcacacctacaagtaaaacaaggcaaatacacgctcaaggaacacacagtcaaagaataaacaggtaggtaagggagcctggctctgtgggtagacaagtgggaaaaaataaataggtggaagcagagagcagagacgccatcaaagaaggatggtaggagaggccatggaagtcagtggctgaaacccacaaaacataacagctgtcagaattaccaggttctctgtcaggtttcaccagcagaaggaacatactggttactgaactactttggcaagcaacaggaaatgggtcagtttcatcagctttgctttaggaagcaatcatatgtatgagaccaaggttgaggaggaaaaggagagcagaggatgcagaaatgcaaccaccagccatataaacaggaaaca

SEQ ID NO: 211518 - DNA, 644 bp, Homo sapiens
cttcccaaggaatgagtatcagtataaaagtagacttgtaagatgaatacagcgcagagatctttcagagcaactagtctagtctcaccaaaattgaaacctagaaattcagagcaagtaccagtagcagtaaattttcttgcacatgtccaaaattaagtaaaattttaaaacttgaagatatgttttattattttcccccaaatggcctatgatagtcccaatcgaatattagaagagaaagttatgtccaaaatgaaaacatttccatactctggtaaaacgatgttcacaccaggcaaaatgcaaatatgaaagggcactgcgcctggcagtcacgtaaatgtttattttgggtctccttgacttcttggtgacacaaatgccttgtctgttcatgctcagatatgcgtgatttcagtggtttaactttagtctcctgtggaacatttgccattgtatttggttttcaccaagtaaataaaatgctgtgaaatcaaatatttcccttagattgcaggtactttgcacttctcctctgctttccaaactttctatttatacagctaaatataagtttataattagaaaataaaattctgtactaacaaagaataaaataatctgcagatgctattcttcat

SEQ ID NO: 211519 - DNA, 359 bp, Homo sapiens
tgcagtaccataaaccttgaataacaccataagacctacaggaagtgccaccagagatcctggaagtgttctgaataagcagaaaaaaatcatgacattacaagtaaaagttgaattacttgagacataccatggattgaggtctgcagctatggttgtctaccatttcagacaattaatcttggaaacagataacataaacttgtggtatcaataaatacagtacaatactggaaatgtattttcccttatgattttttttcctctttttgagacagagtttcacttttattgcccaggctggagtgcaatggtgcgatctcagctcaccacaaacctcgccttctgggttcaagtga

SEQ ID NO: 211520 - DNA, 404 bp, Homo sapiens
tcatttggaccaatttgggaatgatgtatgagtgttggtgaacattagtcaaagaggggaccacttgggggaaagggatgtgccgatgccgcaggccactcgggggaggcagctggggtgtcgtctcagcagcctgcactaatggcggggaaaggcagcaatgaccaaacgatgtactgcctgctgtcggggagcagcgctgtgtaaataaaccaataaggaaaacatacgaagcagaaaggagaggagttgtttttcctaaatgctattgacagcccaaaacataaaggaaatttgaggttccctttctctatttctaaaccctgaaacccgtatgggctctgctaagccttgtaacaggaggcctagaaaaagctcttgccagaaagcttaatgatgatttg

SEQ ID NO: 211521 - DNA, 260 bp, Homo sapiens
ctgagaacatacgcggcatgaagacactctcagccctcaagggcacccagtcagcgctgtttaaggacggtttttctgttcacagcatacttcatgattacagcttcactccattggatacaactatgtgagtatgtgtgtatgagtgtgtgagtgtgtgtatgagggtgtgtgtgtgggggggtaggggagtgccatatcccccagcagcacattaagaaataatccaattacaatttaaataaccattgtttcaacac

SEQ ID NO: 211522 - DNA, 520 bp, Homo sapiens
cttatctgaagggaaatatttaatattgggtatgttagttcctcatgtatctttaataatttttgtcaacagcgaatctttaaataaaatataaaggatcaggcctctgctctcctgcatatatttgtaaagtcacttactgctttttgtcacagtttcaatttctgtaaaatagtgagagggtttttacctgacaggatttgtgcatgtacgtttactttgaaaattaaaaagcattaggccaggcgcggtggctcacgcctgtaatcccagcactttgggaggccgaggcgggcagatcatgaggtcaggagattgagaccatcctggctaacacggtgaaaccctgtctctactaaaaatacagaaaattagccgggcatggtggctggtgcctgtagtcccagctactcgggagcctgaggcaggagaatggtgtgaacctgggaggcggagcttgcagtgagccgaggttgcaccactgcactccagcctgggcgacagagcgagtctccgtctc

SEQ ID NO: 211523 - DNA, 342 bp, Homo sapiens
agtgcctaacagggtggaactgggcacagggcatgtctcagacctgtatggtacttttaaaaaaataagttaaaataaacactggggcatggtgatggaaaagatgaaaaaacagaacgtaagttatttcaatgttgtcactcggtgtggccacttggagtttatatttgcattttactgttgcatttgaaaattgttaaagtgaaagtgacaagtgcaagacacactctttttgtttggtaaatatacatttcagtccacacatgagaatagttattgaatgttagaagtatcttttaaaatgaaatgtatgttttttcctatcttttggttttaaaagtg

SEQ ID NO: 211524 - DNA, 369 bp, Homo sapiens
agaggactatgtttctcacagattggagttaacaaataaagtaaaagatagtcagttaaataaatttcagataatgaattacatatagagtatccaaatacttatactacagagttagtagttgtctttctgctttttagatgtaactgtgtgtctggtagttttacttgctgaatccatcaacgccaacatgaaataatcataggatctgaaaacatgatgcagacctaggagaaaagcaaaagaagaaaaatccatagaggtcatatagattggaaggagcatggaggagaattgggtgccatctgataccatacaaatatatgtatttgaatgcacatctcagattgctctgaacagtgacagttt

SEQ ID NO: 211525 - DNA, 528 bp, Homo sapiens
aattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaa

SEQ ID NO: 211526 - DNA, 279 bp, Homo sapiens
tgagccaggctgtttatgacccgtggtgacaacgtgagggggtagcccttggggaggaaaccatttctacatctaaggatttgacattccaaagtttttccaggtgtgctttcattaaaaacaatcatgacaatgttaaatcaacatgaaaagatgttttccatttattatacatggtcctccgtgttcttgggcctctagagtcatttgggaagtgttaatgaatcaacccatcatctgcagaagatggattggccttggtacttttacaaaatcgct

SEQ ID NO: 211527 - DNA, 409 bp, Homo sapiens
atgtcaaattgtgctgtctttcaaaggggttctcaggtgcatctccggaatgtattgtcagaaagctctgggggccccctgttcaagaagtcttgctgccatactgccgcactgattagatgttttccaagcttcaagaagctgcttcttgaaaggattgtttccccaaggcccaagaggaaatgattctcacggggttggggctgtcctgtccatgacacgcctgacgctgtcagatctgaacgaattcacagacagacggacttgtcaccatgaactctgtgtgcgtcatcacccagggctcaggtgcaaggttgtccccttctcgcctggcctctgtgatcgtcttagatagcaatgttaacttgccctgttagtggaacgggaaagtaaaatattttcttatttc

SEQ ID NO: 211528 - DNA, 168 bp, Homo sapiens
cccagctattcatatgccaagtaatggtttttcttcccttttctttttttttaaaaaatcaattcccatttgctacctcccagaaatactttccagactactctgtgaaggcaggaaaagaaggcagcagcttggtttctggttcccttgtgctctgcggctcggccc

SEQ ID NO: 211529 - DNA, 370 bp, Homo sapiens
cggacagatggaggccatcctggagatcgagaacatcctggccaacatggtgaaactccgtctctactaaaaatacaaaaaattagctgggcgtggtggtgcgtccctgaaataccagctactcaggaggctgaggcaggagaatcgcttgaaccactgagtcagaggttgcagccagccaagattgcaccactgcactccagcctggtgacagagcaagactccgtctcaagaaaacaaaaaaatgtaactctaccttctgcagaaagtgactgaaatctcagagcttacaggttcccttcgaacatcatggaaactttcctatgagccagaaactgagtgacttacttccaacttctatttaaaatta

SEQ ID NO: 211530 - DNA, 320 bp, Homo sapiens
caaatgtaaacttatctttactttaatgtgttcacttctcataactccttgactggaacccttcacttcatccagtctgagagtctgtaagtttctgccgcaggcatgcacattcctgacaccacgcttttgcttggctgtgcctcctgcccagaatgctgtctattctcttacgcacatcctctctgtatcccatttttgtcctatttcttcctgattcagagagggtggtgattggtggatatggctaacatttattaagtatatctcatgctttacatactgtggtggcaatttatgtgcattgtttaatgataccc

SEQ ID NO: 211531 - DNA, 512 bp, Homo sapiens
aggaacacatattttgatgtggtcctagccttgagtattgaggactaggatttctaagtagggcaaatgcaaaagcctggggtgatttagaggtcacagaatgaaaggggattaacctgccagaaagcaattaagtaatcccccaattgcaaggaacactatggtgctaataatgagcttccttgagcaaaatgggaatactttacattatgtaaactctttggggaggaaatcacactgtctccagtggtacacaactttttttgagggtctctgggagttgttgcatcttagtttttgagagcagcagtagtgaaagtgtatgtttgagaacggtgtcatcactgcctaggggctttcagtggccttaacgttctgcatatgcttggttttctcctagagtcagttacctgtttcatttgttgggatagtttatcagttaataatgaagaaatctgaaaccctgaaatttttgaggtctgaggaggggaaggatggatcacttttattgg

SEQ ID NO: 211532 - DNA, 375 bp, Homo sapiens
acacatattaaagcgaggagaaaggtttatattgttcagctgaatctgtacttaatgttatttatctgaacactgtaaaagtttgctgaaaggttaatctgaggttatttcaatttgtcttttcttactggcaaggtggaaaacactgtttctcaaagcacttcctaagactttcaggataatgtcctcagcgatgccaaacctcactgaaaaggatttgaatgtaaactccaatagagaatcatgctagtcttaaaaattttaccctgttcttataatctcctgaaacactttgtaaattaaatttagttcacatttttaccaaaaatcttgtgcgtgtagaggcacatgctgcaaaacaacattttggtcaac

SEQ ID NO: 211533 - DNA, 543 bp, Homo sapiens
agggataagatcatacaaagagaatgcatagggaaagaagagcagagagtccaaggggacccctggggagagatgggcagagtagggaaaccatgagaagaaaggaaaagggcacccatgaggagggaatgaggatcaggagagagtggctaacattcaatgtcaagcatggctcatagataatctcatgtgatgcattcaataactctatggctagatccaattatgctaattttacagacaagggaactggagctcattgggatatagcaatctgacatctgaccaggtttgcagcatcaataagttttgaaggtgggactgaaccatgtatttgcttttttctttgaagcctgtgtacttccatctcacaagctatatcacaggtttccagaacagaattgatacctaacatttatttagtatgtactgtgctgtagacactgttatagatattttaaatacttttcctcgttgaatcctcacactgacccaaagatatatagtacccattatccggttacattatttcctcatttttca

SEQ ID NO: 211534 - DNA, 218 bp, Homo sapiens
aaaatgtcagcacttacctgctgcccacattgtggacacatggatcagttcacaggtcagtgactgataacatgaggaaacaagaccagcttcagatctaattcaagaatagatacctgaccatccccatgttctcaataatataagctaataataatggccaattccttggccacatcagtaactatctaaagagacagccccggctgggtgcggtg

SEQ ID NO: 211535 - DNA, 213 bp, Homo sapiens
  misc_feature (12)..(12): n is a, c, g, or t
  misc_feature (37)..(37): n is a, c, g, or t
  misc_feature (50)..(50): n is a, c, g, or t
tacaagctttgnagactgagtccagctctgtcgcagnctggagtcagtgnccatctcgctcactgcacctccacctcttgatatgtggctaatgcttagcagatatttttgagtgaatcagtaaataaaatttcgctgccagctctcaaaggaatatgctgtggaagcttcagttacttttttttttttttttttttttggaaagggagtttt

SEQ ID NO: 211536 - DNA, 947 bp, Homo sapiens
acaatgcgcagctgaattgggatgaggggccaggacaaagcagaaatctgctgcagagagcaggaaagatattctgtagcaggatctgggcaagcggcactcatccatatcctttgcattgcaaagagaggagctacctccttcctttttattttccagtttattggtggctcctagaacctctgagaactaactgattttgacctcttaacagttgcctttcaactaccattcatttactgcaagcctactgtgtaacaggcccttgctaaccacttcagatatattgtctcttgtccagcttcaagtgactctcttagggagggattagcctcacctcactagtatggaaatggagacttggagtaatcaagtgacttgctctgaattacacagctgggaagtggtgaagctggaattcaactcaagttatgtctagatctaaaactcatgctcttttctatgctcaaagctgcatatcaaaactgaactttagcatggagtctatgatgactggctcatgtctctccacccagcacctagcccaaggccaagcacagagaaggctcacagtggacacttttggaatgagtagattttttatggaatggtcgagcacactgaactacctggagtaaaggggcatcatgtctgaaactgatgcttaagtggctcagaaaaaaaattctgggagctagagggagagagagacagaggagtgtggtaaaaagttaacattttggggatctgcgtaaaggtatatgaggattctttgtacagattttgcaatttttctccaaatgtgaaattatgtcaaaatataaaattaaaagacaaaattaaaagaatgaatgagagtttgctaggtagagaagcagggggatcttctggcaaaggaacaggataagcaaaagcatcacaagtgtgcgagtcttctgtgttgacaa

SEQ ID NO: 211537 - DNA, 516 bp, Homo sapiens
gaaacatgcagtggcagtgccagtttcccatctgtgctcgatttgcgcctactggtgtaattttcaggtatcttgtgtttacacaaatgctggaaaacaagctgcttcttaagcagcaaccgacagggaaggtcagcttttcccactgccatggccgtgccaggatgcacattgcaacaggcagggttctccagagaaagagaaccaataggagagagagagagacagtgtgtgtgtgtgtgtgtgtgtgtgtgtgtgtgtgtgtgtgtgtaggggtggggagagaaagggcgtgtgattgagagactgatttattgtgaggaattggttcaggccattctggaggctgagaagtttctatgttctgccatcagcttctggagacccaggaagacctgtgacataattcagtccaagtctgaaggcctgagaaccagggagctgatggtctaaatcccagtctaagggcaggagaagatgagaggagatatcccagctcaagcactgagccaagtt

SEQ ID NO: 211538 - DNA, 307 bp, Homo sapiens
cttgatgatatcttctctggaggcctggtgaacagaaggctgtcataataatatggaaagaatgatagcttggccttaggccttgtcagtagggatcaagaaaaaggagtaactgaaagacattatagtgatagagtgaataagttaagtgaccgattatatgaggtgaatcatgaggaggagttaaaggtgttggcagggaatataggaggagaaaaaaggttgagagggctttgtgaatatatatatatataatcacaatatatatgtactcaatacttcttacatacatatattacagtgttat

SEQ ID NO: 211539 - DNA, 532 bp, Homo sapiens
aatactataagtattacagaataggcatacaaaggaccatggatggcaacacataagaagaagtggcctacagtccctggtagcttagggaaggtgcctgggaggaaatgacaccatctgcattttcccctaatcagccaatgtaagagtactttaatgtggcaagtctatgatgttgcaagacagtcttaacctatctaagtccataaacacatggcaggtagtgtgactgtaggactagtaaaattgtaattatctatcatttgttcatgaatggttgagtcactatttaggctatatgactcttctttttatgaaaggagcagatttagcttctgagagaataggtattttttttctttaaaaaaatggaaaattgtattctttagactaccccaatagactgctgttatagtctgtgtcatgagtggtctctttgtatgaaaacctaaaaagaaaaaaaaagctattcttaagtacaggtgaattgctaccaaaaagaagcagcaatcatatggaggcttctgtatcc

SEQ ID NO: 211540 - DNA, 721 bp, Homo sapiens
catgaccgtaatcaagataatgtgatattggaataaagagagtcatacagatcagtggaatgaatagaagagagtctaggaatagatccacacatatatgacccactgatttctgataaagctgccaagaaggcaactcagtgggggaaatgatagtcttttcaactaatggtgcttgaacaactggatagccacatacagtaatatgagccttgacacttacctcacatcctacaaagacattaattcaaaatggattatagacctaaatgtaagagtttaactgtgaaacttctataagaaaacaaaattgtagtgaccttgggttcagcaaaaaatttttagatagcgtacaaaaggcaccaactataaaaaaatcagtaagttggactttatcaaaatgaaaaactattgcttcccagagaatgtttaagaaaataaaaacccaagccacaaatgggggaaaataactgcaatacgtaaatgaaagatgtgtaacatgaatatataaaagaactctaacagcacaataataatgagaaaaatacctaatttaaaatccaacaaatgacttgtaacttgtcaaatatttcaataggcactcaccttcatgccaaatagcacattaaaagatgctcaaaatcatgagtcattaaggaaatgcaaattaaaaccaaaatgagatctcagtatgttcccactagaaaggttaaaattaata

SEQ ID NO: 211541 - DNA, 326 bp, Homo sapiens
acattattctgttttgctgttagcaaaatagaaggctttgctgtcttctgaatctgtcctggatttcactgataattgccctagttcagggccccatttcatcatgcctgtttgacatttgtctcctaactgatttctctacctccacccaacttctatatttgatttatctccgccagtcaattgtccaatacacgcttcatcagcagtgcagattgggagaagaattctaacatgccccagcaagctgtatgcagtagtatgcacctatagtcctagctactcaggagcctgaggtgggagaatcgcttgggttcatgagttca

SEQ ID NO: 211542 - DNA, 295 bp, Homo sapiens
aacaaacaaacaaaaaaaacgtgttttaatgttaaaacaattttgaaaatctacacttacctgaaaccgcacttagagagtatcttaccaccctctggattcagcccaatcatgatacgatctttttagaacggaacatcactgcagccatacagaaattagaaggattataagggagcaatttcatgccaaaaatttgacaatttaaatgtaatagacaatttcctagaaagagacaagttgcaaaaactaaccaagacaaaggagaaaatcttaatagacttatatcaagtta

SEQ ID NO: 211543 - DNA, 194 bp, Homo sapiens
atgtttagtagagaagtacttacttgtagctaaaatgatgggatgaaggaaaatgaaaattagtttgtagatagtatttgggtacatgcggacactcatgaaatatgttgtatcgtttaaatttggtttgtagcacagtttcctttactttgtgtcatttaaaaaaattaaaacctagacagaagagaaacgta

SEQ ID NO: 211544 - DNA, 326 bp, Homo sapiens
aggggcttgctaaggtaggaagaaaacccagagactcccgtcctggaagtcgaatgaagagttttaagaaaagagtgacccaaagggtcaaatcagtcattggttagggtgacaagtgagaactgacttccggatttggcaaagaatgatccttagtgatcttgacaatatctgtttgggtgaagtgaaggtaaaagcctgatcgagtaagttcaagagaataggaggagagaaagcagagagtgcaagcaggtccaactctttggggagtttatctggaaagaggaacagagaaacaaggaggggatggggatcaacacagaatt

SEQ ID NO: 211545 - DNA, 267 bp, Homo sapiens
ctcagctcatggaaagaagatgctaaagatgaaggaagataaattgagaagagattttttggtatgactgtgtcaatagccttaagagttttgtacattcaacatacctggctgggcgcagtggctcacacctgtaataccagcactttgggaggctgagatgggtgaatcacttgaggtcaggagttcgagaacagcctggccaacatggcaaaaccccgtctctactaaaaatacaaaaactagtcgggtgtggtggaggctgcc

SEQ ID NO: 211546 - DNA, 758 bp, Homo sapiens
ccaatcaaagtgctggaattacaggtatgagccactgtgccaaaccaagaaatttattttcatattttgagatttgttattgaaaattacagatttttaaaaatgcaataacatataaaagtacatcatatatggttcagtcttactgaaccatttaatataatattttgtcaaagtactcaatttataaataaaatataaaaatcattaattgtgacaaatattttcctaaaatcttccaaaaggaaactatatatgtgtgaatacatataatttgcttgtatatcaatcatatgtataatttatctttctttttttctcagacagagtcttgctctgtcacccaggcggaggttgtggtgagccgagatcactccactgcactccagcctgggcaacaagagcgaaactccatctcaaaaataaaaataaaaataaaaaataaatgattaattcagctaaagactaatagatactgtatatttgcaattgttggagagctcgatttgtataaattgtttattttgaatctttctgagctcactcaccattatgtgctaatttttaccctgagaagtgtcaattatgataacattttggattagaaaactactttcatcctgttttatgggagatttttagagcatttttagagcattctataaataaggatacatcatggataggggttctgcagttttcagtagctggtagatacctgtaccttaagcacactctttgtcttaaataaagacaat

SEQ ID NO: 211547 - DNA, 568 bp, Homo sapiens
catttcagaaatgaggatggtgcaggctcaggagtcggcttgcaaggatggggaggggcttgggaggaaggtgtccccatcttgctcagggccccctgagtggacagcctgctcccccacacccctctagcctcatttgggcccagaatgctctggaattggcagtgttttttggaactgtgtggagctgcatttccgctgagaaaccctatcagtcaacgtcaccttccatcccttactgtcgtcacacgtacacaagaggcataatgcccagcgctggcctggctgcaggcaagcaagcagtcccagaggacactggtgggagtgttcatgattgctgccttgggggaaaatacattggcagtgtctttaaaaataaaaacccacgataccctttgattcagttcctttaggaacttctcctatagaaacaagaaaaaaaaagtaggtaaagatgtaagttacaaagatgtttattccagttttgtttctaatggcaaaagaaattggcaactctgtgagtggccgttagcagagaaaagtctcattaggatggttgttgatccac

SEQ ID NO: 211548 - DNA, 414 bp, Homo sapiens
caaaaattggctgggcatggtggtgcacgcctgtaatcctagctactctggagactgagacacaagaatcacttgaaaccaggaggtagaggtttcagtgagctgagatcacgccactgcactccagtctgggtgacagagtgagactctgtctcaaaacaaatacataagggacagaaaataagtattttaggctttgcaggccacaccacagctgttacaactaatcaactctgctgacgtagcacaaaagtagccacaatctataaccaaatgaacatagctgtgttccaataaaattttatttacaataacaggtggcaggacacaatgacctgtagaacatagtttgcaacccttggtcagaaaagttccaaacaaataacagtatcagagtaagccagggatttatgg

SEQ ID NO: 211549 - DNA, 200 bp, Homo sapiens
cttggctaacttttgtatttttggtagagacagggcctcagtgtgttgctcaggctggtctcaaactgggctcaagtgaagattccttttataaggctgaataatattccatgtgtttttatttatttatttcaaactaatgcagtttattataacaagaaggaaatcaagctttacagtaattatagtcactaagctga

SEQ ID NO: 211550 - DNA, 393 bp, Homo sapiens
aataaaaatgccattgatacagaccttagaaactggaaccttgcagaaataggaagtatctagggtggggtaagtgacagacttctctgacagacccctgctttacgcactgagtgctcacagagtcggggtaaggggttggggagcagccaaaggtcctcacagtttgcctcgcttggtggtggagtcactgcctcacaagccagggcaagggctatcagtacttcagtatactcagtggtactgtgcccaaggtagagctttgtccacaaactgggggctgggcagaataagagagctctcacatccatactgctcttgcccagaacttagccttagtagtaggtagctgagtgcaggatgatataatctgaagtctggtttctcctgaga

SEQ ID NO: 211551 - DNA, 255 bp, Homo sapiens
atctgaaatacagcaaccattatggactctaatgaaaagctagcttcaggaaacagtgaaacagcaagaatggagtcagtcgaggcttatctctaggtgcagaagatgtttcccaggggagtccttaaaggcaggcaacaaatatgcttctgaaccaagtctacaatgactatgttcagaatgtttacactaatatttgttgaatgctactgaggaaaacaggcttaggttaaaaaatcagattttatagttgtt

SEQ ID NO: 211552 - DNA, 728 bp, Homo sapiens
gaatacacccactttgaagaaaacacaaaacagcaactgctctctcaggccccaccatgaggcacaggacacagagggagtctcccaggaccaaagtgatctctgaggcccctcctcaccctgacgtgctgtgcgtacagcagccaaggaagaggcgcagagtcatgggagagtctcagggccacctgccctaagacaagctcaacagcacagaattccgcatgtgacgaagttggaacttactccactgaagctgatgcaggttcaaaaaaagccagcaggccaggcgcagtggctcacaaatgtaatcccagtactttgggaggctgagaatgcagaagaatggagtaagagaaaacccgcgaaaatccaaacaacagaccatttgtagctctagtccctgtggctgcagtagagaacagcaacagaaaacacggcctgtagctgtgaaatcaatgacacaattctcggagggagcaagcacatgctagtcccttccttcttcccagtccctcacagcactgacaaggaacactgacaaggagccacaggtggcatccacatggcactcaccatgccagggcagacatggaaccagcacatgtcttaggctagagcccaggttccattttcctacagagagtctccgaagtgcaaaagagaaactcagtcattccttctttacccttgctcacactagtgtcatctttaaaccagggccgctctca

SEQ ID NO: 211553 - DNA, 305 bp, Homo sapiens
ctcaggcattttactaaatcagtctgcattttaacagggtctctaagtcattggtatatacattgagaagcaatgctataaagcatatgtctttgatctgtattgaggacttactgtatactagctgtgggactttggtcaagcttgataacatctataagctctggctttttcatttgctaaagaataaaacaagtactgtgttcaagctatataattgtaatgaagatctattgaactagtatgtaaaaacatttttttttaggtcatataaataaagtttgttgacaccaaggatacataat

SEQ ID NO: 211554 - DNA, 253 bp, Homo sapiens
ggctagagtcagaccagcctggcaacatggcaaaaccctgtctctactaaatatacaaaaattaactgggcgtagtggcacctgtaatcccagctactcgggaggctgaggcaggagaatcacatacaatcaaacataattggtaatgtaccgaagattacattcagccgtgagtaacaggaaacacccacaatattcctgatatgaggaaagtgcttattctcacatcaaagtactgggtgaaaccagtcac

SEQ ID NO: 211555 - DNA, 420 bp, Homo sapiens
cacttatctagacgccagcatcaaaaggttcaaagcccaggtcacaggctcatgaaaaaattaagcaggtatcaaaaaatatcacaaaggcaacagttttatgacatgaaaacatctatcagagacaatataaacctgtctgctaatagaaccaggtaaaactgtctaaattaaattccgaagaaatttcaattttattttactaatgattttaaaaactagctttatttacccaacatgactaaagtcccattgacctgaaaagcatttgggcttatttacttaatttatgagtactcctttatttataagtctattcagtaccatgtagacaatgttcaaacacagacatatgcacgcatacataaaaatacaaatgaacacaaaaaaataaagactacatgcttttatttttaaaat

SEQ ID NO: 211556 - DNA, 382 bp, Homo sapiens
ctgaggcagatttcagcccttgcttgagaccaaggcagggcttcttaacaaggagaaccagcctataagggcagtgactgggcccctggcagtgagtagtgatcttctttttttttttttgagacggagtctcgccctgttacccaggctggagtgcagtggtgcgatcttggctcactgcaagccccgcctcccgggttcacgccattctcctgcctcagcctccggagtagctgggactacaggcgcccgccaccatgcccagcgaattttttgtatttttagtagagacggggtttcaccgtgttagcctggatggtctcaatctcctgacctcatgatccgccctccttggcctcccaaaagtgctgggtttaccggc

SEQ ID NO: 211557 - DNA, 458 bp, Homo sapiens
actgcagcgacttcttgataggatctaataagaagagccttcaaataagcatgacatggaactaacaagtacattctaaagggaaggaaagcttttacagtgaagacaagcctgagagggagaattgttgaaacagattagttagtattttagaattgcccttcctgttcttgttttctatggtggcaagagcagcacgaagtgcaaggtcatactattctgaatggagccatcagggcaagttttgttattcagagttactcgtggggcagcctggatggggagctctgatggagaatatatggaaatagcttgtatcttcttggcacactgacaataccaactctaaagggccactttagcttttaggcactaaaggcccaacagggaaggcctatgaattttggggggacgtctaaaactatttgaagcctggaaaagaaatgtattggctccaa

SEQ ID NO: 211558 - DNA, 513 bp, Homo sapiens
agacatatttaaagtgctgaaggaaaaaaaatttaccctggaatagtgtatctggtgaaaatattctttaaacatgaagatggaataaggactttcccagacaagcaaaatctgagggatttcattaacaccagacccatcctatgataaatgctaaggagagtacttcaattagagagaaaagaacattaatgagcaataaataattacctgaaggtacaaaactcaccagtaatacctttttcctgagactctgcaagctgaagttcatgtaaaaaccatcttctgacatacaaacttacagacccgaaaagtctgtcaagattgccactgtctacttcaactttaactgaagatgcctttagtctaacatcaagacacctcaaatgattgccctccatactctaaggaaactggtttatagactgttccaaacattaatctttgttattgagagactgtctacaacataatctcttataataaatacaaattttccattgtaatggccta

SEQ ID NO: 211559 - DNA, 451 bp, Homo sapiens
ttatttgcaaaatagttatttgaaacactgcatccaaaaaaacaaccattagattccaaaacttccctccaaaacttactgaatatttaagtaaaacaatagttcttaaaaatgccagagaatagctgcagactctgcagaagtggttacctccaagaaaggcctttaaatgtgagcctcattgtgttttggatttgagccttgacttcaacattgggtcatcctattcaggtgattgtacctctaggctttagtttctgcatctacaaaatgggaataaaagcaacaacttcggagagttgttttgaggaataagtgtgacaatgtatataaagaacttaggccaggtggctcatgcctgtaatctctgtactctgggaggcaaagccaagaagatcacgttaggccaggagttcaagacgagtgtaggcaacatggcgtgatgctgtct

SEQ ID NO: 211560 - DNA, 402 bp, Homo sapiens
gctggggaagtgagcagagctctgagggccgccgcctgcgcggtctcttggtgggaagcaggactttgcgtgtgagcgttgcgcttctcccagccagaagtcggaattctaatgtccaaggcgtggtgtgttcagtgagattcgtatttttaaaaaataaaatgatttaagagaaaaacctaaagctaccaggagtggggttcgaacccacgcggacatatgtccattggatcttaagtccaacgccttaaccactcggccatcctggtgcagacgttgaaccttgtttttgctccgcttacaaggcatcctctacctcctcctgcccgcaccctccctccagaacgcagagagttttcgccgccactgtctcggctctctcagcccgggctggggcggccg

SEQ ID NO: 211561 - DNA, 515 bp, Homo sapiens
caaagattttcacacccaaaggcctgtgtttccggtggcattcgctttaggtaagcatatcagtccagattccccagaggaaagaatcaataaacagaagcaatagactcataggggatgagagacagagagagagagagagagactgattttaagggattgactcaccgccatggggactggcaaattcctaatctgtaaggccggccagcagggtggaaacccagcagagtttctacgttactgacctgaggcacaattccttcttctccagaaaacctgtttgtttgcttgtaaggccttcaactggtgggacgaggcccacctacatgatagagaataatctctttgacttaaagtgaatggactgcagatgtcagccacgtcgaccaaataccctcccagcagcacctagactagtgtttgaccaaactccaggcactacagcctggccaagctgacacggaatgttaacaagtgaaccacatccaaatcctgaaactgcaggtgtcaac

SEQ ID NO: 211562 - DNA, 442 bp, Homo sapiens
tgtctggtttcctttgccgcagcttataacctgcctaatttcctaaaaatggatgtgctcttctcaaatgctggttcctaaactgagccaagaccaaaggtctgggtcgaaagcagtgagcccctagggccttcctcattggcttggcagagagtggttttaccttttctgaccaccaaggctcctctggagcctccccaggcctcaggtgggaaccctccctccgtaaacaaagaagcaccctccccatcacaggctcccagtaaacaatgtcataagcacatcttaggcacttattgggttagagcagttgcaggaatggagcaatcagtcatttctacttcttatgtcttccagagtcaggttagcagtctattagaaactccataaattctcttttaaaaatcgtagaatctcttgtgatccctggaataatgaaatg

SEQ ID NO: 211563 - DNA, 215 bp, Homo sapiens
  misc_feature (165)..(167): n is a, c, g, or t
  misc_feature (188)..(188): n is a, c, g, or t
  misc_feature (192)..(192): n is a, c, g, or t
  misc_feature (206)..(206): n is a, c, g, or t
agtgttcctggcagggtcagactgctcagataggtggacagataacccagcttttcactaacagtcaggttacttccaatagaaatgaagatgactgtggctttttaagacctttccttctgcaggtagcaaatatacatatgatggtaacctcgagaaatagcnnnccaatggaatatcatcaagcnagtnggagatatcatgcntccagtgga

SEQ ID NO: 211564 - DNA, 650 bp, Homo sapiens
aaagtgtgaagaatgttccaattacaggaaatcctgattagtatggataccaccaatttaaaattcatgataattaaggcccagttagacatcacaatatgtatgcggaagaaagggggcagatgctggaggagttggagaggtgatgggcaaatagatctatggaaaaaacttttaaagaaatccatcaatactgacaggaatactaaaaataagcaaattccatgtgaatcttattggctgattaaaaagtattacccttggccaggcgcggtggctcatgcctataatcccagcactttgggagactgaggcgggcagatcacctgaggtcaggagttcgtgaccagtctggccaacatgatgaaaccccgtctctactaaaaatacaaaaactaggtgggcatggtggcgggcacctgtaatcccagctactcgggaggctgaggcaatagaattgctggaacctcagagacggaggctgcagtgagccgagatcgtgccattgcactccagcctgggtgacaatagtgaaaatccatctcaaaaataaaaagtattaccctttggtagcattttgtaagccgtcagtttgtagaggcaagatggtgttagtgaaaaagcacctgattagaaactagaaagcagct

SEQ ID NO: 211565 - DNA, 740 bp, Homo sapiens
ggtggcggccgctctagaacaagtggatcccccgggctgcaggaaatcgaattcccttcccccaccagtgagaccccatctctaaaaaaaaaaaaataataattgaaaactgtgcgaatggggtttttgccaattttttttgtcatcagtccctcccgtacgtaggttcataaattttgttctctatcacctgtataaaaataaaaagaaaagtacatttaaataaaaccttagttaagctggacgctttgggtgagaatagcttactttgtggcatttttagtaaaaagctgtattatttatttattgtttgccagaatttgataatatactcaagggggaaaacccagtatatcttttaactaggaactttttacaaattagcatttttcttccaagagtcatgcatataattcttagaaagcagaactgtgacttggccttcagctcaagctctgtcacctggagtccacgagtgctttcttgttttacttgtggcttcaatttcagttttccttctgataaatcacatctcccttgttaaatgttaacaggaatattaagaatgagagtttggatggatgaaaagtaaacctaggccgggcgcggtggctcacgcctgtaatcccagcactttgggaggctgaggtgggtggatcagctgaggtcaggagttcgagaccagcctggccaacgtggtgagaccagcctggccaacgtggtgaaaccctgtctctagt

SEQ ID NO: 211566 - DNA, 411 bp, Homo sapiens
agcccaactcccagtacccagaatgtgactgtacctggagacagggtctcccgagagatcattaagccaaaaggaggccattagggtgggccctcttccaatccgattggggtccttaccagaagagatcaggatgcagacgtgcacagaagggccaccctgtgaggacacagagggccaagggccatcgatcagcaaagggaagtagcctgggacacagtcgtcctgcagagccactgaggaaccagccctgcctacaccttgaccttggccttccagactgcagagtgcgagacgctcaatctcttgtttaagctgcccagtctgtgggatgttgttctggcagccctgcgaaaggaattcagaccctcttagccaaggggaataaatgctctaaggtttcatattaaa

SEQ ID NO: 211567 - DNA, 477 bp, Homo sapiens
gacatacctttcccctagacatgttactttgcaagattccctaggcacaccatgttctttcctatttttgcacatatacggttgacccttgaataacataggggttggggtgctgagcacaacccccgaccccagtcaaaaattcatgtacaattttgactttccaaaagcctaattactaatagcttactgttgaagccatactgataacataaacagttgatcattaacacatattttgtgcatgtattatatactatattcttcttataataaagtaagtgaaagaaaataaagtgttattaagaaaatcagggccaggtgcagtagctcatgtctgtaatcctattgctttgggaagccaaggtgggaagattgcttgaggccaagagttcaagaccagcctgggcaacatagcaaaagcctgtctctaagaaaatcataaggaagagaaaatatatttactattcattaagt

SEQ ID NO: 211568 - DNA, 485 bp, Homo sapiens
gtcccccaagtctgcctaattggcttgtttccagcatcagcagtttagtaagagactcgattagcaatttggtatctttagagttttcacccgttagtaagaacaaataaatgaaatacattcttgcctttctacctagagtcagtcttggggaaatttaccaattttggtgtgtggtccaatttattaaatgtttacattttgtctgtatatgtcttttccatagtctagtatggttactcaatatcctatctatagtatacacctagaattatccaagttaggacatcagagtgtacttctaacctcaaaaggcaagctttttcctttgaaattgtgtcaatgtagtttatatattgattttataatgtactccagcagtagaaggctatgtcaaatgtaccagaagaacctttttttggtaccaataagatagagtttatgtttaattattataattttaataaactatttaaattcaggca

SEQ ID NO: 211569 - DNA, 383 bp, Homo sapiens
agaacacttaactgcggctctactgtgcactcggtaatgttctcggtgttggacatatggtggtaaagaagacagaaaatgcccagccttctatgaggctgacattcaagtggagaaacatgggaaataatcaaataaatagaccaccaaataggtcaaatggtgatcagtgcaatgccaacaattagaacatggtgatgtgctagaagtgtctggattgtgactttagattggatggccagagaagaataatataagaatagcatcaaaatgttactcgtgggcttcaggtgcccacctataaaataggttacctggacaaaatgatttttgcatgcatctgtctagaccggagacctgacttaatatatcacatgaattta

SEQ ID NO: 211570 - DNA, 1108 bp, Homo sapiens
tcttctgttattgttcctgctaccagaagacatttttcttcgcagattttggtcttagtatgatgattaagataaagttaataatttattaattgaaagtgagtcagactcttatccattactatattctaggaaaattggaaagtttaatgttattaattctaaagctaagcttaatgcttctgagaagctcaaagggcattattgcttatagaccaatgtctacaaagctgtatttaagtcaggaaagggttatcacaagctgatttagtgcagcaaccaagtaaaagatgcatgagaacagagttctcaggtgacttcttgatgtttctgtaaattatctgtctggctttggaataagcacttatttgtggaaaatgtattatttacagtttggagtaaatgttcatagaaaagttacccagtttgatgctttgtcgagagctggatttaagtttaaatcttggttccccacttgctagctgtgtgacgtatctgttaggaatagatttagctttaagtagtaacagtggcaaaactacaaaggggtttatttttctcacataatgagaaatctttttcagtgacagtaattatagtaatgttcagcgatgccagggctggaatctctgtgattcttcgaactttttctaataaagaaaacctggctgctttagcttgaggcgtcatatccacatggtgggctgggagaaaggagggaagggcaaaggcagcttttatcaggacaagataattttgcttatgtctttggccaagtccaggttatgtggttaagtccagctgaaagactggctggcagatgagtaattagctttttagcggctgaggtagaggcatgcaaggaagagtttgggaatggacgtggggttggtcagtctacagagtctgccacagtgaccatgagtgccactggtaacctgaataagcctcacttttctcttgggtatagtaatagaaccactgggggtgggacttggactttttgtgtaccactaaatctctagcatctaacacaaggcctggcagatgtatttgtttggtgaattaatacatgaagattatcatgagaattatatgaggtatataa

SEQ ID NO: 211571 - DNA, 1286 bp, Homo sapiens
ggtcactgctctctcagcaaattacagtcactgtcacttagcatggagagtggacgttgcacatcactgtgaaaccttgcagaggaggagagggcaggttcatcagaagaaagaaaggacaaaatgactccttatgaagcattttgtgccttctgtgagaaaacatgtatttagatcagataaactctagtcaaaatacaaaaaggaaaaatgaaagacctctgaaataggaacaatctcttgaagaggcaaatgactcaaaactgctcagtggctctttcagaaaatctaagtaaagttccctgacaacagaaactgaagagattgcctggttcatcttgtagtcttccaaaacagcagataatttctgaatctcagatgttgaatcagtacaacgggatggatttcttgttcctaagtgttaaatgatcacatacataaaagagtctgagcctgagcaacatagtagagaccctgtctctacaaaaaaaaaaaaaaattagccaggcgtggtggtgcacactgatagtcccagctactcaggaggctgagggaggcggatcaattgagctagagagttcaaagctgcagtgagccatgtttgtgccactgcactccagcctgggcaacaaagtgagaccctgtctggaaaaaaaaaaaaaaaaagcgtctgcataattcctggtgcattttgtggatatacaatatgagtatgtgttccatgttttcagaaattcaaaggaagcgtttccacaatatgtgacggtttatttcccaagagatgaaaagattcattaaggtgcatgctttgatttaacatctgcaaacatttaaaaaatataacagtgtgtgacgtagcagtgagagtactatctttttttaaaaagggaaattaagatttatttctggccaatgtgaacagaaataagtcactttatctcactgagcaccaattttacacgtggaaaatagaagaattggaccaaatcagcagtttcaagctgagttgcaaaagttcatggaaccatttcagtcgcttcatggaatcggggtaggcatgaggcccgttgttctttcaacctgagccgcatggctcttgtgtctttaaaccttgtggtaggatttttttttttttctgctttaataagtgaagggtcagggcaccagttggtgtctgagatgccctccagtctggggaaccccgtagatgcttagactactttgaactgaagtatgtgcagtctgccatctcacattaaaatgtaggcattttgtcaattgctttt

SEQ ID NO: 211572 - DNA, 579 bp, Homo sapiens
cagttggaatctagctcttctgaccatttccccaatgctaatgggaccccgggattagagaatagtaacttcaggtatcctattcctggaatcccaggtgtgttcatggctgtgagggcgctcagcgcatgcatgtatctggccagatgccctaggccaggcatgtccacgttgagcattgttgttgtttttctttctctctgtacacttctcttgatgatgtcattttctttatcaaaaagctttactaaactcctgctgtggtttgaatgtgtcccccaaacttcatgtattagaaagttgagactgggcgcagtggctcacacccgtaatcacagcactttgggaggttgaggtgggctgatcacctgaggtcaggagttcgagaccagcctggccaacatggcgaaaccccatctctactaaaaatacaaaaaaaattagctgggcgtggtggtgggcacctgtaatcgcagctaccagggaggctgaggcaggagaattgcttgaactcgggaggcagaggtttcagtgagttgcaccccagcctgggcaacaagagtgaaactccatctcaaa

SEQ ID NO: 211573 - DNA, 405 bp, Homo sapiens
ttgacaggaaggacgggaggaaatcctgctcgagcgcacctgttttccaggatgatatgtcgcttttataaatggctgcaggtccctttgagaaaagcttgggacgatttctggggtgcacttgcagcagtggtgcaaggtccttcccaggggaacctagcctccctttccatcatgggactctggatgccggcggtgacttaggtctggaaactgggttcgaggctgtaacaccactggggcagtacaagtcaggaattgcggcggagtgccgtggctcacgcctgtgatctcagcactttgaggggcggaggtgggcggatcacttgagcccaggaatttgagacctggacaacatggcgaaaaaccgcctctacaaaaattaaaaactaaaaattggctggg

SEQ ID NO: 211574 - DNA, 626 bp, Homo sapiens
ctcagcctcccaaaatgctgggattacaggtgtgagccacggtgcctgggccgccctcctactctgtaagtgcatgttgctcttgtactatgagcccctctggttaggatggcctctgcacttcttggaagtccactggaatggtgataacttcccactcatattaagtgatccctgttcattggctgattggcattccatcattaatgtttgggtcatttatagctaaaccagcagagcctagtggatcattctctagcgagcctgtctaatttgagtgatctttttttttttttttaaagacaatggtataaatagttttatgttaaatatcatacagactttgaaatgttcaatgaaagatagaaggaagataatctctaaagggcaaagtaagttgtttatggagacttctataaagcacctgtaaatcatttgggtgtcaatactgtgcatgttttataatggagaataaagtttccttaatgatgcttgtgtttgaagtataacgttttgcttttcagtaatggtctccctgactataattgtgtctataactttagtctgttacggaaaaaatgaaatggctgatagataagagttctgatttcattatgaggtaagaa

SEQ ID NO: 211575 - DNA, 478 bp, Homo sapiens
gagatggaggttgcagtgagccgagatggcgccactgcactccagcctgggcaacagagcaagagtgtctccaaaaaaaaaaaaaaaaaaaaagaggccgggtgcagtggctcatacctgtaatcccaggactttgggaggctgaggtgggtggatcacttgacgtcaggagtttgagaccagcctggcaaacatggtgaaaccctgtctctactaaaaatgtaaaaattagatgggcgtggtagcgcacacctgtaatcccagctactctggaggccgaggcaagagaattgctagaacccaggaggttgcaggttgtggtgagccgagattgcaccactgcactcctgcctgggcaacagagtgattccatctcaaaaataaataaattcattcttctaaagaattattctagaaattattctaaagccagtgtccatgcattttgattaacaggactggatgatataaaatcctc

SEQ ID NO: 211576 - DNA, 702 bp, Homo sapiens
tacaataggctaaaactataggagcataatatcttccttgaaagtctggatattaattggtggtgcatgtaattagacaaaagacattagctcctcctccttacatttttttttccaagagcaaatctcccttaaaatttcatctagtactttaattgtttagaaattaactgtttaaccattctaattccaaaggacgaaagtcacaattatgaaggtggatacatataggttatgtgccagcaacaaatgttatatattaaaaaagttgttgtggaggagttagagcagaatgagaatcagtcttctttgatagatatgtaacagaaataaaaatattttaaaatataggagatgaatataagattggcatttttaacatcattgtaaaagtaaaacaaagagatactatggagcaaaatgatcataagagggtaatagttatgatgccaggagtttcaaaattcccagaagtcagaccctgatagctctcttgagggctttgcactgccaatgcagatgtttccaatgttcaggaaaaactttgaaaaactagagtgtctgggcagggagagaggacagtgggatcagaacatgcagcagctgcctctcatctggtttaatggactgactttaagggcatcttctaaggaaggttggtactgacagtgtaagtcattcctttggcactctgcattcatt

SEQ ID NO: 211577 - DNA, 128 bp, Homo sapiens
tatatttgagacctgaatttaacctcagttttttgttaaaccaggttctggaagacttaactttataagaaatgaacatatattctgtgtaattttcccatcacattaataataaatgtttcagaaat

SEQ ID NO: 211578 - DNA, 276 bp, Homo sapiens
tccaaacccacagactagaaggcccaagaggggaatttgcctttctcagaaaaaactccaaggacagagaccacccgttggctttctcactttcccatcacctcatcctgcagggcatttgaggcagaattgggtgtttggtcaacctgggcagtggggcagaatgaaaggcctgggttcctgcccagcttggcctttccttagcagctgcctgactttggagggtccagtgggctgggggccatttcctgagcgccccaggctgctgtgatgcgg

SEQ ID NO: 211579 - DNA, 399 bp, Homo sapiens
ccattgttaatcataatgcataattccctgtagggcttccttctccagttgaatccctttgttctgtgatacaactggggaaaacatctaggggagaaaaactcttcgtattgatactcagaagaattagtttgatgaccaagacaatctgctaataatatttgagtggaaagatgagctaagggaattcttgaagtacaaatttacctaatggttgttttttaaaccttttattagggtaaaatttaagcacacacaaacatagagatggtataattgaaccccatgtcccattcacccagcaattatcaacacatggcaatcttttttcacctattacctacctctaccacctcctgctcttcaataaaatgatctttaacacaaaagaaaaaaaaa

SEQ ID NO: 211580 - DNA, 309 bp, Homo sapiens
ggtggaatggaaacaataatccatccaaaagaagacagaagaaaaagagaaacagaagagacaggagaatgagaaagcacccggagaaaatttctgcaaaatataaatcggataagggcttatgtccaggttatagagagaactcttaagacgtaataataaagacaaacaacttgataaaaaaacaagtgggcactttgggaggctgaggcaggcggatcgcctgaggtcgggagttcaagaccagcctgaccaacatggagaaaccctgtttctactaaaaatacaaaattagctgggtgtggtggc

SEQ ID NO: 211581 - DNA, 354 bp, Homo sapiens
agctggtcttagggttacagcaggctgtttcagcaactgggcctctggatagttcagttcttggagcctgtgctatgtgccctgagtgcttttttcccctgactccttgactcttatgtagttgggtatacaagaatgacccaattcatgtaatcaactttcacagatccaaatatcattcagttgaaattaagactcattttattttggtccatttaaaaaatgttgtcttttaaaattacatatgtatttttattgtggtaaagcagacataacataaaatttaccctttcaccaattttaagagtgtggctcagtggctttaattttattcacaatgttttgcaatcatca

SEQ ID NO: 211582 - DNA, 286 bp, Homo sapiens
tatatggagtgggacagaccttagaacagctaaaacaatcttgaaagggaagaataaggtgggagggatgactctaatattaaggcctgcgatataaccatcataaccaagacagcatgacaatgtcacagagggagacccatagatcaacgggagggagtaaggacccagaaacagacccacacaaatatggccaactaattttggacaaaaatgcagaagcaaatcaatggagaaaggatttcaacaaattattctgtagtaactgaatattcatccatagaca

SEQ ID NO: 211583 - DNA, 217 bp, Homo sapiens
aaataaatagccatggagtttttttctccttcttggctaggaaatatttaattacctaatgcttacaaagagaacaggatgtttgccttcaatgttatgcaaagaacccgcttcccttcctccagagctcacttctcaccaactcacctgcagagtacagcaagcctcctcatatcaagacattctccatcacagctgagaaaaaatgctttcatct

SEQ ID NO: 211584 - DNA, 558 bp, Homo sapiens
ccccttctcctgcctcttgcattttaacacataaagcagataaggtggaggagagaatggggctggaggagaatgttcgagttacccagagaagacatgagcaagtagagcaaagaaagaactgtgacctcccagtcacccatatttattcctttatcaaagaacgcaggagttagacttctcttttcctgatctattgtttctggagctcaggaagtacaatgcaccatggcaagtcagagtcatgagtttcaattccaccttccccattatctggctaagcaatggtggacttaatccaacgaggttcagagtctacatttataaaacaggggttatatcagtacttatgcctcaaagataacataggtagagatttggcatactgcttggcacatactaaccagtcaatgactgttagatattatcattaatactaatcccacagagtcagttgggttgcaaactgttttgcaccaaagtcaacattatagcacccactgtcacaatcctttgggcagcatcatctctttgcatcatccttgttggatcatgtgt

SEQ ID NO: 211585 - DNA, 385 bp, Homo sapiens
tacagtacaggcacagctggggagcaagggaccccttcttctgccaagctgcttccttctgcaagccccagggtggccgagtgcctgctgtgggccagacctctgctaggcccatcaggacacccctgtcctcagggtccaatgctgccaaggaggaggcgggggggtcggtgcagcgcactgtaggagtgggaagtcaaggaggcatcgtggaggagtgcggcttcccacaggcaccccttcaggctttcaccagctccctttgttgcaaggatgtgaggatgactgactttggaagtcatgccaaccaagtccctgctgacctgatcacccacccactactcttccaggaccaggaaataaacttcttttgtgattaagcctt

SEQ ID NO: 211586 - DNA, 398 bp, Homo sapiens
tcaattttagctgctggtcatcgttgatactattattgcagcaataacaagcctaatggctttcagtgctctgccatacgttttcagtcatttacagtgctctacagtcgtttcagtgctctgcaagcccagaattgttagcctcttatgcttggccttgatgaaaataaggcagctagagaagaaagatatgagttcatgattacctatctcatagaattcttatgaaaatcccaagagatataaaccataaaaaaagccgtaagatcaggaaaacacaaaacaaatggctagaatttaacagatagtaaaatatacaaaagtcaagagacctccaaaaactaagctcccaaatccaataagactcaataggagctaggatttcaatgcatactaat

SEQ ID NO: 211587 - DNA, 331 bp, Homo sapiens
ataagactaatctaattaaatcctcataaaaattgtgtgagatgtatatttaaatgaggaaacaggttcagaaaggttatggccataaatttatcaagtcatagaactgggttttctttttttttaatcaagtgcagaatatttgaaaacctccattttcttccactactctatgcttccctgaaggaatgtgaccctattggtagaatttagccctgtactcatattttatggtaaactacataactaaaaaggcatctgattaaatatagggttgtcatatggttttaatacacacagtagattaaaataagatttgtttgcctctcta

SEQ ID NO: 211588 - DNA, 528 bp, Homo sapiens
agcaagatcaggaggagacttgtatgggcctgtggttctccaggaaatatagctggatttagttagtttcaggatgaaaggaaactggtagtcaaggtgaggaaaaaatttaggctaagattagaaatttgagcaaatcggtgtttaagttaatatttttaaatgagtctcataactttgagttccctaatccctaggatcgcaaaaattttttgaaagcattaaatagaatggcttgggctgggcacgggggctcactgctctttgggagctcacagcactttgggaggccaaagtgggtggatctcttgagtccaggagttctagaccagcctgggtagcatgttgaaaccatgtctctaaaaaaaataccaaaagtagctgagtgtggtggcctgtgcttatagtcccagctaccaggaaaactgaggtgggaggatcacctgagcctggggttgtagagattacagtgaccactgatggtgccactgcactcctgcctgggtaagagactgagaccctgtcaaa

SEQ ID NO: 211589 - DNA, 451 bp, Homo sapiens
tacaagtataacgtaattcaaaatgacttcagtctattttatacttgatgtaagtatagcttcccatagtgaaaatcacctttcttctcccctgctacatcctcatcacagagtgtaattcttatgctgaggttccaaacccccctccttgaacagtgacacagctaaaaaaaaaaagtctcctatcccaattatacctccttcctggcagcgaactctgaaataaaaccacaagattaatattctgatttctcctgcaatagtcaccaagaagctctgaaaggcttagtggctgattttgaaaaataacaagaaattgctaatgcttgggaaaaaaaatctatttccatttcaggagacaattctgcaattattttcattgttcatttgaatgtactgggaatttttaacttagagaaagagtgaaaataaattgttagttcattatact

SEQ ID NO: 211590 - DNA, 717 bp, Homo sapiens
tagtagagacggggtttcactacattggccaggctggtcttgaactcctgaccttgtgatccgcccgcctcggcctcccaaagtgttgggattacaggcatgaaccaccgcatcaagcaagatggaattctttagccctgagtttggtgtactgagtcagaggaggttgtatatctatactcccctcccgccacaattatggagtaatggtgttgaaagttttttgaacgaccacatcctttttgcatgatactgatgtcaacctctagtggacagagtggtattaacataagtggaaatcaaaatgaggccttgggaataaataatcccagcattttgctggccccattttctgagcttgccagcaatttgtcttcactcgtggctgccagtcagggttgggcacttgggattttaagttttagtgtttaactactactgtgaggttgggtaattcattttcttctaatttacttgggtcaagggactctaagaaactattgaaaaagttttgtttaattatatatatttccataaaatatatttctgaaaatgttatttactaaaattgttatctatatgtgaaatttttttcaatgcagaaaactctaggtattctaattttaaaggagcttaagaaaggttgagacaatctgatatttgcagccatctactgtgcaagaatattggtaaagtcttgttcaaacttaattcttt

SEQ ID NO: 211591 - DNA, 789 bp, Homo sapiens
tgtggtggctcatgcctgtaatcctagcactttgggaggccgaggtgggtggatcacctgaggtcgggagtttgaggccagcctgaccagcatggagaaacccccatctctactaaaaatacaaaaattagctgggcatggtggcacatgcctgtaatcctagctactcgggaggctgaggcagaagaatcacttgaacccgggaggcggaagttgcggtgagctgagactgcactgttgcactccagcctgggcaacaagagcgaaattccgtctcaaaaaataaaacaacaacaacaaaaaacaaccaacaaaaaacaagggcaagagtgtacaaagatatacacatgtaaggacaaaccaacaattttctcttaatgattactcataaggggaagggcaggaacaggatggcgactggacagaaggtttgccttctctggatagattttatcatgttttgctgatttgaatctggaaccttatacacattttacatgattataaaagaaaaccaaatttttaaaagataattccaaaaaataacatatcaaaagcaaagtgaaacaaatgaacctgtgtgtcaaactgatgatgtaacaacagagagaaaatctgaatttaatcaagcttctagatctaactaccaattcacaggaaagacagaggacagtagaacatgttaagcaatactataaaattcagaccattggaaattctagaagacaaagaatctaggtattacaacaaattacaagaaattaaaaaaaggaagagattaaggggaac

SEQ ID NO: 211592 - DNA, 429 bp, Homo sapiens
tttttccatgtacagtctgtcacggcttcccttggcctgacgagggaaattcccagaccccttgcacttcctgagtgaggcaacaccccgccctgcttcgcctcaccctctgtgggctgtacccactgtccaaccagtcccaatgagatgaaccaggtacctcagttggaagtgcagaaatcacctgtcttctgctttgttcacgctgggagctgcagaagggagctgttcctatttggccctctttgaacggaccgtgacagagatcaagaaataatattttttaaaagatcctcttctgttcttgaaaatgcttacaatacaatacacaatttaaaaagtaggctaaaaacaatctaaaatcaccaatgctaaattaaaaaagagaaggaagagggactagagctaaagaaaggaaataaaaataaa

SEQ ID NO: 211593 - DNA, 341 bp, Homo sapiens
aaaaaaaagtgtgagaacaaatggcttgccaaatagagaatatcgagagagattaaaattatttttaaaaaagaaccaaatataaattctggagttgaaaagtacaataatagcagattagagcttgcaggaaaatcagcaaacttgaagacaggtcataagattatctagtctgagagacagaaaggaaaaacaatgaggaagagtgaacagagcctcagagacctgagggacaccatcaagtgtagcagttgacagacaccactggtctccctctctatcctttccctccctccctgatacttctgtcaccctgcaaaaaaaacaaaaaacaaaaaaca

SEQ ID NO: 211594 - DNA, 906 bp, Homo sapiens
  misc_feature (234)..(234): n is a, c, g, or t
  misc_feature (237)..(237): n is a, c, g, or t
  misc_feature (242)..(242): n is a, c, g, or t
  misc_feature (248)..(249): n is a, c, g, or t
  misc_feature (251)..(252): n is a, c, g, or t
  misc_feature (266)..(266): n is a, c, g, or t
  misc_feature (277)..(277): n is a, c, g, or t
  misc_feature (282)..(283): n is a, c, g, or t
  misc_feature (294)..(294): n is a, c, g, or t
  misc_feature (301)..(301): n is a, c, g, or t
  misc_feature (309)..(309): n is a, c, g, or t
  misc_feature (342)..(342): n is a, c, g, or t
  misc_feature (353)..(353): n is a, c, g, or t
  misc_feature (355)..(356): n is a, c, g, or t
  misc_feature (358)..(358): n is a, c, g, or t
  misc_feature (362)..(362): n is a, c, g, or t
  misc_feature (371)..(371): n is a, c, g, or t
  misc_feature (373)..(373): n is a, c, g, or t
  misc_feature (376)..(376): n is a, c, g, or t
  misc_feature (382)..(382): n is a, c, g, or t
  misc_feature (388)..(389): n is a, c, g, or t
  misc_feature (395)..(395): n is a, c, g, or t
  misc_feature (398)..(398): n is a, c, g, or t
  misc_feature (402)..(402): n is a, c, g, or t
  misc_feature (406)..(406): n is a, c, g, or t
  misc_feature (410)..(413): n is a, c, g, or t
  misc_feature (415)..(415): n is a, c, g, or t
  misc_feature (423)..(424): n is a, c, g, or t
  misc_feature (436)..(437): n is a, c, g, or t
  misc_feature (439)..(441): n is a, c, g, or t
  misc_feature (444)..(444): n is a, c, g, or t
  misc_feature (447)..(447): n is a, c, g, or t
  misc_feature (454)..(454): n is a, c, g, or t
  misc_feature (457)..(457): n is a, c, g, or t
  misc_feature (469)..(469): n is a, c, g, or t
  misc_feature (482)..(482): n is a, c, g, or t
  misc_feature (489)..(489): n is a, c, g, or t
  misc_feature (501)..(501): n is a, c, g, or t
  misc_feature (524)..(524): n is a, c, g, or t
  misc_feature (530)..(530): n is a, c, g, or t
  misc_feature (534)..(534): n is a, c, g, or t
  misc_feature (541)..(541): n is a, c, g, or t
  misc_feature (544)..(544): n is a, c, g, or t
  misc_feature (547)..(547): n is a, c, g, or t
  misc_feature (567)..(567): n is a, c, g, or t
  misc_feature (570)..(570): n is a, c, g, or t
  misc_feature (573)..(573): n is a, c, g, or t
  misc_feature (575)..(575): n is a, c, g, or t
  misc_feature (591)..(591): n is a, c, g, or t
  misc_feature (593)..(594): n is a, c, g, or t
  misc_feature (599)..(599): n is a, c, g, or t
  misc_feature (602)..(602): n is a, c, g, or t
  misc_feature (605)..(605): n is a, c, g, or t
  misc_feature (612)..(614): n is a, c, g, or t
  misc_feature (617)..(617): n is a, c, g, or t
  misc_feature (632)..(632): n is a, c, g, or t
  misc_feature (635)..(635): n is a, c, g, or t
  misc_feature (637)..(637): n is a, c, g, or t
  misc_feature (639)..(639): n is a, c, g, or t
  misc_feature (642)..(642): n is a, c, g, or t
  misc_feature (650)..(650): n is a, c, g, or t
  misc_feature (897)..(897): n is a, c, g, or t
agaaaatttaacagaataagataaaataattgccatagcaaagaaaggaaaaggaaagataagacaaatgcagaaggaagaaaaagagagaaaaaattatgtagtaactttcaggttttaatatatttgcaggataattactagtgtatataaaacctgattacatttctagccaagtttctagtactatcaaccaggagttcacacagttttagtcctgaaagggttttggcnttnattcntgcgcnntnntgtaatgtaacggngggggcgggantgggnngctgctaagcnccacacnggacaatntgcgcccttttctaggacaggagctgcacattnaatggcatggncnncntccngccgctccnanatnatcacncaggannaggccnggngccngggngccnnnncngggatggnnggccggaagganncnnnggnggnggatgtnccnttgttggagccncactgctggaggngccaggnatgaatagaaantgtaggatggcggccctccgcgnggtggngggngggtcangcngcngagaaaaaaaaaaaaaaacnccncgncnccgggcaatttccttngnntgttnttnctnagccctnnnttncggggtctcccggcnctncncnctntgctgccntctgctctcctcacagaacctgcacaccctcttctggtggttggggcagatatagcctgtccctagcacctcctcagaacagggcttccggcagagggggcagcagaagaccccagaggctgaggccttctccacatgctgtgtcaggcacactcgacagaagagatgtccgcagttggtgctcacggcctccttcaggctctcctggcagatggggcagacaccctcctcctgggttgtccttctncaaagggat

SEQ ID NO: 211595 - DNA, 325 bp, Homo sapiens
acgtgtgaaggctggaggagagggctgtatcccggggaggggtggcatcggatagagggaatcccatgtgtgaaggacagaggagaggtgagttctggggaatggttcccagggaagcagcctgaagaatgaagggagggagatgactctggaactcttgccagtgtccagctaggagatgacccatgggacgccgtacaggctctgctggagcacaacacatgtccctgctgtgtccccggaataggtcatgctcctgtcactctgaaggtcattagtaacaaggcagaacaaccacacaggacccccgggatacagctgaaca

SEQ ID NO: 211596 - DNA, 454 bp, Homo sapiens
cccccaccccacaacagtccccggtgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcatttttttatggctgcatagtattccatgttaaaccatcactattaatgcacacttctaaaaatgcagtcacaaaccttctctttttatttgatacttttgtttttttgatctgatctttaaaacttttactcattccaggttataaactcaaattattcaaacttctactagatatgtctatgagttcaatcattatgcaaaagtaaaattaaccacttctgacttaaatttagtgttatgttattaaagagctttttgattccaggactc

SEQ ID NO: 211597 - DNA, 392 bp, Homo sapiens
cccagcccacagggggacagtgcaaatctagaaccaaggcgatggcaggggtgaggctggcacggtagctagagaccacgtcgtgccaagggccttggggaccatgggactatgggaccttagggaaggcgtctggaatgctgtagccagacactgttgcaaggaggatttttctgtagacatgaggccttccttatgaagaaagcaagggttctttcattcctgggggtgccaggtgctgtggactgcagcacgcgtggttgctgccgtcacagagctgtcatgcaggagggcagcgcgtccttgggaaggtggcaggcaggtcaggctaggaggaaagaggccgggaagctgagggcatttcctgcccgagatgcccaatgtagcctact

SEQ ID NO: 211598 - DNA, 285 bp, Homo sapiens
acagaccaaatatgggaggagatgatgatgattcacattacaaaaagaattcttgggcagaaacttgccacttcagcattcttctaggttgcacgattcctccgggccttttgaatatcatgtgatcaaccaagattggttttgtatagatgtttttctaggcacaggcctcgtctgtaaggcaggaacaccaccagctgactttgaacaaggggtctttcgccaacagcataattgaaaacaattcatccaggatcattcctgtcctcttgtgaagtgagctgg

SEQ ID NO: 211599 - DNA, 417 bp, Homo sapiens
taatggttgaatgggtggaggtagggggagccagtatttttctgcagctttgcatttgaagccactcagaacattcccagatgggcgtatggctcaaggtctaatggtttagctgtttgctttccctcttcttattagacacagaagttctcttaaccaccttttactcagctgccttacttggagactcataaaactcacagccttcgtaccccagcatagtgaagagcactcccctcatgctttagtctctagctcatgatcacttcttcattcccatatgagttctgtgttcacaaagggaggagtggttagctgtgtttgtccccaaatccatttatggtagctatatttactgtgtaaatataatgtaattaaatagtatgtaaatcaataaaatgagtgtgaatacaaaca

SEQ ID NO: 211600 - DNA, 289 bp, Homo sapiens
tcaggagataaattcgtgttaaaacagtattccttttcttacctagcatattggcaaagataaagaaaaatagcaaatttttaacagagattcaagaaagattggctttttttttttttttttttttttctggagatggagtctcgctctgttgccagactggagtgcagtggtgtgatctcggctaactgcaacctctgcctcccggattcaagcgattctcctgcctcagcctcccgagtggctgggactacaagtgcacgagattggcactttttaattcgctgtt

SEQ ID NO: 211601 - DNA, 762 bp, Homo sapiens
ttttatattactgcccatctcaatttagactacccacatttcaagtgctcaggagtcacagtggctactgtatggggcagtgtagctctagctttaaaggtatgagagactgattgtaagccggtagtagttggatttttggcacttcagtttcctcacctgtaaactattagatgaactataaggttccttcctttggggccaactttatagcgagaacaagggccctctatactttttttttttggctctctaaatgatatttaaaatgcaaatataatttccatatgcaaataaagatgtaccataatcttgagatggctgcctaccatagttcaccacagatttaatgcttaggtcaaatgtcctgatagcacagtgaggactctaaacattctattaaaaacttgacaattaatgtttttggcctacagatgaattttaacaattacatagataaaagtatatcaagtacaatttgggcaagtagggggtaaaactaaatttgccaataacatgactatgacatctaggttaattaccatgataactttagaaatcacatgtaaccagtattcataaaaccaccactctccaccaaaaagaaactgactatactgcctttttaaaaaacttcacaactaatagtggtaataagaaaatataaagcaactaaaaagttaatttattactcaatatcaaatcagcattcagttaagtgttacttctggccagagcgtgagcatcacgcctgtaatccca

SEQ ID NO: 211602 - DNA, 444 bp, Homo sapiens
accagaatgtactttaatagatgtcctctgtgcccagcagcccacaagcaggaaacaaatttctcctctgtctaaagcattactaagcctttatcaagggtgtgtcatgtgcccgggactatgcaacaaagaaaaatagcacctcctatccacagccctcatgtacatcacgcaaaggactaaagtgggcactaaagtgcccattgtcccaggcgatcatcagagccagacaggagaggactggggtggaaaggacctttataagttcccaaggaggtggcaagggaggtctgagtgggcagtggactgggtgctgatgacagctgctctccctcgggatggcagagaggggagatgggattaggggctcttcacttggggcaggtgacgggccacatccccagctgtcctacgccatgaatgcctccccgttgatgatacata

SEQ ID NO: 211603 - DNA, 237 bp, Homo sapiens
tcaacatttgaattttggaaaataaagaaaataatttagaataatgtttctcaaagggaaagggaaataacatttagtttggaaaagccaaacatacctatcctctttattaaaaaaattattgaagattaaagtgctgggattaacactttggctagtgcaaataattagaaaacaatgttagaaattggtaaggaacataagtgtaagaacgcttggaaatgagtgatttagaag

SEQ ID NO: 211604 - DNA, 546 bp, Homo sapiens
tctatttcccctgcaaactcaatgagaagccattaaaagtgctgtcttggggttctaggcgtatgtctcaaccatgcacgaaagcaatgatgctccaaggacatttgtctgtcagagcacagcaaggtcagaattgtctactaagtcccccaaggcctgctgtgtctggtatgttaccagacacagctcttaacatctctatctaataatagatctttgatttttgtttttgaagccacaatgcataacttttttttttaaaccctgaatgacaagagttttccttacactaaagtaaaatgtgttttacattttattgtgttggcattggtccaaattaaataatctggtaaaatcattaaaggaatttaagacttcaagttctgtctttcattgttccttctctgtgagtaaactttaccacctaaaagagcttgtttttaagagagtttatttgggttcaaaaagtgttgattattatatagccttgttgcttaactgcacatcttgtcgtatgttttactttttccccctctatcccaacat

SEQ ID NO: 211605 - DNA, 510 bp, Homo sapiens
tgtgtgcacgtgtttcccttcaacatactcaccacatcctagtctttctttacacctttcatttttccatattctaaatatcttcttgttttctcttcccctctagagtgggaatctctggagaatagccaataaatagacgaagacctaagtttcaccccctatttatactctcatggaatggatttcaattgtttagtgttctgtcttccccattagtccataagtttttctacacatgcagcagagttaataaatatctgaggacttattgtatgcaaagtgctgtgctgcaatccatggagatagcagcataaaaatttaaaaaacaaaaggccaaaaatttcttttctcacttagattgcattacagagaagatggataataaacaaggtaaagaaatgcagtccagctcgggcacggtggctcacatctgtaatcccagcactttgggaggctgaggcaggcagatcacttgaggccaggagtttgagaccagactggccaaca

SEQ ID NO: 211606 - DNA, 302 bp, Homo sapiens
tgcttttatgttttaatattgaaatctctttagtggttggaaataccctttttcatctctacagattttctcttagcctttcccacttttgtaatccacgatctctgttttaccagttacttatagttctagtgttaaacatcatattgagactacttatctgtttgtttgaaggcatggtgtttcagtcaactctcaggtctaattggtttgattctcatttctcatagcaactgagataggaaagaacctgtcagtgcaatcacttaaaggtcttttgacttcaacatcttttaccccgt

SEQ ID NO: 211607 - DNA, 416 bp, Homo sapiens
cgagggactctgacgggaaagtaccattgtgggttgggctggctcttgttgcatacccaaccctgggcaaggagtggatgcttattcatttgtttaatgaatgaagatgaaatagacccaaaaagcagatcatctattcagtggatgtttaccgagttcccaactggtcacaagtgcaatggaggaaggtgtgcttgacagggggtatacatgtaggtgcaactgtagacagggtggccaggaaatgcctcccctaaaaagtgacatttcggcagaggtcttgaggaggtgagccatctaggtacctgtgcaaagagcatctccagtccctgccccatccactgagctggaggatggggcagggactggagatgctgtgagaaccctgccctgcccgaggatcatgtacctgggcc

SEQ ID NO: 211608 - DNA, 427 bp, Homo sapiens
cagtgcttaccgtgtaaatttaacatactgaataaggtagtttaacatctctctttttatgaggagagagaacagattcttttgagatattctaggaatcccctggaaactaccgaagttagttcaaggtgagaaagacctaatggaggctgggcatggtggctcatacctgtaatcccagcattttgggaggccaaggcaggcagatgtttgctgaggcaggaagcagcctgaccaacatggtgaaaccctgtctctactaaattaaaaaattagctggacgtggtggtgcatgcctgtggtcccggttactcagaaggctgaggcaggaaaatcgctcgaacctgggagatggaggttgtagtgaaccgaaatcgcaccattgcattcaagcctgggcaacagagccagactccgtctcaaaaaa

SEQ ID NO: 211609 - DNA, 543 bp, Homo sapiens
agttgttgggaaggaacctctggttgcagcaggactgactgtacaatttgtgagcccagtgtgaaatgaaaatgcagggccccttgatcaaaaattataaaaaaatctcaagacagcgccagcagagcattaaaacaagccccaagtcccaggcgccacacagcctcgctcttctgcagttcagctcttccttttacgttcctcttctggctacctcatttatccttccgtaaaccttcactgatgagagatgtggtaacccaagcaagtctatcgttcttgcaactaaaatgaaccagcacacttaggacacgacagggttcctgctgtcatttcttcctcttaccttgtaccgtctaaaaattgcagggatgtattaaaatgctttctactccatgttattttaggtaatatttaattaggtttttatgctttaatacgatgtctgatgttctggatcgtatcctctaattttttctactataataaagttcctgacactagtttaggatggactgcatcctctcatcattaactactttg

SEQ ID NO: 211610 - DNA, 369 bp, Homo sapiens
gtttatttcaatagcgttttagatacaagtcattttggttacatggatgaattatgttcttaattctgagattttggtgcacccatcacttgagtagtgtacattgtacccaatatgtagtagttttacccagtatcactgggtatctagtattggtcgctgcatcgaatggtagacctacttttggttctttaaggactctccatactgttttccatagaggctgtactggtttacatttgaaatgcgttgttttcttgaatagccttgaaatcacaggtgctaacacataagagctagcaactgtacgtgaaccctgggctactaattgctcatcagactcctctaacccctttggtgtgtgccaga

SEQ ID NO: 211611 - DNA, 428 bp, Homo sapiens
cctacttgacatttccatctgtaatataatagttacctcaaacttgacatgtccaaagctgagctcctggcctttacttgccttcctctgccctcagacttgctaaacccacagttttcttcttctcagataatgacatctttctgttacttgagctaaaaaaaaccttagtcatcctggactcctctttctccctcactgcggtcctgttaattagcaaatcctttaggttctgcctttcaaaaataacctaaattcaatccatactagctcttcttccttttttttttttcctcagtctcgctctgtcgcccaggctgcagtgccgtggcatgatctggctcactgcaacctccgcctctcaggttcaagcgattcttgtgagtcggctacctgagtagctgggattacaggtatgcgccaccatg

SEQ ID NO: 211612 - DNA, 927 bp, Homo sapiens
ttgatgatttgagattcttactctataggttgatacagtaatacagtatgagtagatatacttaggacacaggcaggatgggaaaaaataatacctacccccttgcacccaatattcccagacccttatggttgatggctgtagtctctcagctgtgactgctctgcagggacctccatctctcacccgtcagacagcgactgaaggtggcttacagagcatgaaggacggcgtgtgagttggccagctctgtgtgcagaagctgtttcccaaaaccatttgtgtgtttaggtcttggttctggatgagagctgtcgtggaagctggcccccttctgtttgtgaaaaagaaagcagcatgggtctgatggtcaccagtttcgaagcccctctcagcacctgctttaagggagtgcaccgtgttgttgggcttgttttgggagaggggatcccctggagggagttgttcaggaccttccacagtggtagagaaacaactttggaggtcttgggatgttttagtaggctttgggcagggagtctctgaccaccattctttttttttttttttttttggagcagagtcttggtttgtcacctaggctggtgtgtgcagtggcgagctctcggctcattgcagccttctcttcccggattcagccattctcctgcctcagcctcccaagtagctgggtctacaggcatgtgccactacgcccaactaattttttgtattttcagtagagatggggttttgccatgttgcccaggctggtcttgaactcctggattcaaccgatccatctgccttggcctcccagagtgctgggattacaggcgtaagccactgtgcctggcctggttttgttttatagatgcacagttatgtaaaaatataggaaatattttattaaatgcctgcagagtt

SEQ ID NO: 211613 - DNA, 237 bp, Homo sapiens
taaaagcagcagactgtacctttgctactgagcacagagagcttcttctcctgagatctcttcctcctgcttgggtccggccccagctcctgctccagcaagtatgaccatcctccaaaagaaatgaaggctacaaaaatgctcacatcttattaaacctgctctttgatttctcttgggatggaagcactcttctaaattgcatcatgtatattgcagatagtgcccaccttcctt

SEQ ID NO: 211614 - DNA, 449 bp, Homo sapiens
ggcttgttgacaagaactgtgctgctcttggtggttggcaccctcagatgctggagggttcatgtcagtctttccaggctggccacaagcctgaccccaagaacaaagtgggagccaggactcccccatccccttcctgtgccttcttctgctgagctgagtgccactgacttttgtgccttatatgtttccttgggcatgaagagtccagcattggatgtgaggagggacccagtagggtggctcaggaacatttgtaacttcttattggacacttaccttgtaccaggcactggaaaagctgtgttacacacattatatataatcctaccataatcttgagcaggggtgtctaatctcattttacagacaaggcaattgggcatcagagagtggtccactgatgcgctcaatgccacagagctgatgaatggcactgccaagatttg

SEQ ID NO: 211615 - DNA, 268 bp, Homo sapiens
acaccctggtgcagggaagactaatgacagaatgtcacgaagcagaaatgcagaaacataggagtaattgcgcagcaagtcagagagctttcgatctgaatgcacgcaacagcaggaaagcccattactccaactgctgaaattatgtctcactggagtgaagtctacagaaatatttatagaattagcaaaatactatcattggcagttttggggattgcctaatctcctgaaaaccttttatgggctgtggggaaagagctggggg

SEQ ID NO: 211616 - DNA, 266 bp, Homo sapiens
ggttgaccacccttgttatctgatctccctggcctgccttcagcaggaatcctatcaggtctgtttagacagaaacccccttatccttggggcttcctcttagtaattttccatgcgctgctttccaccctgctccttgattataaatccccacctgtccttggtagagttggtgctgagttcaatttctccccactgcaaagccctgcagtgcccctctacctatcaccatggccccctggaataaagtctgctttaccatctga

SEQ ID NO: 211617 - DNA, 331 bp, Homo sapiens
caaaagtgttctaaagccgcatgactagtgagcggaggcctgaggcagtgactagaaggtaaggccacctttgactctgccaagggaagtaattaagacccaggtggttctccttagggtgcttcccctgcaggtgtcctacgtactcacgcttatcaaggagagcaggtgtcctacatactcacacctatcaaggaaagacccctttggtactgacagaaactgagcattgggaggatcgcttgagcctgcaaggtggaggttgcagtgagccaagattgtgccactgtactccaacctgggtgacagagtgagaccccctctaaaaaaa

SEQ ID NO: 211618 - DNA, 225 bp, Homo sapiens
caaataagaatagaaagatatgtaaaaaacaaaaagcaaacaaaaataaacaaaaaaaaccaaccttactgtttaggaagctcacaggtccaaggcctgttatcttaaacaacaatagagcagtgtctggcacacagtagctgctccgtaaatgtttggcccaaagaatagtatcactggcatctctgcatttattgagacttcatattgcagtgaccccttgct

SEQ ID NO: 211619 - DNA, 715 bp, Homo sapiens
ggtgaaggataggcatcattggtttacccagtaagggattctctgttactcaaaataattatgggatcatttaaaggaaattaagtctgacatcactgactatttgtggtatatttacataaattttgtcaaaatctagtaaggaaatgttaagatatgaaaccattaaagaaaacaggttgagccattaaggtgtaatatcagcagaacagagcttagaggtctgtttctccttccatttttgttttatcaggtaactatatcagtataattcctatgaaggtgctctagtacttaattaaaaattgtctgtgccacaggtataattttaatattaggtagaactcgagtctgggttggctatttatcagagtttgaattccagctctgctacttgcaatatgaccttgactcttggcaagtcacttagcctctctgtccaatctataaaacgagcggcgtgggccagccagttgctgaggtctgttaggccctttgggttacataaaaggagtaaagtgctgtccgtgttcacagagggcatgtacagtctagtagaaagactatcataaatgcataaataacagtagtactaggtagatgacgtaggaatcaaaagataccatcccattcatgtgcttgagaatattcagtcggtcagaaggcatgaaaggaaaaacaaatatcaaagagattgtaaggcagtgtgtactaa

SEQ ID NO: 211620 - DNA, 725 bp, Homo sapiens
gggaaccccagacctaaacctcagccatgcttctggcagcacacccagcactgtctctccaggtgctaggaaggcactaagacacacccacccagtccaggtgggctaactcaccaactgacccatcatagcaacttggcttgcccagcagcatagcccatccggatgactctacctactgctctataatcactgtgtggtgagaaaaaaaaagaaactctgccttgaaacctcctgttcccccaactagttctcaggagaatgtttgtgctttactctctctctctctcactctctctctctttctctctctctctgtgcctatatgtaaagactgatctgcagtctgccatcatagggagaaatgtgcttctagcctcacctctggaaaaagaaaattaataattaattaattaaagatcttaagatggagaggttatcctgaattacccagtggttccagtgtaattacaaaggtccttataagagggaggcaggagagtcagaatgagagaaagaaatgtgatgatagtagcagaaatcggagtgatgcaaggaaggggccacaagccaaagaatgcaagtagcctctaggagcttgcaaaggaaggaaaatggattctcccttagagcccccaaaggagtactacactattgacactttgatttgaggacttctgacctccagaaatgttaagtaataaatgtgtattttaagacattaa

SEQ ID NO: 211621 - DNA, 746 bp, Homo sapiens
taatagagaaaagctagcttgagaaacttaagaaacaggttgtattctgtcatgaaaacaattttagttctgaatttgcattgcaaaagacattgtcttgtaaatgtaaataatttcattaacagtgaaatgaaaacacaaaattaaaaaaattctaacttaaaagctacatactacagactctaatagtttaagagacactaaagtagaccaattaattagtctaattttaagaacctcagaggttgtctgttttgcagacacaaagtattttgggttcaaattttgggaactacactagagagcttaataagagtaaagttcagcagtaattcagttcaactagtcagaacaggattgtaatagttcaatggtagtgaaagttctgccattaaagcttgattgagttagttaaaagattgagaaacagaagggacagcagactctcacaggaaaaaatcccgaaagtggttgtaagtaagcccctcattgtatcacaaaagaaattctctatatctgattcttagagttttgattgagaataagtaatgaatgttagtaaatttcttctgagcattaatctccctctctcaaccacccaggaatctgcccaacctctatttttagcgcttagcttatcttaccttgtgttgcaattatgtgcgtctaggactttctcttcttgtatgcagaaggtttagttagagtactagccttgaattagtttatcatctctgtaaaaactc

SEQ ID NO: 211622 - DNA, 837 bp, Homo sapiens
gaaccactgtgtttgactcctgtaatcaaagctgggtgaagaaggagactgcaggtactgaacaggaaaactgctgtggagcctggtctccaactccgaggcttgctttatttgaggagctccccacctgtgctgggctctctagcagaggcaatacggcatcagctgatggagctgcagtctcccccagcacttctcaagtccccacccccagcccccgacctttttctaaaggacacagccttcctttgttatctttttccacagaatgtaaaatgagtgtgctgagtgaaaagtccatgacccctgtgaactggctctgcttttgccaaaggtgcaaaggtttgtcattcccttcatgagccttcaagtagtaacttcagctgaccctgggggaatgtgaggtgcccagggtctggccttagcagggctgtgggtgaaggaagtgttcttgttcttagagggttctgtatccaccaggaatgtagagtggagacagttcttctcagcttctttttctgccctagagaaacaagcatgggaagggtgcgtgcgtgcgtgcgtgtgtgtgtgtgttcagcctcactgggaacagtatcttgactttcacttggaaaaggtaatggtggatccttgtgtgtgtgtgcgtgcatgtgtgttttgaccagcctcactgggaacagtctcttgactctcatttggggaaaggtaatggggtatcctccccccacctcccaaataggacagttagctgccacacacttacatgcacattttaaaaactgtgcattgcgaatggcaaatatgtattagttcactcacctggtgggaggacca

SEQ ID NO: 211623 - DNA, 472 bp, Homo sapiens
gagcctcagtttactcgtgtgtaaagcaaggaggctggactcgacaacccttaggatccattccaggtctaatctgtttccgaacctttaatgcgcacctagagtgtaccaaacactgtactatttattggggatatggtggggaacaagaggccaaggaaggggacagtaatcgggtaggcaaattaagaagcaggatagttttaggcagggatcaatgctgtgcaataaaccaggtgctgtaataagagtggctagggggtgatggaagtggagagggatttctaccatagaaggtgatcagggaaggcttctctgagcaggtagtttttgagaaggttacaggtgggggcggagcactccagacaaaggaggagcaagtgcaaacgccctaaggtaggaacaagtctgccctgttggagaagataaagaaaggccatgtggttgggacagaggcaatgaggttggggtg

SEQ ID NO: 211624 - DNA, 292 bp, Homo sapiens
tttggatccgagttcgttgtagaaataaaatgtgtatagtggggattttattttaagtttgttgtttaggtagttgaggtctagggctgtgagaagtcctaggaaagtgacagcgagggctgtgagttttaggtagagggggattgttgtttggaaggggggtcagggttgattcgggaggatcctattggtgcgggggctttgtatgattatgggcgttgattagtagtagttactggttgaacattgtttgttggtgtgtatattgtactagagattgctcgggggaata

SEQ ID NO: 211625 - DNA, 704 bp, Homo sapiens
catcagtcttaggtagttctaccttcagatatattgtacatgagggaagagtaaacttttatgtttaagcccctgttatttcagctctctgttactaatttccccgaagtgataccaaaatggtagaatatgtattcctctttttttcttggttaatttagaagtaatactgtatttttctatttcattggttgttacattctctttcgcggcatgcatagtcaaactacatttctttggtcttttatgaaataccagttattgtacatccagccacatcactacttctcccacctcagaaagtagagacttccagaatatttacttccccaccttccatctttactctcaagttgacatcttttcatcacttccgtttcctttctctgtatcccctgtatcaacttcaaagatttagggagattagcacttcaattctagactgttattatgatttctcttgccgagtacctctattatttcaagcatctttatttagcatttacattacgaattcccagtcactatatcattatctactcagacttaattatatatacaacagatgaatcattgctcactatttgttctcttcatcttctctgattttgaagtctgtgttctgatttatttttcgattgaatagtccttttaaaagagttttccttagatgagttatgtgggtaatagaagccgtgggagtg

SEQ ID NO: 211626 - DNA, 320 bp, Homo sapiens
gtctccccctcccccatcgtattccccaaccctggtcagacacttgtgaccgggccctgggccccaaactggtctcaggagctcgggcagaaccaacacttgcgtgtagtgaagcctggctgcacagctcacaccgtgtctgcagcttcagggagtgagcccctggttacgtggccattctaactgggaggatcttgtactctttccttcccagggacttttgggaactttttggaaactctagggtgtcagccagatcctgagggagtggagaggtcttgagtgacttagcaggacataaagtcttagttacttgactc

SEQ ID NO: 211627 - DNA, 374 bp, Homo sapiens
atttgtaatttaaagtagatttttcatgagcatggctttgatgctatcattttttagtcattgtttagagaattaatgtgcatagtaggaataatattattgaatatcagcatatagctgattatttgccccagatcactgaagttgaaatattacctaatgtgattggtgtaggaaataaaacttgtttaaaacacataatatattcttttgaaaaatgaatattctcaaatactaaaaaatagtaagtattaaaaattatcaatacatgttggttttttaacaaaatatatgttatttcaaaaaatatgtaattttgaattgattccaaagcaaagggatgatcaaaagcactttaaaatttctaacataaa

SEQ ID NO: 211628 - DNA, 656 bp, Homo sapiens
tgtcccctggcatcgctgggaattcaacagacacagcccacagcatgacttccagaacacctgaatcaaattactcctcaggatgataggcacatataataggagtgtaaccgggttgggacagtggcctcacagttgccttattttaggtaaagcaatggcagggaagaaatctttacctaggaaaccgtgtgcgtgtgtgtgtgtgagtgtgtttgtgtgtgtgtgtttgtgctgggatgaacctccaagtaggtacttttggcagctgccatcatcctctcagcgacggaaggacaagaagtcgaaagtgcgctttctgacctgagaatagtcaatgaagtatagtatttagcacagcgtattttcttccctagtgagaaaggagagatccgtggaatcaaacagaccttccagcgataacctttccacgttgagcctattgattctctgtccgagtgaaattacctgccagtggagaacaagacaagtctttgcatgaaatgctcttgtggaagctagattgccaaataataaagcatcaaatggtagaaacatgcactgaagtttgaagagatactcagtgcacaaagtagactgtgaaagcctttggggaaatcatgcaatccccgagagactgattgatgacaatcccc

SEQ ID NO: 211629 - DNA, 829 bp, Homo sapiens
actatttccctgggcttttgtttcctcatctgcaaaatggagagaacaatgtctgggtacctaatgacctgaaattatggatactagggatgccatgcttaattaaatgacaagacgcctgtcttgattactgctgtgactgttactctcctccacggcaaatggagaaagcaaagcctaaagctttattgctggacagaagacaaggccagcacaaggatgagaactgccatccagaactgctctccttccaccactgagggccacttggaaggtgacctctgctggctgttgtgtgtgccaagggcagatctttccagtatgggcctggctgtgttggaggtttatcttgattcctcgtggcttagaacacaaaataaaatgttacatagcaccacgattcgtgattgcctagcaggctatcaacagatttgtttaggatgtgaaataatgaattcagaatattgtattgatgatggttattcttttatataattacaataattatccaggaaaatagcaaacagatgcagtgctgaattcaaataaagggtaggaagaagcgtcccaaatactgacgtgattcagaatattatatgagttaaccctacctcttaaactgcccatgtcagaactacaaggtatggataggcactctttataaatggacataatgtacgcactaaagcgaaatacacatgcgtgttacagtgggtctaggggggttactcagaaaaggtatgtcagttaggacccaacatgattctatggctgcagactgacaggtggcaagagatcatgttcctcaaatttctccatctctcaatgg

SEQ ID NO: 211630 - DNA, 595 bp, Homo sapiens
tgggagtacgatggcgcgatctcagttcactgcaaacctcaacctcccgggttcaagcgattctcctccctcagcctcctgagtagctgggattacaggcacacgccaccacagccggctattttttgtatctttagtagagccggagtttcaccatgttggccaggctggtctcaagctcctgacctcgtgatctgcccgccttggcccccataaagttctgggattacaggcatgagccaccgcacctggcaaatctacataattttaagtataaaatgattaattttcttccagacagattagaattttttttttttttaatgagatgaagtcttgctctatcgcccaggctgagtggcatgatcttggctcactgcaacctctggctcccaggttcaagctattctcctgcctcagcttccctagtagctgggactacaggcatgcgccaccacacccagctaatttttttttgtattttgagtagagatgggttttcaccatgttggattagaatttacagtgatttcattgtcctcaatttagttgcctcaaatttttaaatattacattttttgttaattcatatgaa

SEQ ID NO: 211631 - DNA, 337 bp, Homo sapiens
ttaggagaatttagaaaacagtcactccaatcagcttgcacaggatttaattctcccatggtatctcaaaaatataaaccaaaagccacctacaggtgaaaaacccatctttctgtggccatagctatattttctgttaaatgtaataagtatagctacttttgctctcaggacttaatgaaaataagtaacgatggtgtaagtgatactcttgacactaatgactaggttttctagcagttttactacttaggagaccttcttttcaaaagaaaaatgatactcagtgtttacagaagttatatctttttggaatggccacattttatagctgttt

SEQ ID NO: 211632 - DNA, 1257 bp, Homo sapiens
attaggaaggtgaaagttaagaggaaatgagtatctggaaacatcagaaatgccttagttaagtacagttactcctagtaaccactaacccaggcctgtcataggcctgcttcattttagatatgatagaactctattcatgaacacactgcttgtctctgggactcctggattactctgatagtacctcgaagcaaggattttgccctcaaatttcctctctgtattggcaacgtacttcattagttggggctttatgtcccattatgacttcagttaaaaggatgcaccctgtattttgttttcttctgagtattagaaccatactgtctttagctaaaatagcaaccccttgggaaaaggcaacttctttttagtctacagtagtccatccttgtttgcagaggataggttctagattccccaatgaatgcctgaaactgtggatggtactaaaccctaaatatattaaattttcctttacataaatacctatgataaaggtcagtttacaaattaggtacagtaagggattaacaacaataacaaataacaaaagagaacaattatgataactactgtaagttatgtgaatgtggtctctctcaaaatatgttactgtcctgtactcacctattttcagaccacagttgactgtggataactgaaacaatgtgggtaagaggggactactctatattctaactattctaacctatagaaagtatttctgtatattaagatgtaggaggtacataaccttcctgaaaacttatggaatgacatcctaacataatttattttgttgctctgcaccaaaggtggttctggtatgtctattatttgtctggtttggatgtaaaatgcttttctaaagcttgagaaagaaaaaccagctattactacgacgtggtaaaactgcatattcagagcactaagactagggactcagtatctgtttggtgcattttaaaaatttgctatcatttgttaaactgattttgtcctcctataacttcactccattctttacaattttactacttagccaatgccaaaaaaagaatcataatagaaccgctataatcaagatgagaaacataatacttactgattcataaaatcaatacagtggttaaatctgagggtaggaaaacattcccagtggaaataatgttctttatacaggacatcttacctcctcaaggaaatctacagtttatttttgatgacggtgtagtatattataaaataata

SEQ ID NO: 211633 - DNA, 446 bp, Homo sapiens
ttttctctctgtttcgcaggcccgatagctctgggaaagcagaacttggccttttccaaaaattttctgcccttggttttggggatcatttgggcaagcccgaggtgctgtgcatgggggctcctggaatcctgggaagggcagaaagccttggccccagactcatcgtgcagcagctctgagcagtatttcggctgaggagtgacttcagtgaatattcagctgaggagtgacttggccacgtgtcacagccctacttcttgggggcctggtggaagagggtggcgtagaaggttccaaggtcccaaactggaattgtcctgtatgcttggttcacacagtgcgttattttaccttcctctgagctgctaatcgcctgcctctgagctgggtgagataaatatcacaaggcacaaagtgattgtacaataaaaaaatcaaatccc

SEQ ID NO: 211634 - DNA, 336 bp, Homo sapiens
tggcctcagatgggcagcactcctcctgaccctgggcttcagaaattttcactgggagtctgatgaggctcagccacagttgtgtgggactgttctcaatttcaagcagaggagcagagaaagctggttagttgcggaggcttcccacattacttggaccctacaatatatatgacttctatcacaggacatggtacagaactggaacaataaagcattttttaaaatttaatttcttgagcaattttagtttcacagcaaaattgagcagaaagtatagtgttcacatatacttccctgtttattacgcacacactgccttcctcactactgaag

SEQ ID NO: 211635 - DNA, 547 bp, Homo sapiens
agaattggcatccaatccttacctttattgaagcttccaacctattggaaaaaaaaaacatgtttatagacaaacaagtgccacacaggtaagtgtatgaacagtgccaacagaatgatacaggaacgacacgaagccaaatgttacaaggagatcatatttcagtagaaagtaggaaaacaaattttcttaatttcagcatatacttttgtgaaaaaaaaaaaaaagccaggaaatacgagactgaatgtttgatttctaaaatccttggcttccctgttcttttatgctacctgtatacccaggctaaaggagaagtatttactggcagcaaatttcagcatctcccaacaacatggattcctataaatttcaaacactgtgtgatacgaaagaatggacagtattgcaggcatctttccatctccattcacatactttctacacatactatgctttctttcaggtatggaacatgtaagctagaaatcattttcagaacatttttcttagaaaatatcttaaaattatgttctaaaaatcttcc

SEQ ID NO: 211636 - DNA, 341 bp, Homo sapiens
ggtgagtttcatactaggactgcttgatgttctggaatcccttaaccaggagtcccagttgccttttgagagccgtggtcagacccttggcgagggtgtggctgaggatggccctgccagggggaagggcccgaaagccccttttcagcatgactttaagttcttgtcatttctaagagcgtacatgtttctctttttgtgaacagctcccactatatttctctaattgcaaaaacgtaagaaatgtaaagcattccttagtgttttgctttgaaatgtaacatttaatttcctccgttcattctattaaaattgtagctcttgttatttctgaccaaaga

SEQ ID NO: 211637 - DNA, 392 bp, Homo sapiens
ttaattgcactgagatattttggtcgttaccttgcaagtttctgtataaaacatagatacctgagttttaacacactgcaagtttatactaaggataatctgtgaaggtagggcaaagaaggttctaggaaagcccaactccacttgcttcttttatcacgacaggattcttgaaattacagcattggtgggttttttggtattttttttctttattagaaaatctctgttgtcacgtccccatgattactttggtttcattggtttatggtaactgctgtgagagtaaattaatgtgtatatgtttagtatttactctgtgcctagaatatatagatatcatgagaatacaaaaaattaaagacatgattattaacttcaaagagcttata

SEQ ID NO: 211638 - DNA, 312 bp, Homo sapiens
tagtgggattatcttgtgagagcttgatttttatctatgattttattgcataataataaaatttgtcaacaccataccatgcagctattactgttactggatcttttgggaaatttcaaaggaaagagaagacgtttttatctgatttgacagctttggagaattgttaatttatgtattttaaaatgtagacagctgatcctaagggaaaatattgaatcagaagataagccatcaaactttatttgataaatataacataatagaatatatttcaacttcaacttcatataaaagttgtttaaggaaaga

SEQ ID NO: 211639 - DNA, 468 bp, Homo sapiens
taatgggtctgtttcacccccaaactgtatggtcacggggatagattgacaagcccatagatgccattttacataatctctaagctgtttttcagtgacttcggttttcttacataacttccttatcatgcccggatgcctcagggaagtcgtagcaatttctctttcagtagataaagccaataaactggctttagaacaacattctgaggtttaagcccacaccaagtatgaggagttctataagccaaaagacaccagtggatgacaggggacacttattgaaatagcagacattttgctagacactccaattaacctgatatgaggtgctaatcaataaaaaatagttaaacatttgcatgactctactcatttgggaataaattccctgtttaatatctcggctttttatagaaaaataattacttaaaagagtaaaccaggtaacccaggcctgtgaactat

SEQ ID NO: 211640 - DNA, 445 bp, Homo sapiens
aaaggcaaggtccagctctgtcacccacactggacttcggtggtacaatcctagctcactgcggcctcgaacttctgggctcaagtgatcctccagattctgacagaagatacagatggaactcattggtcagagatcactcacatcatagcaagcagcatgagcttcaagtttatgttgctttctcttaccctccaagtccctgaggagtgatatgaagtggctcagatacatgttgtatacacagtaggtttatgtcacaaatgaagaagcccaagcttaaggaactgatttttaataataggtgcaagcaaaatgcttcaaaaggtataattttttgaaagaatactggagaatgaacaaatatgccttctgcttcaggagaagatactacctgtacctttcaaagtacttcactatgtaagcaataacagtttagaataga

SEQ ID NO: 211641 - DNA, 455 bp, Homo sapiens
atctatctgcttcttggctaccagaaaccaaaatcaacattaaaaagtgtcaaacctccttaaacagccagatcactggttgcaaagactgcagaggaagagatataaaactatcttagccaaaaacttggtcgtgatatattaaccctaagtgttccagagaaatgtaaagcagaaacaaaacaaaacaggacagctggatcatccaattctcatccatgatgttctgcttttttatatggctttttctccctctaatgactttatgtcataatgagtgagtatcagctcatttaaaaaattggaaccaatccaaggaaaatacacagggctgctgccctttttaccaaagatctttcattaactaatgttgatggaagcaaatttcaccacagcaatttacatggtagttgagttgctatttgtatggaacagcaaaccagagagtaataaaa

SEQ ID NO: 211642 - DNA, 549 bp, Homo sapiens
aggacgagaaagttcccatctgatgccttctgttttctgaatgatacttgaggtgaggttattagaggttgaggatggaaagccaaagagttgaaaagatcatcataattgtttctagttatggtgtgcttatgttatgccaatctctgctctaaaacctttacatctatgaattaatttatgtaatattttgaagaacagatgaggaagctgaagccaagaaagttagttccttgataaagatcccacagctagtaagtggtagagcttggacttgaacctgagcgtcttcattccagcatctatgtactttacttctgtgcctactgcctctagcctggaaccagaaatatgagatcaaccacttcaagagtgggacacacaataagagaggctgcctggccagactgagtgcccagtggagatttgtgctcgtgagtttaatgtgaaaccaataagctcactcatacagttctgggaaggttcagctgctgagtgcaagtgaggagaagatggtagtttagggtgttccaggtgagtataccaaag

SEQ ID NO: 211643 - DNA, 174 bp, Homo sapiens
tcgcgtgtgctggcattacaggcgttagccaccacgcccggcatgcatcattattttcaaaccatctggtaacttccctactgcactggctatgacctccagtataatgatgagtagaagtggtaacagattattctttgtcttactcctgaagtaagggaaaactgtagcaca

SEQ ID NO: 211644 - DNA, 104 bp, Homo sapiens
tgtatcggtgtgcgcgcgcgtgtgtgtgtgtgagagagagagagcacccgaggctcctggcgcttggcacatggtgagccctcggtaggtgggagccgtgaaca

SEQ ID NO: 211645 - DNA, 162 bp, Homo sapiens
agttgtcagtgtgaaagaacatgtccagttggtatggcagtagaagttgaatataggtcataaggtagcattatgctagggatgttatgagtagaagccatgaataagcagaggccaacaggagatatgcaaaaagtatactttttgcaggagatgactagc

SEQ ID NO: 211646 - DNA, 428 bp, Homo sapiens
aataaaataaggtgtcctgggctcactgtgtgtacctcccaccacagactggaatctgcctttgctaaggagcattacagtgggaaattaaatttagaagccacagactgacaggaggtattggaagaaattccaacttgagtctaacagatatctcagaaagagacaactgagcgaatgggaagtacagatatagagaaatgatttttttttgttttgtttgttttctaaaagcttctagatttgagggaaaacacaaacacatacttagaagcagcagacccacttcatccttcaattccagtacatcaggtgtaaggaaaaaaaggctatttaggacattacagagggctataacgcccaagctccgatgagaaactgattagtatcctaagatctctgaaacgccaagtagaaaagcaaaaaaa

SEQ ID NO: 211647 - DNA, 5035 bp, Homo sapiens
tgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatataattgcccttcctttttggctgctgctttagccagagccacatcagatgaagtccttcagagtgatctttctgcacattatatcccaaaggaaacggatggcacagaagggactgtggagattgagacagtgaaattggcccgttctgtcttcagcaaactacacgagatttgctgcagctgggtgaaagacttccccctccgcaggagaccccagctttattatgagacatcaatccatgccatcaaaaacatgcgcaggaaaatggaggacaaacatgtctgcattcctgactttaatatgctcttcaacctagaggaccaggaagaacaagcttactttgcagtgtttgatggccatgggggagtagatgctgctatttatgcctccattcacctccacgttaacttagtccgccaggagatgttcccccatgatcctgctgaggccctgtgcagggccttccgggtcactgatgagcggtttgtgcagaaagcagccagggagagcttaagatgtgggaccacaggagtggtgactttcatcagaggcaacatgctacatgtggcctgggtgggtgattcccaggttatgcttgtgagaaagggccaagctgttgaactaatgaagccacacaaaccagacagagaggatgaaaagcagagaattgaggcccttggaggttgcgtagtctggtttggtgcctggagggtgaatggaagtctgtcggtttccagagctattggagatgctgaacataagccatatatctgtggggatgcagattctgcctccactgttctggatgggaccgaagactacctcattctggcctgtgatggcttctatgacaccgtgaaccctgatgaggcagtgaaagttgtgtccgaccacctgaaagagaataatggagacagcagcatggttgcccacaaattagtggcatcagctcgtgatgctgggtcaagtgataacatcacggttattgtggtattcctgagggacatgaacaaagctgtaaatgttagtgaggaatcagattggacagagaactcttttcaaggagggcaagaagatggtggggatgataaggagaatcatggagagtgcaaacgcccttggcctcagcaccagtgctcagcaccagccgacctaggctatgatgggcgtgtggattcattcactgatagaactagcctgagcccagggtcccaaatcaacgtgctggaagacccaggctacctagatctcacacaaatagaagcaagcaaacctcacagtgcccagtttttgctaccagttgagatgtttggtcctggtgcaccaaagaaagcaaatcttattaatgagttaatgatggagaaaaaatcagttcagtcatcattgcctgaatggagtggtgctggagagtttcccactgctttcaatttgggttcaacaggggagcagatatacagaatgcagagcttgtctcctgtctgttcagggttggaaaatgaacagttcaaatccccgggaaacagagtttctagattgtctcatttacgccaccactactcaaagaagtggcacagattcaggtttaatccaaagttttattcatttctctctgctcaagagccttcccacaaaataggcactagcctgtcctcacttactggaagtgggaagagaaataggataagaagttctctgccatggaggcaaaatagttggaaagggtacagtgaaaacatgaggaagctcagaaagactcatgatattccatgcccagatcttccttggagctataaaatagaataatttttctttcaagtaggttagctagctctcccccaataaaaataccactatcagagtagaaacaaggtagacatttctaaaacatatgtgcttcattatgaatccatggatggctcaattcttaaatgtaaatagatctctaggaaactcaaagtacagtgttttcaatctaaaaagaagtattggcagtttcacttgcaaaattacacagctggtccctgtgatgtgtctcgacaccaatacacaacccccttcccaccatccttcatgtcactagatacacaacccccttcccaccatcccttcagtcactagtgaaagctttcaagttagttatttcagtcaggatatacagtgttgaaatctcaatgcagttgaaatctggtctgatgtgcctaatttatctgtggaaaatttaatgctgaattacatttggttgggaaatgtccctcaaaatcctgggcactatgaaggaaccccctgccccctcacctttttgggtaggtaaaagactaaaagccatatggattttaactgataacaatgaaagtggtaaatcagtgtaaaagtgtcatattctcagacttgtgaggcggtttatagtcagaaagatttacggatttttttcctgtaacataaaagattgtgaacttttttttaattaaaaaatatttcctagggctgtagttatttgggagtttcataacctgttatggtgcttttggtggaatttttattatttagcattttaggagaccgctgtcaactggttttaatctatgatgctaatgtgttttccactgtaccctcatctcaggaataaaactgctttaacggagatgatgtcaggtacaaatacactatagagtcaaaataccatttacaaagaaaatcaaaagcatttctatattttgtctttttttagttcagacagcaaaggcatgtactactataaaatacaaagtgattttagagaatgaaaaatgctacttttatcttctctaaaattatttcccccaaggtagtgaagtaattggaatgaaggaggctgaaagtattgtctaaagtgagcccagaggccactgagaatgcagattactgacagccaggtctgtttagttgtaattggaagacacatgagtgtcctgcttacatgtagcttcagactgcagagacaggacgtgtgcttttcatttcaatatttagttatatttgatattttgaaactgtctgctttttgctatttctgcagtttcaagttagttagaagcatgttgtcaactaaagacaacaaactatcagattcattcattcagtgaagcagcctctgattctctaagagtcacgaatgtcttagtgttaccctcccctagtcaacagcagaccagcctggccaatgcctatgggtggcccctctggagtgctcactaacaagggtgagtgctctcgctaagaagtgtcccccgcctaatcatgtgtttataggatagtacacgttccccaggcccataacagaggactaaaatctctgaattttaaagacacagatgactggcatattttggataccagtatagctatatcaaatagacaaaaacagcttcactttagcaatgatcagattgttaatctacagattttattttttaaaatttggatgtaagtagagactttcagtatttgttttctcttgattttgaagtcatttcttcttctcacgtctgtgacaaatggttgaaaaggagtcaacatggccccaactatagtgccggaaccttttcatcattctgaggctttgccccacacatggtcctcactcatatctgtcaccttctgaagcctagatcttgttaacccatcaggtgcagtgtcagtttcaaatcaaattatctaagaaaacaagaaaacaaaggcagcagactattggtacacattatagtccaaagtgcttagcgaagtaaaaaaaaaagctttttaaaatttctattgttgtctattggtaatgtttttgatcagaataaagagggtaaagggaaaaagttactacacatgctaggctttctcagtggggaaaaaaatggctggatagaactgggacaaacacagacccatctttaggggtctggattttgtaggtccgactacacagcagtgttaactcatttctcatgccattagctctctacaaaataaagcaaagtagttctagtgtggtcgttataaaccaatattgtgaaaaatagcaactattcatttgttcacaacatgcgtatttatagagtagttaggtaccatttgtaaggtaaatcctttaaaattctataatacatactaaaatagtggttattggtctgatatatgctgctcttggttctataaactagataaaagcagtgctttgtgaaatgcagtgttctctcttaacgccactggtgataggaagtagttcccttcagttcaaatcctgtgcccttatttgctgcttgctgacgtaagcaataagtaaccctctaactaatggtatctacatatttctgtaacttgtatttaatgatggtgtacctggtgattgtaaaaatattagacagatataaaagtatctatataatatctataaactgttaatgctgaggt

SEQ ID NO: 211648 - DNA, 1352 bp, Homo sapiens
tgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatagttaagtagctgggcttggctggtggtgggcccgcggtccccaccgcgccggcctcggacgcggctccctcggcccctcaaactgctctcttttctgctcctctcccccgcacccgcgcctgccgccgctgaaagcgcccccgctgctcggacccgggcggtcggctgagagctgcccacgcccgcctcggcccccacgcctcctacccggccttgaagccgctctcctgagccccggcgccctcccgccgggcccgggcccctcatcccctttcacctcggcccccagcttctagctccacttcacgcaacctttccctttcctgcctggaaaggtccttcctcccaggcttgagctccctcttcttcccagatcccttctttctccgggaggtttcctcccaccccagtctgtcttttcccgggctgagtgccttgttgtttggcggcagagacgcgactcctttctagactgagctgcgaggtgcctcctgcgtaactgcaacaatgatggttataccggccccgtatccagatgagagaatggagtagattttccgtcaggtgctcagtgttgaaagtgaagggctttttagatgttttcacacagggaagcctagtctcttagtttagacatttgacattccataattgagggaagtgggaaggaattgagagggaagggtaagcaaaattttgcaagcaagccttcgggtgaaagagccataattcattaaagtggaaaagtcaggctg

SEQ ID NO: 211649 - DNA, 639 bp, Homo sapiens
tgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatagaattgcactccagcctgggcgacagagagagaaactatctc

SEQ ID NO: 211650 - DNA, 239 bp, Homo sapiens
tggaatgaggtagagtttgagattgtagggacccccgtgggtaggatgattttggagggtttcttttaggaagatgcatttgagatgggtcatgttgaaggatattgctgtacatgtgtcatggaactgggtgccagacttgtgcaccgtgactggactcttcctccctcccctctccctttatagtagcatttgacagcaaggaagaattaattaccacacatttccctctgcctaga

SEQ ID NO: 211651 - DNA, 644 bp, Homo sapiens
  misc_feature (18)..(19): n is a, c, g, or t
  misc_feature (406)..(406): n is a, c, g, or t
ccctccgaggatcccgtnnagtagagacttgatgaattgaactcatgtttttgctgctgtggccacaccctctttacagacatttgcttcatttgggttctcagcaacttgggaaggaggaggctattgatgaaactttcaaggcgttggcttatagctactggagtgttcttttcctgtcccccccccctcctcacttcctccagtgttgggacactttgtattgaacaagaagatcatgagctaatttcaacctggcagccatttatttagcacctactgtatgttgtctttttttttttttccttttctttctcaactccatccgtgtaccttccctcctaaaagcagagtaccggctgaaacaaattataagcctgacttcccttgggagatggtctaggtnaaacaattttcccggaaatcataattcggggaggctaagatcataattcatgggtaaccttttaaaaattggtcactcccgggtcttcattaagttatctggaggtcaaggcctcttctataacatatttataagctctatcacctaggctagactgcacgggtgaaacaataagggcccctgaatctcgaactctggggtcaagaattcccgtgtaatcatcctcatgggcgggacc

SEQ ID NO: 211652 - DNA, 519 bp, Homo sapiens
ctttccatcttgttccagtgacccaatctataaatggtcagttccttcatttgcagaacttgaaatagtttaaagaagagacttgatgaattgaactcatgtttttgctgctgtggccacaccctctttacagacatttgcttcatttgggttctcagcaacttgggaaggaggaggctattgatgaaactttcaaggcgttggcttatagctactggagtgttcttttcctgtcccccccccctcctcacttcctccagtgttgggacactttgtattgaacaagaagatcatgagctaataattatgttatagaagaggcattaacttcaagataactaagtgaaagcctggtattaacaaattttaaaaagtaacaaataaataatgatctaagctacccagattagtttctggaaaatttgtttaaccaagacaatctccaagggaagtcaggctaataattgtgtctcagccattactctgcttttaggagggaaggtacaaaaaggagtgaga

SEQ ID NO: 211653 - DNA, 930 bp, Homo sapiens
aaaaaccatcctgggagtcatccatgacttctaatctctcacggccccctccccagaccagtgtaacaaaagctgccaactccatttcctaagtatctcttgatctgcctactcctctccaccatcaccagcaaggctgagccactggtgctaacactgccacatccactctcaccccattccaaaccactcttccctctattgccaagatgatctaaaaactaaaatcaaattcctttattccttgcttaaaatcccacaaaggcgttttcttgcccccaggctaaagccccagactctggccatggcttacacccggccctgtgtggtcaggcccacatccctctcttcggccccatcttgcctcacttaggactggttgctgtgctctcccacactggcctttctttaatagttcttttccctgtgtcaagttcttcctaccataggtagaaagaacacacatagtgccttcgcttcaaacattctccccctccccttcccagttgttgtggagtgaattaccactcattacccctcagaccaggtgtcctccctccgagagcacccgtcttcccaggctcattgctcacgccagtactaactccaggccagcacaggaaattgctcggcttcctctctgtgagcatgccaatgccctgacacatacctatgttctgaatgcataacctgagacatgttcactgagacctcagtctcctcatgtggaaaataggggtaataccatccaccctaaacaacatttgtgaggactacatgaggcaaggtaagcaaagcatttcagccctgtgccacgccgtgggggcacacggtactgggaagatcctatcatttatcacctctgcactgttggcatcaaacacatggctaggcacaaaacaggcaattacccttcaaggctgtgtctaa

SEQ ID NO: 211654 - DNA, 343 bp, Homo sapiens
tttgtcacagttcttgatatatatatatatatatgtgtgtgtgagaataagagatctctatatatagagtttatatatatatacacatatatacacacacatatataatttatttgtttaactgacagaaaagaaaaatatatatatttgttgtataatatatatgtataatttccttttctctttaatggaaatgcatagtgtttcattgtatggctatttaataaagtattatctggttccttattgatagacatttaggttgtttcctgcttttccatgttataaactgctgttatgaatgtctttttatgttttccaatttgtggtaatacatctgtag

SEQ ID NO: 211655 - DNA, 293 bp, Homo sapiens
taggcaagggggagagagcaggaggccactgataccgatcctcacagccaggaagaggaggagctccgtgaggcagctggcgtgaggtacctgctcagggctctctttggacattgaattataaaggggaaagtagaggcaaggtgtctcctgccacaaccttctgggatccaaacaagcctcaaatctgcagaagcccgagggactggggagaggactggacagtggagtcagggtgcccctgccagactttctaggacaagacaggaacattccaggaaacaccacagcag

SEQ ID NO: 211656 - DNA, 812 bp, Homo sapiens
acctcaaaaaaaagttctgaagacaatgttaaaatctgacaactgggaaatggatgctgttcattattttattccacatatttgttgtggtgcttaaaatattttgtcattgaaaacaatgtaataaacaaatgactagaaaaagtcaaaaaaaaaaaaaaaaaaaaaagcaatctttaaaatgtcctggtgttggccgggcacagtggctcactgtttaggtggtcaaagtgggaggatcacttgaggccaggagtttgagaacaacctggacaacctatcaagactctctgcctctaattttaaagctaacattggtgtgcttatgtgttagatactgtgctaaccactactacacaatttcacttacttggtaacaatgaccctttgcagcaggtaccattattttctgctagactgtgtcactgtctctgatctttactcttgagggtccaattgtactcatcattctatattttctaagggcagaaaaatggactcatctatttagagacagggtctcactctgtcacctaggctggagtgcattggtgcaatcatagctcactgcaggatcaacctgctgggctcaagcaaactttttaaaatatgcagctacaaaagcaaatttaaaccctaatttaaaagctgattttgccgggcatggtggctcacgcctgtaatcccagcactttgggaggccgaggcttgaggatcgtttaagcccaggagttcaagtcagtcttggccaatatagcaagatccccattttttaaaccaaatacctcagattcatataattagaatgtttt

SEQ ID NO: 211657 - DNA, 871 bp, Homo sapiens
acctcaaaaaaaagttctgaagacaatgttaaaatctgacaactgggaaatggatgctgttcattattttattccacatatttgttgtggtgcttaaaatattttgtcattgaaaacaatgtaataaacaaatgactagaaaaagtcaaaaaaaaaaaaaaaaaaaaaagcaatctttaaaatgtcctggtgttggccgggcacagtggctcactgtttaggtggtcaaagtgggaggatcacttgaggccaggagtttgagaacaacctggacaacctatcaagactctctgcctctaaaaaaaaaaagtcctggtgtttatagttccaaatcaatatatattacacgtgatttttttttttaaagctaacattggtgtgcttatgtgttagatactgtgctaaccactactacacaatttcacttacttggtaacaatgaccctttgcagcaggtaccattattttctgctagactgtgtcactgtctctgatctttactcttgagggtccaattgtactcatcattctatattttctaagggcagaaaaatggactcatctatttagagacagggtctcactctgtcacctaggctggagtgcattggtgcaatcatagctcactgcaggatcaacctgctgggctcaagcaaactttttaaaatatgcagctacaaaagcaaatttaaaccctaatttaaaagctgattttgccgggcatggtggctcacgcctgtaatcccagcactttgggaggccgaggcttgaggatcgtttaagcccaggagttcaagtcagtcttggccaatatagcaagatccccattttttaaaccaaatacctcagattcatataattagaatgtttt

SEQ ID NO: 211658 - DNA, 682 bp, Homo sapiens
gttggatgaatttctttataaagattgcagaggatagtgatgaaaacttgaattagtatctttagagttatgtttgaaatattttatgaacgttgattttattaagtggcagcctttcgtggttttatgaactgatgtgcctttaagtgtttttttcatcaacagaggaattctaataatatctgttatgctgcagaaaacttagcaaatggacctacattctgacattcagtcaacaagtgaatgattaagcatagctgttacaagttaacagactacatctcttacctctgactattgtactgaaagtacatgtcatttttcatgagaatgtattgccgttgccaataatagaaaacaataaaaaccatattcatatttctaaaaatagcatataatatcccttttagaaatcattttaaaattcttggagtcacaacatattactaaatatttcttctagatgtttatagcagtgttatatataacagggtgaaatttgaagaaaaatatgttcaccatgcccagaatgtctctggagggccacataatagtggttgcctctagggagctggaactgggtgagtcagggacaagaatggaaggaagggccgggcacagtgctcacgcctgtaatcgcagcactttgggaggctaaggtgagtgaatcacctgaggtcag

SEQ ID NO: 211659 - DNA, 281 bp, Homo sapiens
ttcagaaaatcaataggctacgaggcagttttcaacaggtcttaaatctttgccaaactgataaactaaacaagtgtttcaaatgaaacattttaaatcacaagtggatttgatcctctcatggtgtatttactacccatttgttttttcatttacctgttcatgtcctttgcatttatatggtggtgatggtcatactagagtgttttctgtagtcagattattagccttttgtcatacatacctcatgtgttgttatcctcgttgcttttgtgaatgct

SEQ ID NO: 211660 - DNA, 434 bp, Homo sapiens
ttttttttttttgggacaaagtctcactctgttgcccaagctggagtgcagtggtgtcattgcaacctccacctctcgggttcaactgattctcctgcctcagcctcccgactagctgggactacaggcatgctccaccattcccggctgatttttttatttttagtagagatgggatttcactatgttggccaggctggtcttgaacacctggcctcaagtgatccacccgcctcggcctcccaaagtaaagtgctgggattgcagatgtgagctaccacatccggcctatatccagctaatttttaaaaataatatttttgtagagaggtggtctttctcccctcggccttccaacgtactaggattacaggcgtgagccacccttctgtcgtcttttcctttttattttttcacacttccagtggtccttg

SEQ ID NO: 211661 - DNA, 946 bp, Homo sapiens
agggctaagttacaacattcttgaatacccctccaataaattgggaattacacccatgatccaaagcatctgaaaaatcaccccagactcctccactcagggctgcccccacactcctgcctcatccaggtccagcagtttcctcttgtctttgcttccttcccaagttgcatgattataaacacatttactgggccgggcgcagtggctcctgcctgtaatcccagcactttgggaggccgaggcgggtggatcacaaggtcaggagatcgagaccatcctggctaacacgataaaaccccatctctaccaaaaatacaaaaaactagccagatgtggtggcgggcgcctgtagtcccagttattcgggaggctgaggcagaagaatcacttcaacctgggaggtggaggttgcagtgagctgacattgcgccactgcactccagcctgggcaacagagggacactctgtctctaaaataaaataaaataaaataaatacatttacttctaataacccataagcaccttgtacctaggaatcctactaattatcctctcagcgcattttcatactactctcattattcacttattcaatgaatacagccgaaggatctgaatagacatctcttcaaagaatataaacaaatggacaataaacatatgaacggtacctgacatcatcagctatcaggatggtggtcacttcagatccactagcatggctagaattaaccaaaaagggggaaaataacaagtgttagggaagatgtagggcactgtaaccctcatacacactggtgggatgtaaaatggtacagccactttagaaaaaggtaaagcagcttctcaaaagtttaagcacaaagtttactatatttcccagcagttctactccgttcccagagaagtaaaaacacagaaacgtgtatgagcgttcatag

SEQ ID NO: 211662 - DNA, 182 bp, Homo sapiens
tcacagtgcacttagagggggtcctcccaccccatcctcccctcagacagagactgggtgttgtgtgggtttctactgggtcctctgagagggcagcgcttggggtgaagaagtagcccccagactctgtccaccccctcccgcctctggaatgtatcagggggaagacaggcctccagttc

SEQ ID NO: 211663 - DNA, 482 bp, Homo sapiens
atctgcccgcctcagcctcccaaagtggcactaccaactcttaactcacagagacctctgtggcagatacagctgggagacaccagtgaatggaacgtgccgaactgcttccaaatctattgaatctactaaatctactttatctgctctgatccacttttgatcttcaaaagcaaggcaaacacagtctacttctcctaaacctacagtcatggacatattcattagcccccgacaatgagatacccattccaaaaatatacactaaaaatgctttcaatatagcaaccctgtggccagggaacaacagtcctaatgtccaccaccacgcccaggtaattttgtcattttttttgtagagacggggtttcacaacattgcccagactagtctcaaactcctgggctcaagcaatctgtccacctcagcctcccaaagtgttgggattataggtataagccattatgcccaacctctccctg

SEQ ID NO: 211664 - DNA, 357 bp, Homo sapiens
tgagccaccatgcccggcctcttgggtcaatttaattatggcttcaagaagtttattttttagtgatgtcgggggcagagtttttaatttgcatgttttttctttttcggttttattgatatttaatagagagcactattttgatattggatacttttttagttttagaatgtacgtatgcttttttcagtaatgaagatgtgataataggtttctggtgaagaggtatgttgtcagaatgattctgtttcttaatagagatgtcactgtccaaattgattataattgagaagagtctgcttcctttaaaactagtcattttagtgaatacagagctgtcaagctcacagttgtggc

SEQ ID NO: 211665 - DNA, 501 bp, Homo sapiens
gggaagtagcgcccgagctgcaggcaaggcttgggcttttgcgggaggtggggcatggcagagccatggagatttgcagctagggatttgcaaactggcttttaatgcttgaattctgatacacaccccttctccctgccaagacagagtgagaaacacataagaacctaccaaatcctcctcactcccaaggcagagctccccagtaaaactgaacagttgaatgtagctttgatccaggagacctcattgattcctgctcctcggatctaggatggtctgtccagagtagatgggactggacataatcacccaggcttggaggcagaggactggaaagagagcccatgtgtggatatccttcacatttcgttcagtgactacccatcctcttgtcaaatttcacccgatgaatttctcagactcagacagatcaattagatgatcagcccctcctctcttgggaatcatctcacgaaggtttcaataattccctgacct

SEQ ID NO: 211666 - DNA, 905 bp, Homo sapiens
gaaagaaatttcaggaaatcatcaatcgcagtagcagtgaagcaaatcaggtggttcgtcccaaaacttcaagtaaatggtctgctcctggttcagctccacagttaactacagccattttggaaattaaagaaagcatattgtctttgctaattaaacttcaccacaaactctcaggaaaacaaaactcctactatcctccttggcttgatgacatagaaattttaatccaaccagaaattcctaaatacagtcatggagatggtataactgccgtggaaagaattttactaaaagctgcatcgcaaagtagaatgaacaaacgcatcattgaagagatatgtagaaaagtgacccctcctgtaccacctaaaaaagtcactgcagcagagaagaaaacattggacaaagaagaaaggcgacagaaggctagagagaggcagcagaaattgcttgcggagtttgcttcacgacagaaaagctttatggaaactgcaatggatgttgattctcctgagaatgatattcctatggagatcaccacggcagaaccacaggtttccgaggcagtatatgactgtgttatttgtggacagagtggcccctcctctgaagatcgacctactggattagttgtactgttacaagcatctcaagttaggggcgtggcgtgacaatgtgacccaaaaagtggccaccaggaaaagaccaattacctgggatacgtgcgcgtcagaagaggttacaatacgggtattaggaagcagcccgcgaaatggcggagggggttgtaccggccctcttaaagcaacccagccacagcgactccggtccgaaggcccgcagcagtccccacagacagctcacaacaagccgccaccacatccataactcactgcccttgg

SEQ ID NO: 211667 - DNA, 2671 bp, Homo sapiens
  misc_feature (617)..(617): n is a, c, g, or t
ccatctgccccctttctctgacacgtttattttttgaactaggacttaaattttaaaaatcattttctaataataaaagttaatacacattcactgcagaaaatataaggaaatacaggagagatcaaaagagatcaccggaattcccattttctcaagaaaaccaatgttaatattttggtgttttttcttcccatctttttctttctgttttgtaacatacttgggatcataacgtatattcagtttgtgtcctgctttctttcatttagcacagaagtactttcttaataaaaagatctagctagtatccatcagatgtatttatcataatttatcccctcctcgtagatatctagactttgaccagtgttgattttgttcatctgcacagactcccaaaaaagctcctagctgaaaacctggctcaaaacagaaaccacctgtaaggacttgctcgtgaaaaatctacgcagcagttccctccaggaaaaccaggcggacgagcagcctgtgcctggaagtaggcggggcccctcctgggtctgcgtctgcagacacagaccagggagcgatttctcagcgcctgtggtagctgctgcggtgggaagcacacngcagaccctgagcaggctggccagtgagccagcctctttctgacgggacccacagctcgaatgttggctggatttgcctgggccaaaataagcggaagagtggcagagtgcttggggatcacttccaatcacaccattcagaaggagaagcagtgcacctctaggacagatgccttcaaacgaagaggctggctgctccccgagaaggagggccaggcggggtggtaccaagcagtgccgctagagaaacatcattcagcagcctcctggaacacatgggagcccggtggctgaaatgtcctttcctcccagagttagaatacataatgttagttaactccacaaattagtgcagtggccatgacagtcgaggcccccagtccccagtcccctaggcttatacaacagacgccggttgtcccatcctttgctcaatcctatttaagacgaggattgtgcactcctggctggagtccaggagggtgggagccactgggtggtagtggagcggccctgtctccaggccagactctcctgctcctggccctcttgacgctcacagagtggcctctgtggctgccgagccctgtgctgcagcataaatcctcagcttttgtctgtgtttaatcccaccctgagaagtgatatccaagtgcaactgtttccagccaggagcgcagctcccaggccctgctgctgcctacccaagacaaacagatgtaacaaggaatttctagcacagtgctggtcctctgtgttaataaatggccgaccaggagtactgggtaatgcaagctgggaactccccatcacacacagacactggagccggctctgacacatggggcagagactcggcctttggttccctgaggactgaatttacacaccctcttagttgccacccaactgtttctagctaaagctatttttgaagtatcctgaaggaaagcacacaagactctagcctctccctgcctgtcctgggtttccaaggtcaggatatggtggaaagacctgttcaagggacatggcatggagggagctgtcacagttacagagaagggagccccctttttggtcaaaggcaagtattgtgaaaggttacttttctagaaaggcacaaacatcaacccaagcccctaataaagcggggcccagtaaactgtgcagataactgaagcactaaagagagaaaaagacatctagtcatttgtaatacagctttggtgcatgatatataacattttgtacattaaaaggtttttggcgatttctctttaaagcagaccacaaagtagacaagagattggttattatggaacacttgtgtgttaaacgcgatttccatctctgcggcacccaattccagaaacgttaactggacaatcctcaggggatggtggatcatctgcatctgtttccagacgtgcatgaaggatctccttcgtacacctacacaacccatgcgatttcccttgaaccatgactaaccagctgtctggacgacatccagggcgagtcacaagaggcttgggaatcctgggaggctgttttcagattatggaaatgcaaatcaaatcctccctgatacgacttcacacccactaggacggctatagaatcaaaaagatggacaataacaagtgctggtgaggacatggagcaactggaacccttgcacactaacaggtatacatccagcctgtgtgcaaaaacttgtacatgaatgtttaaggctgcattattcctaatagccaaaatgtggaaacaactcaaatgtccatcaactgatgaatggacagacaaaatggaatgtgtccgtacaatggtgaaggggcttggcagacgagcagccccatttagccctaaaaaggcgtgaaggactgatgcgtgccgcaacacagatgtacttttcataaaatgtccagataaaataaaaataaataaataatacaaagtcaataaatacataaaatatccagataaaatgcttgacactatataattaataataagaaataaactaaaaaaaagtacaccataacttcagt

SEQ ID NO: 211668 - DNA, 2778 bp, Homo sapiens
  misc_feature (617)..(617): n is a, c, g, or t
ccatctgccccctttctctgacacgtttattttttgaactaggacttaaattttaaaaatcattttctaataataaaagttaatacacattcactgcagaaaatataaggaaatacaggagagatcaaaagagatcaccggaattcccattttctcaagaaaaccaatgttaatattttggtgttttttcttcccatctttttctttctgttttgtaacatacttgggatcataacgtatattcagtttgtgtcctgctttctttcatttagcacagaagtactttcttaataaaaagatctagctagtatccatcagatgtatttatcataatttatcccctcctcgtagatatctagactttgaccagtgttgattttgttcatctgcacagactcccaaaaaagctcctagctgaaaacctggctcaaaacagaaaccacctgtaaggacttgctcgtgaaaaatctacgcagcagttccctccaggaaaaccaggcggacgagcagcctgtgcctggaagtaggcggggcccctcctgggtctgcgtctgcagacacagaccagggagcgatttctcagcgcctgtggtagctgctgcggtgggaagcacacngcagaccctgagcaggctggccagtgagccagcctctttctgacgggacccacagctcgaatgttggctggatttgcctgggccaaaataagcggaagagtggcagagtgcttggggatcacttccaatcacaccattcagaaggagaagcagtgcacctctaggacagatgccttcaaacgaagaggctggctgctccccgagaaggagggccaggcggggtggtaccaagcagtgccgctagagaaacatcattcagcagcctcctggaacacatgggagcccggtggctgaaatgtcctttcctcccagagttagaatacataatgttagttaactccacaaattagtgcagtggccatgacagtcgaggcccccagtccccagtcccctaggcttatacaacagacgccggttgtcccatcctttgctcaatcctatttaagacgaggattgtgcactcctggctggagtccaggagggtgggagccactgggtggtagtggagcggccctgtctccaggccagactctcctgctcctggccctcttgacgctcacagagtggcctctgtggctgccgagccctgtgctgcagcataaatcctcagcttttgtctgtgtttaatcccaccctgagaagtgatatccaagtgcaactgtttccagccaggagcgcagctcccaggccctgctgctgcctacccaagacaaacagatgtaacaaggaatttctagcacagtgctggtcctctgtgttaataaatggccgaccaggagtactgggtaatgcaagctgggaactccccatcacacacagacactggagccggctctgacacatggggcagagactcggcctttggttccctgaggactgaatttacacaccctcttagttgccacccaactgtttctagctaaagctatttttgaagtatcctgaaggaaagcacacaagactctagcctctccctgcctgtcctgggtttccaaggtcaggatatggtggaaagacctgttcaagggacatggcatggagggagctgtcacagttacagagaagggagccccctttttggtcaaaggcaagtattgtgaaaggttacttttctagaaaggcacaaacatcaacccaagcccctaataaagcggggcccagtaaactgtgcagataactgaagcactaaagagagaaaaagacatctagtcatttgtaatacagctttggtgcatgatatataacattttgtacattaaaaggtttttggcgatttctctttaaagcagaccacaaagtagacaagagattggttattatggaacacttgtgtgttaaacgcgatttccatctctgcggcacccaattccagaaacgttaactggacaatcctcaggggatggtggatcatctgcatctgtttccagacgtgcatgaaggatctccttcgtacacctacacaacccatgcgatttcccttgaaccatgactaaccagctgtctggacgacatccagggcgagtcacaagaggcttgggaatcctgggaggctgttttcagattatggaaatgcaaatcaaatcctccctgatacgacttcacacccactaggacggctatagaatcaaaaagatggacaataacaagtgctggtgaggacatggagcaactggaacccttgcacactaacaggtgagactgtaagatggtgcggccattttagaatacagtctggcacttcctcattatatgaatgaaacacagcattaccatatgacccagaaattccattcctataggtatacatccagcctgtgtgcaaaaacttgtacatgaatgtttaaggctgcattattcctaatagccaaaatgtggaaacaactcaaatgtccatcaactgatgaatggacagacaaaatggaatgtgtccgtacaatggtgaaggggcttggcagacgagcagccccatttagccctaaaaaggcgtgaaggactgatgcgtgccgcaacacagatgtacttttcataaaatgtccagataaaataaaaataaataaataatacaaagtcaataaatacataaaatatccagataaaatgcttgacactatataattaataataagaaataaactaaaaaaaagtacaccataacttcagt

SEQ ID NO: 211669 - DNA, 508 bp, Homo sapiens
ctacacgtccatccgagaggaatgtaaccagctatcaccatgaagaaaactggggtttttcctaaccaagaagtcaggagtttcaagaagaagtatttagtcttgtactaaagagttagactacattttgtgatgtctgaatactaacagcttttacacctctgcattccttcttcctatgaaaggaggtagttaacttgccttaggtagatagcaagaaaagggtctctggagagtccctggcccatgggtcagtgcctcatccccacctaacagaaaaagcagcctgggaaaaaattcaaggtgcagggaccgataagggaactagcacaaggtgttatgcctacggctgcacagatggaaaaggcccatttggataaaaacttgcacagacctccatctcactcagataagggagcaggcctggcacagaaatgccttttgcctttgtagagtcagtgggctcccaggcaaaagtttcttctccctttgtggacatgggcacagt

SEQ ID NO: 211670 - DNA, 265 bp, Homo sapiens
ggactttctcacacatagtaggtgcttaacagatggtagtgctctctccttgcctctttggacacccacaatggagtgattcagagcccaagttttgggcagattgtacatgcatgggctaaatgggctctgagagtcagcatccagcttcacaaaacaggaataatgatagctgcctcccggggatgttatggagatgcaatctgctatgtctatagctatgtctataaagctatgtctataaagcacacagcgttccacacgt

SEQ ID NO: 211671 - DNA, 256 bp, Homo sapiens
aatattaggagaatgtcttcagcagaaaggtaagaaaggacttcttaaataaaattccagaagtacaaaccagaaggcaaaaaaattgataaatttgtttacatcataattaagaattttatttcatggaaggatattatagacaaaattcatagagaaatgtcagagtggaagaagattatttgcaatgtttaaatctgacaaagggttagtaagtagaatattcaaagaaagcctgaaaagtagctctaataga

SEQ ID NO: 211672 - DNA, 539 bp, Homo sapiens
agttattttgcctttatctcagttttatttgcaaaaatagtatacgcaaaatacatcgagtgaatgcacatcaggcatatagaagatctggcagaaacatgttttctcctgctcatttccagtcagtatttgaacacagaggcttccacggttttgattctttccacaaaaggttagttttgtctgttttcaccatttatgtaagtgaaactataaattatataatttttatgttcactcactaaacatgcttgtgacacatcattttgctcctattgattattcattattttgtaatattcaattttatgactataccacaggtttgaggcctttgcttgttttgtttttaatccattccactattgatagacacaaaagcagtttctgatttgaggctatcatgaataaacctgctacgaacaaatcagatatacatatttttttctgtaataatattttcacttttcttgagtttaagtacataagagtggattttctgggttataaaataagtatatatttggcattgtatgaaa

SEQ ID NO: 211673 - DNA, 420 bp, Homo sapiens
taactctatactggaagtgatttactctaagaatgtggtcaagtttctagcattaggaccctacctcgatataacaagaagtggggattcagagaaaggtgtattctcttacgatttctttgcttgaaaatctgaggaaacagtatgttaggtacaactaaatagctttgcttaaacacgatttgcagttaggagcaatgtcacctagaggaggaaggcctctagcataccagtcagagattttaggatataatcctatagtatctggtatttgctattagtcactttcttatcatatctgcctatgttgaatgcctgaataaaggagaaagagctaacattttggattaattatttaggattccaaaataccctgataggcttgaacaaataatctgaataacatgaaaacaccattaa

SEQ ID NO: 211674 - DNA, 514 bp, Homo sapiens
ttctaagagcatactacaatatatcagatattattgaaaagaaatgtggcagctattttgcttcaagttaattaggaaaataaaatatgctttcttttagaagtcatggaaattgttggaactttttgataacttaattaggcacttttatatttaaataaatataaataaggaattggaaaataatcatttttctctcactgtctttcagaaccatgcaatactgtttttctgcatttccttttcagtaaaaccgattatttgggctatccaggggagtttttaaaaaatctcaaaatggaatactttgcaacatacacttgatatatatttatgatgatagttaatatgctaaagcttcccaaatacacatgtgatataaatttatttagaaatatttagtataaaacagaaaattttaaaggaaaactcattagaaaaatgtttaaagatttatatacacaaagttcattacattgtctttttattttaggatagtcataattgaaaagtc

SEQ ID NO: 211675 - DNA, 351 bp, Homo sapiens
aatgtgaaaagcacaagatttgggagggaccaggggtgcaattatatgattgggctctgtgtccccacccaaatatcatcctgaattgtaatccccacatgtcgagggagggacgtggtgagaggtgatggaatcatgggggcagttttccccatgctgttctcatcatattgaaggagttctcatgagatctgatggttttaaaagtgtttggcagttccccccttctctctcttctctcaccatgtaaaaggtgcctttcttccccttttccttccaccatgattgtaggtttcttgaggcctcctcagccatgtggaactgtgagtcaattaaacctcttttctttat

SEQ ID NO: 211676 - DNA, 500 bp, Homo sapiens
ttttctccactgaacaagcatttattatgtttttactctgggccaggccctctgctagttactgggatccaaagataaatcagaaatactctctgccctaggggactccaagtctgatgaagaatatggcagttatctgtggtgctggagtctctgttcagttgtgtagaaggacaggagaagttgtgaaggaaggtaacatttctttagtgcgtgggccatgccagaccctttatacatgtctaacttagccgagatcacagctctgcgaggtaggcagtatcatcctcatttcacagaagagggacctaaggctcatgaggtttagctacttgcctgtggccatacagccagaaagtggcagaactagaacacaaagcgagctccatctgcagagcacatgctgttacacaccaaacaacggattccctcatgggcagggtgtcacctttttggagttggctttagattttattttgtcagactctttgggaaattag

SEQ ID NO: 211677 - DNA, 417 bp, Homo sapiens
atcaaaactgtgaagttcatggagaaaaaaggagcttctagtttcacatactggcctagacctgcctaagggtgcagccaactccctaaaaagaggatgatactagaataggacagagcaaacagtatctctcaagaatgttggaggggtcgggctcagtggctcacacttgtaatcgcaacactttgggaggctaaggcaggaggatcgcttgaccccaggagttcgagaccagtctgggcaacatagtgaggtctcatctctacccaaaattttcaagttagctgcacctgtggtcctagctacttgggaggctgaggcaagagaatcacttgagcccaggaggtcaaggcttgcagtgagccacgattacaccactgcactccagcctgggcgacagagtgagaccttgtctcc

SEQ ID NO: 211678 - DNA, 460 bp, Homo sapiens
gacaaggctaatcaagagaaaaaaaaatcacgtggtattatgaataaaaaaaggtactgttatgtaaagtattttaggaaaatacaaattcattacagcattaaaaataaactaaataattaaaaaggttttagttgccttcattgaaaagaccaacaactacagaagaaactggaaatatatttttattttttttttgttttttgtgttattgttgttgagacagagtctccctctgtcgccaaggctggagtgcactgatgtgacctcagctcgctacaatctctacctcccaggttcaagcggttctcctgcctgtaatcccagctacttggggggccgaggcaggagaattgcttgaaaccgggaggcggaagttgcagtgagccaagatcgcaccatcacgccatcacactccagcctgggggataagatcgagagttcatctcaaaaaaaaaaa

SEQ ID NO: 211679 - DNA, 488 bp, Homo sapiens
gacaaggctaatcaagagaaaaaaaaatcacgtggtattatgaataaaaaaaggtactgttatgtaaagtattttaggaaaatacaaattcattacagcattaaaaataaactaaataattaaaaaggttttagttgccttcattgaaaagaccaacaactacagaagaaactggaaatatatttttattttttttttgttttttgtgttattgttgttgagacagagtctcccttccagcctgggcgacaagaacgaaactcagtctcaaaaaaaaaaaaaaatcaaatgaataatactccttgaccttgtgaagattctatgaagttcagattacagtgtccagaaattgttttgtttgtttgtttttttgagacagcttctcaccctgtcatccaagctggattgcagtgagccaagatcgcaccatcacgccatcacactccagcctgggggataagatcgagagttcatctcaaaaaaaaaaa

SEQ ID NO: 211680 - DNA, 300 bp, Homo sapiens
ggcctgttagtcaaaaagaagacaagacagaagcaagggggtgcggggggaggagagcaagaggggaccgagaactcggaaccaagtgatgggcagacactgaatgcctgactccagggttatcgcctcagaaaacaagtccgtttaagcccgtggtaacagtgttagcgctttcactgaacctgcactcaacactggagaacctccctgcattatgaagatgagccgaaaaataacattaattcacaatgtagagtgatgattcagccacagaaaataaaactgatataatccactaca

SEQ ID NO: 211681 - DNA, 527 bp, Homo sapiens
gcttctccaacataccatggcttggaggccaatgtgaaaagtatataagatgtaacaccctcagaagggttaagttttcacctgagttttcatcttcaaccaagtcattgggatggtgatctagaaggacctctaagatctagaaggataaagatctggtccaaggagtacaaatatgtaatggatctaccaccagtgtcccctgctgtactcttggcagacatcactaatccatcacagcatgccttcccactgatcacagatgtagcttcagggcattcgagttaccacttaagatggatatgagtgaccctcccttatctcactcttctcctttcacagaagcaggatctgaggcccagagagggaagctataataaactcccctaagtcaggtcccttctaagaggcagaggtaggtttagaactcaggcctcagaaacttccagaagccaagccatttgggctgtagttggtggacagtctatcagcgctctgcagatgtttcttctcagttagggaacttg

SEQ ID NO: 211682 - DNA, 417 bp, Homo sapiens
ggtcattgcaatagggagaaagattgggctcaactccaaatacagcaaagacgtctggagatcagtagccaatgagccggggaggcgtctgtggaggggaaattactaagaagagatattaaagtcagggggattcttgctaaatcaacttaacaggattcctgctgaaggcaggttgacttagacaacaaggatagggacaaggaacttgatcaggtgtgatcagatatccagaataaaggatatctctctaaactcatctagcagctctctaactttagcaggattcttgctaaaactaactgggaaggcctggaaggtgggggtgggctaacggcctagctgagaagggggctcagagaagccggattcaagtttggtcaaggagcaagtcttcatcagtaatagtaactccag

SEQ ID NO: 211683 - DNA, 454 bp, Homo sapiens
agcaactaaaaatgggtaatgaactagaaatatgatgtgtttttagtgaaaaaagcaggttacaaaacattcttttctaaattatgtatgtacagcctgatgtcattattgtttttgtttttttgagactgggtcttgctctgtcatccaggctggagtacagtggcatgatcatggctcactgcagcctcgacctcccaggttcaagcgatcctcccaccctcactctcctgagtagctgagcctacaggcatgtaccaccaggcccagctaattttaagttttttttttttttttagagttgaggtcttgctatgttgctcatgctggtctcaaattcctggcatcaaatgatcctcccacctcagcctcccgaagtgctgggattacaggcgtgagccatggcacctgtcctcattttttatttttaataaaacatgtaaagattggatgg

SEQ ID NO: 211684 - DNA, 623 bp, Homo sapiens
tttaatccaacaccatggccctcaatttaaaaactacatccaagagaaagaaggagggagagggaagaggggtggtaggcaacaacataaaaaacattctaggccacggaagagaaagtctcacaaaccggatgaaactactaatacaatattaaaaattaaagccgagcactgaagcacgaaaatcacacgataacccattacagttaaggattaaaaataaaatgacatatgcaccaagggggagcggaaactaaatgtcgaaagtacagcggtttataaaaaactaaaggcaaaacaagacattctcgcgacggggggaaaaaaaggccgaaatcaacaatacgttcacaattctaggccaaaagaaaatgggaacggggctcaaagttttgcggaactacttgatgctgtttcccacaccttctctctcccacggcccatccgacccttttcgtcccaaaatcgccgtccgcagatctccggatccaggggagaagaaaaaagaaagtcgaccccgagcaagaataaaagtgtggagtgaaaacgcacaggctgcctacctggggcaaggatcagctcagttcgtgccttgagaaagacagtgcgggtgggggtgggaa

SEQ ID NO: 211685 - DNA, 415 bp, Homo sapiens
gaaacaattgagaacacagggggaaaaaagacccaattatgcaccaggaagtccagtgccccatttttggagaaggaaagtgagagggcattgagtttcattgattgggtctccgtggcaggccagctgccccccaggaaggcctggtattcctgtcctctccgtgaacctgcctgaaagggatataggagttattgggtaatcaggacttgtcagcacctcggttatgcaggatggttcaatccgataatgtgaatggaacctgtaatagggctgatgaaaagcactccagtttcaaaagggccttgaatgattttttgttcattttctgtttacatgtaatgtgttattgatgtcattaccttataatacggcagcttgtttcatagaaaaaccaggaattattcattcttta

SEQ ID NO: 211686 - DNA, 615 bp, Homo sapiens
gtttaattgcattgcctcttttaacctcttgctgattaaatagtgggaaacgtagaaataattgtcagatttttaggagaaaacaggttgagaagtgcacttgcttattgaaggatgctttcccttttcactgaaattacctggacttttgtatgcaattgctttgtgccttccattatttttaatttcggcttacaattagagcttgcaaattgaattgctttctctgaggagctgtgatttctctatttggcaagtgccaggcatcccccgtcacaaatccccacttgctcagctgaaattaacatggttgattttgttctcttgtactgcaatcgggtctgatcagtagaatcatgatctcacttagtaattgcttccacagagtctgtagggagagcggatatgagtggtgctctgcctgatgaggagaatggaggttctccaggggagtacaagggagctttaggcaatgatcttggggattatagagagctgtccctctttacttgcactcagaagtcttgtggtatttaccaaagccattaagggccctgatgttggaagtgtcctctttggaatcaggataaattcaaagatgtggttagctgttat

SEQ ID NO: 211687 - DNA, 507 bp, Homo sapiens
caggttctggtggtgtgcacctgtagtccctgctgcttggggggctggggcaggaggatagcttgagcccaggagttccaggctgcagtgagctatgatcacagcactgtactccagcatgagtgacagagtgagatcatgtctctggaagggaaaagaaaaagaaaaaaggtaagaggtgcaggaagctacccatttaattttatgaggctatgatattgtcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactac

SEQ ID NO: 211688 - DNA, 292 bp, Homo sapiens
caatagtaatttccatagttttcaaaagactttcaaatatcttttatcatttgatcctgacaacaaatctcacaagctcagcaaggcaggcatgcagggaaatctttattctttatccttatacaaaggaacttgggcttcactgttcaggtaggtactgtatggaaaaaaatatttctagtccctcttgtccatccttcatttgcttttctccataagaggagtaatgtatccatctggctgctgaccttgtaaaaggctaacacctatctgactatgttggtcaggagat

SEQ ID NO: 211689 - DNA, 470 bp, Homo sapiens
atgtgcaggtttgttatatgggtaaacttgcgtcataggggtttgctgtacagattatttcatcacccaggtattaagcctagtacgacattagttatctttcctgatcctctccctcctcccaccttttcaccaacaaatcatttcgtgactcgactctagcttatgctgtttaatgcctttcctgctatgtttacctgacggaaatagtttctttggttctaaatatttgcacaaaactggttctgcctgtaagcatgatttacaacattaaaaaaaaacgttgacatagtgttgagattgagaaaggtacattggagtaagcagtgtcaggctaaaggtctctaaagtactctgttgaaacctaagtgaaggaggacaacttggtgtagttgctctccagcactcccatccccaacatccattttcccaagctcactcccccatggatagaacctgactgcccctca

SEQ ID NO: 211690 - DNA, 406 bp, Homo sapiens
agtaatatgtgtaaaaagaaatgtacagaacctgtgcagaaaactataaattgttactgtagaacatagagtaactggaaaaaaaaatcagactgtttgtttgaataataaaactcagtattgtgactgggtgcagtggctcacacctgtaataccaacactttgggaggccaaggtgggaggatcacttgagcttaggagttcaagagcagcctgggcaacatggtgaaaccccatctctacaaaaaatttaaaaattagctggcatggtgctgtgtgcctgtagtcccagctactcaggaggctgaagtgggaggatcgcttgagtttcggaggttgaggctgcagtgagccatgttcgcacaactgtactccagcctgggtaacacagcaagatcctatctca

SEQ ID NO: 211691 - DNA, 793 bp, Homo sapiens
gagacggtattagaggataacggcttttttcttggtgatgaaaatgttctaaaattgtgatggatatacaactgaatatataaaaaaatcattgaattatacactattattagttttgagatggagtctcactttgtcgcccaggctggagtgcagaggcatgatctcggctcactgcaacttccaccttccaggttcaagctaggattacaggcacatgccaccacacccggcttatttttgtatttttagtagagttggagtttcaccatgttgccaggtgtgggggtgtggacctgtagtcctagctacttgagaggctgaggctgtagtgagctatgatcgtgcagtttcactccagcctaggtgacagagcaagaccatgtctcaaaaaaaaaaagtaaaatttaaattatgtttgggttttgtgaggttataaagcattccttttagacttataaaatgaaagcttatgtttacacgtttcataggactgtttttaaaatttattttaatgttctttctgctgctttcatttatctcttatttttgtcttttcccatgttctaatctacctaaagttatagctatatttaatatagtgttaatattaagtattgtatttagggaaataacggatacatattgaaatagggatcgtattaccttatagtaatctaaagaaatagcaactctgcacctgtgtagtcttaccatgttaaaagaaccaaataataaatccataaatatttttatagagaacatgtggaccagcagtgcagagaagctgttt

SEQ ID NO: 211692 - DNA, 458 bp, Homo sapiens
gtggacaagtctagggagtaaaaactctggagatatgtctaataatggggaaacacagacgagttttacctgacagattctcacagtgaatattgggaaaaaatcatcccatgcttctgaaaaggagaggaaaaaggaaaccatttttaaatatgccagagcattttatttttcttaataaggcctgccctaaagagaaactatcttaccagagcctaaacttttagcattttatcagagtctaactgacctgggagaagaaaatacccaaatctagccccttggaggcttccacataaggaaagaaaaaaaatcaaactcagtattactctagccatcccatctcaggggagaaaggattgagaagcattggtgaggttcacatttttagaagcacaggctaagacctaatttatagaaccatggaccacttcccttccccccacgctttaccatca

SEQ ID NO: 211693 - DNA, 328 bp, Homo sapiens
cggtgcagtatgctaaaagccaggttgcaagtgggtgaaagagagaatgagaggtgactgaagtcagcgccttcgctttcctaagggaggatgggaagtgaagtaggcttgaggttatctaaagcattcccagcttttcagttggctcagaaattgggccatgacagagcttatggttggggacatctgaggatccctctacaaggaactgagtccaaagttcagggtgccaaagggcataacgtgcgccactgctgttcaaacagtagttcctagcacttcttcttttttttttttctcccaagacagagtcttgctctgtcaccca

SEQ ID NO: 211694 - DNA, 293 bp, Homo sapiens
attatttgtaacagtagaaaaactataaaccacttacatatccaacatgagtaaattagttaggtgaatgaaatccacacaatgaaatacagcattattttttaccatataatgaaataatacttttaaaatcttaaatttaaaaaatgacctaaattgtttataagcttgttaaaactacataaaaatagagtaaaaatgacccatagaaagatataaacagtgattgcctctagatgatggaattgtgagtgaattttgtcttcttctttgtatgttctatgctttcaagg

SEQ ID NO: 211695 - DNA, 706 bp, Homo sapiens
gaaagaatactggctctcatttattgggaatctactatgtgccagatactacattaggttttatagtttacatttcaagttagctgctattttatagttgaggaaagtaaggctgaggggttaaatggcttggttgagatgtcaccactccaaaaaaaatcataattcatattcactaagtgcttcctatgtgccaaatactgtttttaagcaattacatgttttatctcattaacaggtaagaagaagtggctgaaagggtgctaactaacctattcacaaagtcatgcagccacagggtaatgtatgctagcactttcctctgcaccacgctgtctcttgctacagaggtaaaggaaatatccccagctgtgcctctggtcaatcagcaggggctctccagtaaataaggaaggactgaggctttgatcaggggttgttgctacctttctgtctcctgcaccagaagaaacatccatgtgcaagaccaggacctgcaggtcaaggaaacagcatctcgatggcctggctgcacagccaggagttgtctaagtggacactccaagcacagccatacctctctctgctgtgaagcagcacctcctccatgccacccctaagacagctttgcttccctttgtcatcaggtcccacattgcccattgcctcttttactgcccaaggaaagcacagttctgtagcctta

SEQ ID NO: 211696 - DNA, 261 bp, Homo sapiens
ttagtagagacagggtttcaccatgttggccaggctggtcttaaactcctgacctcaggtgatccacctgccttggcctcccaaagtgctgggattacaggtgtgagccacctcgtctggcccatttattttcattgctttgtaactttcctttccttgaatatctcacaatgtattcattctaccttggacagacatttgcattgtttccagtttgtctattatgaatcttgctgctgtgaacattcttgtctattatga

SEQ ID NO: 211697 - DNA, 249 bp, Homo sapiens
cctggaggcgatgtgctggtgggaagggctgtggcgccgggaaacacggggtggaaatggaaccggaacgagcaaggagagtccaggcaccacctgggcgacagccagggagaggaatcctggatcccgggtctgagccggaagttgctcctctgcctgattccaaatgagctcaaggctggacccagcaccccagctggcatgtgtgaatctcggctggtcaccacccgcagggccggccttaactga

SEQ ID NO: 211698 - DNA, 529 bp, Homo sapiens
ccatcaggtttttaatgagtcacagtatttgaaggctatgaactgagaaatatcattcatttatggtcttgtcctgcagctgttgtgttttatataagacagtgtgatacaaacaaaacagagctctttaataagcttcactattaagtgcaactgagccatttcaggaaataatggcatttcacagaagagaatgaaaaacacgaagtgtaattttcctcaaataacaaagaggtaaatggatttaaaaaaagcataaatgttaacatagtgaccaataagtactttttggcatctaaaaatctcactgtagcacaactctttgcaccttagtttttgcttcaaatatgccagtcatgagtcaattatggtatatatttgtcaacaagtccttgtctgttttttcctaaattagggtcaagcaataaagctgccaaaaaaatttatgctttttttaaaggtaacactagaactcaaattcaggctagaatccattgtccaggtaaatccctgattatcaactgatcaa

SEQ ID NO: 211699 - DNA, 335 bp, Homo sapiens
aattttatgtacttctcatgatttaaattttaggcaagaatattactttttagccgggcgcggtggctcacgcctgtaatcccagcactttgggaggccgaggcgggcagatcacctgaggtcaggagttagagaccagcctggctaacatgatgacaccccgtctctactaaaaatacaaaaaattagctgggcgtgggggtgcacgcctgtaatcccagctactcgggaggctgaggcaggagaaacgcttgaacccggcaggcagaggttgtagtgagccgagatcatgccactgtacttcagcttgagcaacaagagtgaagctcttgtct

SEQ ID NO: 211700 - DNA, 639 bp, Homo sapiens
cgcggtggctcatgcctgtaatcccagcactttgggaggccgaggcaggcggatcacaaggtcaggagtttgagaccagcctggccaatatggtgaaaccctgtctctactaaaaatacaaaaattagcctctaaatattatataattctagcccagaaacttacattcctcagtctccaaagggagacctccacaaaacaataatttactataatgtcagtttctatcagcatttcacataatcacataaataaaacttctgtatcgattataaaactcacagtccattaggtttttaaaatatctctaatgtaaaagattctccaacatttatatcaaaccatgattaacaaaaagttcctggtcaggggtggtggctcatgcctgtaatcccagcactttgggaggccgaagcagatggatcacttgagcccacgagttcgagatcagtctgggcaacacagtaaaacccgaaacctcacctctactaaaaacacaaaaattagccaggcgtggtagcatgcacctgtaatcccagctactcaagaggctgaggcatgagaatcccttgagcctgggaagcagaggtcacaccacggcactccagcccaggcaacagagtgagactctgtcaaaaa

SEQ ID NO: 211701 - DNA, 887 bp, Homo sapiens
cgcggtggctcatgcctgtaatcccagcactttgggaggccgaggcaggcggatcacaaggtcaggagtttgagaccagcctggccaatatggtgaaaccctgtctctactaaaaatacaaaaattagcctggtgtggtggcgggcacctgtagtcccagctactcaggaggctgaggcaggagaactgcttgaacccaggaggcgaagtttgcagtgagccgatatcacgccactgcactccagctgggtgacagagcaagactccgtctcaaaaaacacagtacctccttcaactcaaattgcttccccaacaacattgtcaggatgttaaataaaacaatgtttggaaaacacagtgcttcatgcgtagtaacaatgctaaatataacacttaaaatgtgcaaacctcatgatttacctaatcagcctctaaatattatataattctagcccagaaacttacattcctcagtctccaaagggagacctccacataaataaaacttctgtatcgattataaaactcacagtccattaggtttttaaaatatctctaatgtaaaagattctccaacatttatatcaaaccatgattaacaaaaagttcctggtcaggggtggtggctcatgcctgtaatcccagcactttgggaggccgaagcagatggatcacttgagcccacgagttcgagatcagtctgggcaacacagtaaaacccgaaacctcacctctactaaaaacacaaaaattagccaggcgtggtagcatgcacctgtaatcccagctactcaagaggctgaggcatgagaatcccttgagcctgggaagcagaggtcacaccacggcactccagcccaggcaacagagtgagactctgtcaaaaa

SEQ ID NO: 211702 - DNA, 535 bp, Homo sapiens
gcatggtctcacttattcatggaatccaacaaagtcaaacccacagaagcagagagtagaagggtaattgccaagcactgggatgtggtttgaggaagggaggcatgggaaatagggaaatgttggtcaaaggtacatgttttaatcagaaataagttcaagagatctattatgcagcgtgattactatagttaataatatatttactcttgaaaattgctaagaatgtagattttaaatgttcctaccaaaagaagtcaaaaccaaatggtaagtatgtgaggtaatgcatatgttaattagcttgatttaattattccacaatgtatacatatatcaaaatgtcacaatatcacattgtataccataaatatatataatttgtatttgtcaattttaaataagtaaataaagtaatgagatagctttcaactaagcttatatagtggtataatataaaaatttttgtagtaacaaaattatagtaattttggcttatactgaaatgtgcattaaacaagtgtttgcataaaat

SEQ ID NO: 211703 - DNA, 488 bp, Homo sapiens
ttagtagagatggtgattcaccattttggccaggttggtctcgaactcctggcctcaagtgagccacctgccttggcctcccaaagtgctgggattacaggcatgagccaccatgcctggccatctcatgttgccttttttgccataagtcatcaactcatgaccatttcatgcacttgctttctagatgttcttgcttttgatctcttcccattttagtctactgagagactaatctttaaaacactttcctttattataacattaatgtacaggcagacatataaggcaaaggttttaatatttgatcctattcagttttcccaaatgtgttttactactgcttaacctgcacgcttactctagcctggaacattttatttgttagggagttgaaactgagattcactgaattctcattgggagaataagagtacatatggaagggtgaactttagagcaatatcctgcaaggaaggatattgagg

SEQ ID NO: 211704 - DNA, 556 bp, Homo sapiens
ataatagccaccattaatacataatgcttattatacgccagatgcttttttaagcacttcatagatatttacttgtcatttaatgcttacagaaccctgtgaagaattattatcatccctattttatagtaaagatatagagcctgaagaggcagaggatcctgcccaaagtcctacacctagtgacagagctgggatttgaatccaggcagtctgactcacgggtaatgctgaacccatcatatcttaactgcccataaagatacagagagaaggctgggcacagtggcttatgcctgtaatctcagcactttgggaggccaaggcaggaagatcacttgagtccaggagtttaagaccagcctgggcaacatagcaagaccctgtctctacaaaaaattataaaaattagctgggcatggtagctcacacctgtcgtcccagatacttgggaggcggaggtgggaggtgggaggatcacttgagtctgggaggtcatggctgccataactatggcatggtcatgagccatgattgtgccactgcactccagcct

SEQ ID NO: 211705 - DNA, 510 bp, Homo sapiens
catgatggaagtatcttgatagtacccaaagaactggtagcctcaggccagaaaaaggaaacccaaaagggaaagagaaagtgagaagaaactgaagatggactctattacgtgaagtagtaatgttcagaaactgattatttggatcacaaaccattgaaactgcttcaaaaattatatctttaagtactgctacttgaataactcagttaaggctctgttttgaagcttacatggacaaatgtttaggacttcaagatcacacttgtgggaaatctgggggagccataacttttcatgaaatgcattgtatacaaaattcatagttatgtccaaagaataggttaacatgaaaacccaataagactttccatcttggcagccatcctttttaagagtaagtcggttacttcaaaaagagcaaacactggggatcaaattgttttaagaggtatttcagttttaaatgcaaaatagccttattttcatttagtttgttagcactatagt

SEQ ID NO: 211706 - DNA, 376 bp, Homo sapiens
agatagttttagatggtaaatgtgttaacattttgaaaaaatttatttaattggcttaaatattcagcattgtttaaaatttaaggtactgaacaaaaaaattaatgatattttggtaattggagtggtgctatttggaactattttaaggacttagggaaaactcaagttttcaaatcctttttgaaagcttattctcttataagcaaacataaaaatatctttattgcttcattccatttgaatcttgaccagtaattagagagaaaatcaacgtggctggaagggaaatggagtggggaaagctggacttatgcatagaaaaaactatggcaactggcaaatcattaaaatctggagactatcttgtttattt

SEQ ID NO: 211707 - DNA, 380 bp, Homo sapiens
cagagtgagacttgtgaaaaaaaagaaaaaattaaaaaaacacactttaaatggggacttatatggtatgtggattatatctcaataagttgttaaaaaataattaaattgcatcagaagacaaaaagatgtacatatgactatatttactgcagcactgcttgtaatgacaaaatacttgaaacagttaatttgactcttgtgtgatatgtaacctaaggatgaaaacaacctttaaaactgtaaactgctttctgtagtgacactgtggatagtaaaaaagctgacttattctaagattacaagatttgtgttttgtgataagataataagtaattttgttggtatagcaaaactgggattttgggttctggagaaag

SEQ ID NO: 211708 - DNA, 529 bp, Homo sapiens
tcagccatagttcatccttgttaagaatatgtttattcaaccttgcggaggttgggatgatgcctaagagaagaaccaacttaggcttctagacggacctatcgggagacctgttccaagtaccaataatgtctcttcttcaaagatgtgggcattggtgacccactattagagattttatacaagttttggggctatcagggaccttagagatcgtctagtctggattcaaacattaatccaggtatcccatcctcaaagattgccagggagctgcataagcttcccaggtgatgtcaatgcgcagctggatttggaagtgaatgcctaagtaaaaaggataatttaggcaatcacttcaaggttcatccttggaaagtggattgtttctactttttggctgttatgaataatgctgctataaacatttgtatataagtttttgtgtggatatgttttcttttctcttgggtatatacctaggagtattactgctgggttatataataaatctatatttaacctcttg

SEQ ID NO: 211709 - DNA, 450 bp, Homo sapiens
tgcctgcactcaagagcacaacagccctaaaagcctcaaacagaagaacaccacacacagtatgccggcgctttgcagtttcctctgtagaacaccacacacagtatgccggcgctttgcagtttcctctgtggaacaccacacacagtatgccggcgctttgcagtttcctctgtggaacaccacacacagtatgccggcgctttgcagtttcctctgtggaacaccacacacagtatgccggcgctttgcagtttcctctatggaacaccacacacagtatgccggcgctgtgcagtttcctctatgagactacgctgctttcactgacactaactaagaatgtttctcttcaaggaagaccgtcttggccttctcaggctctcagcagaggatgatgatgataatagcagctgtcattcactttacatggtaaagtgacacagtaca

SEQ ID NO: 211710 - DNA, 217 bp, Homo sapiens
ttggagtttgctttccattcagtgggaaatgtagctagccttatttccacatgtggaatcagcctctgtctccctttcctaaagctagtgtgttttaaaaagccaattgatttatttagcaggatataaagtcagttttagaaaagttaattgaaatggtcttgtcttcctcctgttttaacacttttctaaatatctctgttgatggaagagagca

SEQ ID NO: 211711 - DNA, 105 bp, Homo sapiens
aataccaactgtagcacagccatacaacagaatacttctcagcaacaaaaaggaacaaactgtcaatatatgcaacagcctgaatcaatctcaaagacatgatgc

SEQ ID NO: 211712 - DNA, 328 bp, Homo sapiens
tcaaactccttttgtacttccttctatgggacttaaacttatattgtcagatcttacaaggccaaatggtgtcatgaataaagtggctatgggtggcaaggatggaggtcatgcatgggctcagccaaatgtacttctacttaccaaggtggacctggttacagcaaccactgaatatatacaaactgttagcaatagaggccaacactcagctccaatgtggtaccattccctggggtgatcagctagctacctggtggcaggagattgagttatggtatagggacatgtgtttgggtgccaagttgacaaggggtggacttaattg

SEQ ID NO: 211713 - DNA, 527 bp, Homo sapiens
  misc_feature (19)..(19): n is a, c, g, or t
gtagcatgaacttcatggntttttgctcactcttgccaaatgccctcctcagtacaatagtcagaataaaactaccctggctcttccctcacgacataaggtgaataatgaaactgacctacaatgttctggtttgtgtggagctgcccaagggactgctttctgtcttgcctgaatcagagtgctaatgggaacaatggcatagtttggataggaggttggaaagagctgaaagcaatgatgggtaccatggcatgagtgagctgcaggggaacacagacctacagaaacctgtgggcaagagatcagagacaaaagaataacagaacagctaagactccaagaggaagctggaggcaaactcaggaaaactaagaaaaactgaaaggcagctgtgtataggaggaaactaaaactaatgcatatgcacaggcccagggaagatggcatccccaggaaaagtttgagaggacaccaagcctttatggtgcgctaatcagtgaaggcctttccatgcatggagccag

SEQ ID NO: 211714 - DNA, 373 bp, Homo sapiens
  misc_feature (12)..(12): n is a, c, g, or t
ttatttatgganggacagatagcaagaagaaatcgcactctggattacaaagtgggaagacgcacccccttggccagaatgcctgcctcctatgttcatgatggatatttctaattgatcttgacactcttttccactgagcccatgtcccaaattggccctgagttagggagaaggctctagagtgggaaaggtgtacccaaaacttccctaatctgactatcaagcctaaaaaattaaactttcaattcaacatcccttgtttctccaacttggagtgcctgatggtgtgggaagcccctactcatacaaatttatagttgaagattgttggtaattttgcccaaccccttcttttttttgttatacttta

SEQ ID NO: 211715 - DNA, 507 bp, Homo sapiens
taagatgtgtcatctttgtgaatatgatctagaagaaaaagcacaattatttaaatatggcccattttggtttctgatagatttgtttgacaccttttcttattttgaggtgtagtatgcttccatgtacctttccagtataaattcaggtcctaccatctggagtgactcaaagtaaggttggacttcttttggaagacaaaaacaaacaaacaaaaagcaaaaacaacaacaacaaaaacaattattcaaatatttgaagataaatattgctgcgaaaggccatcatggcatgttcatcatatggcatcccctgctatgtctcttcctggttgggaggaaatggggtccttcacctgctgcccaagacgggtgcgtgcaagtcatctcctgtgtcgactgtgggacgagacccgctgatcataagaaactgaactgatactcactgttgaaactgggctttctctgtttcttctatatgatagtaaagcattgttccatccaaaa

SEQ ID NO: 211716 - DNA, 346 bp, Homo sapiens
tctgcttctcttctttaatctcttaatctatggtttgaaaataactgccaaacgaagccaggagcagtggcttatgtctataatccaagtactttgggaggccaaggcaggcagatcgcttgagctcaggagtttgagagcagcctgggcaacatggcaaaactccatctctaccaaaaatacacaaactactgaggtgtggtggggagagcatgtagaactaggtactcagaaggctgaggtgtgaggatggcttgagcctgggaggtggaggttgcagtcagtcaagactgtgccattacactctaacctgagacagagccagactctgtctcaagaaaaaaaa

SEQ ID NO: 211717 - DNA, 544 bp, Homo sapiens
agaaggtgcaaagagggcttcataaactgcatccaatgctaaataaaaatgaaggagatgaggactcagagggtctttggatttagtcctttggttggtagtgatctttgtgatccaagtctgtagagtttccactgagtgaaaagatggttgccctggttaaggaataaatggaagaaagagaggccagaagcatggaatattatttcaagaagttttatgtgaagaacaggaaaaggacattgtaaatttaggataagaggccgggcgtggtggctcacacctgtaatcccagcaatttgggaggctgaagcgggtggatcgcctgagctcaggagttcaagagtagcctgggcaacatggcaaaaccccatctctactaaaagtacaaaaaattagctgggcatggtggcatgcgcctgtggtcccagctactcaggaggttgaggcaggaggatcgcttgaacccaggaggcagaggttgtagtgagccaagattgcaccactgaactccagcctgggtgacacagtgagactccgtctc

SEQ ID NO: 211718 - DNA, 1009 bp, Homo sapiens
agccacctctgcaagggtgtgccaggaacaggtgggccaatcaccaacctcacatgctgccagtcacagtacatcagttattctgccctagagttagggccccagtgccatctgcttttcctcaggactctgctccatcagccatcaggtggcagctactcatgctgttggaacctggccatctgggcttccttgagtgggtgaggctgctggcttgtccgcctgcttaaaggtactatggggatagaacactgaaataataataatgcatttttcaaacaaattaattccttggttttcaaacaaattgaagacaaaggaaactcatgattcaaatgaatacatatggctcattttattcaatatttatgcttacagaatatatggaaataagacattcccatgattaatattagtatttaagactgataaacttttgagtgggcagttaaagcttatcttctactattttctaacttcagaaatgcttttgtttgaaagttgggtgacaaagtttcaaggagaataagtcccaatattcctattttaaatctctcagcttgtgcaggcagggcaggtaaacatgaagtttttaaggatagaagggacctgagagatagcagaatatgtctgctacataacaggtactcaggttatgtttgatgaataaatggaatgaaagaatggaaaaatacagttggggagttcaatatttttaaataaactcctataaagcaatatttttgcaatagtaatatatgttatttttatttaagaatacaattaaaatgaaatgattaatctatcattgtttgcttacttactgtattccttacacaacatatttccttataactctttgccatcaatctgcacctacacaccacaacgacaaacaaaactccaacgcagacaaacccgggaccgacaacgccaggttatcaaatggccctactctaagacaagacacttatccctcaggataagacccccacgccttgcatacacc

SEQ ID NO: 211719 - DNA, 899 bp, Homo sapiens
agccacctctgcaagggtgtgccaggaacaggtgggccaatcaccaacctcacatgctgccagtcacagtacatcagttattctgccctagagttagggccccagtgccatctgcttttcctcaggactctgctccatcagccatcaggtggcagctactcatgctgttggaacctggccatctgggcttccttgagtgggtgaggctgctggcttgtccgcctgcttaaaggtactatggggatagaacactgaaataataataatgcatttttcaaacaaattaattccttggttttcaaacaaattgaagacaaaggaaactcatgattcaaatgaatacatatggctcattttattcaatatttatgcttacagaatatatggaaataagacattcccatgattaatattagtatttaagactgataaacttttgagtgggcagttaaagcttatcttctactattttctaacttcagaaatgcttttgtttgaaagttgggtgacaaagtttcaaggagaataagtcccaatattcctattttaaatctctcagcttgtgcaggcagggcaggtaaacatgaagtttttaaggatagaagggacctgagagatagcagaatatgtctgctacataacaggtactcaggttatgtttgatgaataaatggaatgaaagaatggaaaaatacagttggggagttcaatatttttaaataaactcctataaagcaatatttttgcaatagtaatatatgttatttttatttaagaaattcattccacggactgtgttacccatcatggttgcctacatcgcatgatacttagaaaagctatgtacttctaatacttgctataattcgcgacgaacaacaactacccaccccccccac

SEQ ID NO: 211720 - DNA, 222 bp, Homo sapiens
cggtaacacaggggcaaagttggtttggtcagctttgaagcatgcaaaaccaaactcgcctgtcatctaaactgacgcagtgtggggccaccttctcctattaagtgcagtcctcaggggatagatggatatcctcatttgttaaaagttatatataatgcttttgcaaaaagcagtttttaaaatgatgtgtctgtcttgagtgttaaattacttgtttta

SEQ ID NO: 211721 - DNA, 319 bp, Homo sapiens
ccataagaagcaaagaggaaggaggtccatgttcaagtcatagtttatctaattaagacatgattcaaggcagaaaccatgttcagagcatttaatgcctgagatacccccggctcaacaggtttttatttgagaaccaacctgtgcataacagcaagatggccgtccggtttacagcatcctattgtagtagtgtaaaatcttagatttgtacccagagatttttgtttaagtccagggctgggcaattgtctcctgtggtacaaattcagcctgttgcttgtttttgtaaataaagttttattggaacacagctatg

SEQ ID NO: 211722 - DNA, 342 bp, Homo sapiens
ctagtatgtgattcatgtttactcaattaaattaaattaatttaagatgaaccctttgttccttacatctaacagttaaatttttttcttgattatcaaattatatcattatttgagaaaatatgcaaaatatgtaaaagcttaaataaaattaaatttttctaattatacaatacagggataacaactgttaagattttgtttcatgtagatatgttatatatacttttatatttatctgtttaggtcatcttttttttaacaaaatcagtcatattttactaactttgtaattaactttttttcatttgacattcttattgctgggagttgattcttaag

SEQ ID NO: 211723 - DNA, 708 bp, Homo sapiens
catgtcaacatgcccagttaattggttttttatatttttgtagagacagcatctccccaggttacccatgctggtccaaacacctggtctcaagaaatccttctgctgtgacctcccaaagtgctaggattaaaacatgacccaccatgctcagagtccattttcatttctgatttgagtaattttaaacttttctctttttttcttagtcaatctagttaatggttgtcaattttgttgattttattttgaagaatcaacttttggtttcattaatttcctctattctttttccattctccattttatttatgtccactctaatccttattatttccctcattcactgtgcttgggtttagtttgttcttctttcatatcctgaagtattaaagtaggttgttgacctgagatctttcttcttttttaatgtaagagtttacagttataaatttcttgcacaagactcaacttctctgaacctctgattcctcacctgaaaattgcaatgagagtgctttcttcataccattcttttaaatgtttaatgcaatcaatgaaacaagatgccacacagaggagccaatgtcagctgctatattactaccatcatcattagccttgaggtcaaatagtcctagaatcaaatttcagatccacctgtcactagccatatgacaccaggaaagtttttacaccatgataagc

SEQ ID NO: 211724 - DNA, 397 bp, Homo sapiens
tggtcctaataagctgtgtgtcaggtagaataagttcttaatgagtaagcttcctattgctaaatcaacatatcgtttaggggaaagctcatttacccacaaacaatatctgcgttaagggaaaaaaaaccttcagataaattagagatgattgttataacaggatccacgctttatttctttgatttaggggtaaccataatttatttaggtttgcattaatatatttctagctactagggcaagttttgaggaggggctagaaagtttttagtctcataagtcattgctctgtgaagatcaatctcaaaatatgatgaaactttttttaaatgatatcttcatgtcagtcagtgacgaaacttttttcctggcagtctgactaagcaaataaagc

SEQ ID NO: 211725 - DNA, 560 bp, Homo sapiens
atatataacataacatttgccattttaacaatttttaatgtacacttccatgtcagtaattatgttcacaatattgttcaaccaacaccattatctattttcaaagttttttatcatcccaaatgaaaactgcacccattgaagaataggtccccatctttccttgtatttggggacatcacgctcttctagttttcctctgtctctgtcctcctctggatcccttcctccctgccttcttcccttttctcagccttctttgtgaatatattttcatctgttggttacttaaaatctgctctccatgagtactgtcctaggcccttgtctcttcttactttatacttttatctaaagctagatcttttacctgagccctttaatataattcattacttacctcttgctacccaccaatggtataatattttctgtccctctaaagctttaccatttcttttctacacatttgcaattgcatttttctatgcttggaatttatttctcttaagtgtgttcattatttttaagatcttaacttggaggtcacttcttccagg

SEQ ID NO: 211726 - DNA, 533 bp, Homo sapiens
tcttcagtctccctgtgttttcccacaaggaatagtgtggaaaagacttggggaaaaaaaaatcatcatgattcagccaatgaccagggcagaggtataaatggagcatgattctatgtatctgtctagaaggcatatatggagcatgattctatgtatctgtctagaaggtatatatggagcatgattctatgtatctgtctttctgtacttgttgcctactgagaaaatacagatttttattagaaggttgctgggcacggtggctcacgcctgtaatctcaccactttgggaggccaaggcgtgcagaaaacctgaggtcaggagttcgagaccagcctggccaagctggtgaaacctcgtctctactgaaaatacaaaaatttgctgggcgtggtggcaggatcctgtaatccaagctacttgggagactgaggcaggagaatcacttgaaccggggaggtggaggttgcagtgagctgagattgcgccattgcacttcagcttgggtgacagagcgagactctgtctc

SEQ ID NO: 211727 - DNA, 359 bp, Homo sapiens
aaaaggaaatatttggctcattttttagtttccctaatccatcctgagaggtagaagataaaggaagaatttttggagaaggaggtgatacttcatattagtcttcataggaattatccagaatagggagaaagtcatttggaagagaaagggtagttccggggactggagaagatgttcaaggaaggaggtggtgaaagaagagacctgagtcatcatcaggcctgaagtcagggctggctttgggtaagccacaaatgccaccttattaaggccttctctcctgcactttcaaaacatgccttcctcccccaccagcactccctattgtccttaccatgattttaaaaagcgtatat

SEQ ID NO: 211728 - DNA, 558 bp, Homo sapiens
cactaataaaattacaccacggagacacaagatagaataattctttctaccatcagaaacaggttaatcaataagtcgcccaaagttagtatcacccaatctatatttttaaaattttggcaagccttatttgtagatgactttaagagctattttttttaacccatcacacttaaattaatattacttttcatttctgtgtctacactctggaataattcattgccaaatgtatgatccctgtaataattatgaacatttgataataccccatccatttgcaaagtacaccacagatgagtattatattcattaaggttctccatttataaacaacatttatcaacttcagctaacttaaacaaaaagagccaagtatgttggctcacaccttgtaattccagtgctttaggaagccaaggcaggagagtcgctcgagcccagcctgggcaacaatgtaagaccccatctgtgaaaaaagtttaaaaatagccaggcgtgatggccatgcctatagttggtgtgagccatgattgcaccactgcactccagcctggg

SEQ ID NO: 211729 - DNA, 341 bp, Homo sapiens
aatatgtgtacaaacagacatcaacaggctgtcatttcctgttatagaaccatgaaattaagcacatttataaaaccaaaaacctggaaagtctttaaaggctagtttcaaaatctcaattaatcaaaatcttccagatggcaattcttttacaattattcaataagctgtaacagtataggacaaataaaatcaaactataaacggcacatggcaccaactcacacagcatgctctgtgatgccttaacgctcgcagctctatggagcgtacagtaacgtagtgaatacaagtgctttccagagcacaataacaattacagccttattttaaaactgcaa

SEQ ID NO: 211730 - DNA, 391 bp, Homo sapiens
tttcctccaaatttggcatcttatctttcaagtacatgaacccaacaattagtgtcatttgtgagaaagtttagagggaacacaaagtatgtatgatccaaaaagcaagcaactgctgggcacagtggctcatgcctttaatctcagcacttcgggaggccaaggcaggagggtcgcttgaacccaggagttcaagacaagcctagacaacatagtgagacttcatctctacaaaaaaaaaaaaaataataacaggcatggtggcgcttgcctgtagtcctagctgcatgggaggctgaggcaggagaattacttgtgccccagaggtcagggctgcagtgagccatgactgcatcactgcactacagccagggtgacagagcaagacctt

SEQ ID NO: 211731 - DNA, 488 bp, Homo sapiens
tcccttccagcccccgcctcccactgtggccattggcaggggctgttgggatcaccacagagggcacatggggaaggtggtgcaagtgctggccttcttgtttctcctagacttttgctaaggcctgtgtggggaatacccctgttggttgccaagctaagcattttcataggctgagtcacatagacagagctttactttgtgaatacaaaacagggaaataaaggaacaaaacaccaatcctgaagggcaatgacatgatcattgctaagtgccattgaatgaactcaggataactctcaacctcactcttctgtggttctgttttgcatatgtataatgtgaacttctaatgagttggttaatattattccctcctccctgttttctttaaaccctgctttgaagcataatggtgtaaaccagtaagaagtttggaaagcctgtgcttgtcattggagtttaattaaaatacactaagccttgca

SEQ ID NO: 211732 - DNA, 447 bp, Homo sapiens
agcaaaagataaatatactaagtaaattttatgatttattaaaggttgataaatactatttgtaaaaaaccaatggacttctggtttctgatgcagcatgtaaggagcttgaaagttgtcactctgtcctaacaaatagctaaacaaactgaaaatcaacaactcttcttagatccatcagagaatggaggtcacagagcaaactgaagccccccaaattggagaaagacacgtggatacagagaatcacaacttactgggaacaagcagaaacctccgtgggaacaaagggcagagtaggaaaaacctaagctataattgataaactgctggaagctcaatgtgaacaaatctgagagttaacttgttgtgggggaaggtgatggatatgttaatttgattgtagtaattatcacacaatatatgtatattaaatcatgtacactt

SEQ ID NO: 211733 - DNA, 601 bp, Homo sapiens
gtcagcattcaagagtaagagtacagcatccaaggattatttagacacccacctttaaacaaagctttgaggcagaaaattaaagtattctgcctctaggaaactaaagtagggatgattggtaaaattatttcatacatttgtttaatctctcactgttagtatctgtatacagtttaaaggttagctgccttaaactgccctttaaaacaaggtgggaagtggagggagaaatcctagcatatattactttacaagaacaatacagtttagcttatatattcagcatgtccctaggtatcttgctattttaaaaaagaaaaaaagataaaacatttcttcttacaagtttgggcttctatagccacatttggagatggagccaagttccaatcccggctccatcatgcactagttatttggtcttgattgagccactgaccttgtgtgtctcagtttcttcactgatagaatggaataaagacctatgtgcttgacaggattactgtgggaacatgcctatcacaggaaaagtgcttagtaaattatagtcattaatgctgtattaaggaatagtacactaaggtctctacatccgtat

SEQ ID NO: 211734 - DNA, 686 bp, Homo sapiens
cgagctcggaccctggacttcccggggttgcaagaggttatcagtggcctgagcaagatggtaacagagaggtgctgtgtcgcccaggctggagtgcagtggctgttcacaggtgtagtcatagctcattgcagcctagaactcctggcctcaagccacctgagtagctgtgactacaagcgtgccacccactgtgcctcacctgaaagacgcctttgctgggaagagagaacatcctatatttactgaaaattgatgtcttacatcctaacactactctttccattttgggtttaaagggcccccatgggccaccaggatgcacgtgaaggtgaacccctggtcctgccagcctgccgtgtggcccgcaccacagggctggttgcaggcctacccctaaacccccagccgggcactttctaccttgattggtctgggtcaccagttctctaagtcttcagactagctggtagccctgcataaattatctcatcctctgagattcagtctcatctgaaatggtggggaaccttaaatacctacgaagggcctggcactatccctggtaaattcgaggccaaaagattcattcccttccctcgctctgggaaggtccaggttacgtcatctctccgtgcctcagtttccctatgtgggataacgtagtacctagtgaatagcggtga

SEQ ID NO: 211735 - DNA, 379 bp, Homo sapiens
cacacttgaagctagatgatggatacgtagaggtttattattctgttatttgcactgtgtgaagatttgaaatttcccataataaaatgttaaaaataaagaaataaaatggttttgagtgaattcataggaaagaaaagaacagtttgttgtctctggctcctcagaaaatgatgccagccatgtttttttttttttaggtaacctgtgttcttctgatctgaaaacaaattaatttttccattgctctggattgtctctgagatcactgtgcttaggaatgagatgaaagatactcttgggcagtaacatgatatttaaagaggcaaatgataagaagtgaatactattgcaatgcattaaaataatttaacccaaa

SEQ ID NO: 211736 - DNA, 599 bp, Homo sapiens
tcacatataatgaaatattattcagccttaagaagaaatgaagttttgatagatgttacaacataaataagccttaaaaatattacgctaagtgaaacaaaccatgcacaaaggacaaatattgtatgattccacttttatgaatactcagaatagtcaaatttgtagagatagaaggtaaaatagtggttactgggctcgggggaggaggtaatggagagttattgtttaatgggtatggggtttcagttgagatgagaaaaaagttgcggagatgaatagtggagatggttgtacaacaacgtaaatgtatttaatgccactgaatcacacacttaaaaagggttaaaatggtaaattttatgttctgtatattttaccactataaaaagaaaaaaatagccaggtgtggtggctcacgcctgtaatcccagcactttaggaggctgaagcgggcaaatcacttgaggtcaggagatataaaaaaattagccgggcgtcataatgtactaaatgccactggattgtacaatttaaaaacagttaaaatggtaaattttatgttatgtgtaatttgccacaataaaaatgctaaaaac

SEQ ID NO: 211737 - DNA, 486 bp, Homo sapiens
cctgaataggcggaggctccgaacagggaggagaatgtcccagagggaggctactgcttttcattccaagatatggatagcaccagaaggccttgacctgcagcacagcagttctctgaagctggtgggaagctgaagaagctgagagctgatttcttgcagacaggagaagttcttctttgaatgtctaccaaaacattctttaaagaagaaagccataattcttgccagcactccctcacaaaaccacttataacttgcagacatcggtctggggcagctgggataaaaatttaatcccacaactaaataataggaaactgttaaaatatttacagtaaaatctgccaacttcccaggacaaatctcttcataaaacacatttacccaagaacacatcatgctctggggaaataaaatacacattgccgctttggtattgtctttctaaagtccttatattaaaaaatacaaaaaacaataata

SEQ ID NO: 211738 - DNA, 571 bp, Homo sapiens
agactccgtctcaaaaaaaaaagatgatgttatagaggctaaaatactctgacctggccactcccctcttcggccaaccaaatcctgtttccgcttgcgtgcccctcagcacctggttctgtgcatggccgtgtgtgtgcattcagggagtcaggccctctgttctcacagaaacggggctctgccacacacatccctctgcatctttctttttttttattctaacattcaacaaaccctcctggtgctctgtccctgctggcgcctgtgaatccacactatttcccacagtatctctatccagcctctattgatagacacttttttttttttgagacagagtttcactcttgtagcccaggctggagtgcagtggcacgatctcagctcactgcaacctccacctcccaagttcaagtgatccttctgcctcagcctcctgagtagctgggattacaggcacgcgccatcatacctggctaatttttttgtatttttagtacagatggggcttcaccatgttggccaggctggtcttgaactcctgacttcaggtgatccacctgcctca

SEQ ID NO: 211739 - DNA, 182 bp, Homo sapiens
gatgacctctaaggaactcaacaagcttcccactgaacctcaccctcattttaccatgtagtttgagaaaggtcatcatacacaagtacattttacacaagtgatcagaataatatgttgccaaattaccagggagcttttaaggaactgccgtattggaagcatggacaatcaatcagaac

SEQ ID NO: 211740 - DNA, 378 bp, Homo sapiens
ttaaaaacagtatgtttggtcaggcacagtgactcatgcctgtaatcccagcatcttgggaggccaaggcaggattgcatgagcccagaaatttgagaccggcctgggcaacaaagtgaaatcgtgtctctaccaaaaaatcaaaaaaattagctaggcatggtggcatcctcctgtgatcccagttacacaggatgaggggatgaggcaggagaatcatttgagcacaggaagtcaaggctgtggtgagctgtgttcgcactactgcactccaatctcggcgacaaagcgagaccctgtctcaaaatgaaacaaaacaaaccagttgtttggctatatatcacacattcagggtccacagaatagagctgaccaaag

SEQ ID NO: 211741 - DNA, 836 bp, Homo sapiens
ttctctacatagactttagagtcgatatgtcaatgtccataaaataacctgcaaaaggctttcattgaaataacattgaatctatgaataattttggggggacttggccactttataatattgaatcctataatccataaagatagaatacctcttcattttattatattatctttaagaacttgctatactatttcatagtttttggtgtgcagttattaactgcatttcagtagcaagtattcctagctatttgatgtctttgtataagatacttttttaaaatttaaagttttatttttaagttaatggtatatagaaatacaattgaattttacatattgactgttaatccagcaactttgtcaaatttaactgttagttctaagagcttgtagattattttgttttaatcctgttaaactatatttttattttgtgtttatttttcttatttctacatccacatgctttatgttcatgtcaagtgtctagtgttccttgtactcattctaattttctttcattatattttttacttttattttaattctataacttacttttcatctatttcagttttttttctatcacttccctgagttcttatatttctactttgtaatcttccttcatacaggtgattgtgtcaataagattttcaattaattataaacttttggtcatacttttcattcattctatggcaacaatttctgtggtcccaccctttaacttctggagttcctctttcaatacactacattgttgcgactcttcaaaacaccggggcggccaaccgaggggagccgtaagcgggcacaccatagctcgtg

SEQ ID NO: 211742 - DNA, 212 bp, Homo sapiens
agtagagaaaatataaaagcaacacagaagccacagtaagtcaaccagaaggacaacagaggacatccagtaacttaattacagaaataccggaaagaacagagaaaacagatggagggaattcatcaatcaaataattcaaaattccccacagctgaaggacatgaatttctagcttgaaagggcccactgtgtgcccacactgtgaagtg

SEQ ID NO: 211743 - DNA, 415 bp, Homo sapiens
gctgcgactacaggcatgcactaccacacttggctaattttctttttaagggtgcttttttgtttatttgtttgtttaataggtgaggtgtcactatatttccgaggctggtctggaacttctgggctcaagtgatcctcctgcctcaacctcccaaaatgctcggatttacaagtgtgagccactgcacctggcctgcacaattattataaaaaggaatgaagcccagttgagttgcagaaaattgaccactttttcatttttttttctaaaaacattcatgttgtagaacatattgtcaatcacccagattgtctattttttgttcggttaaaagaggattgctccttatttcacattattttctgacattattgtttcatttattccttttatggttttattcaattagata

SEQ ID NO: 211744 - DNA, 260 bp, Homo sapiens
atgcccagccagtattttattcttacgatgctgttataaatggaattgttttgtttatttttggagtttttattgctagcatatgggaatataattgacttttaggtgtttatcttttatcctacaaccttgctgaactcatttattacctctggtagttatgtagtttgaattttctatatacaagatcatgtcactggcaaatagagatagtttacctctggatgccttttatttcttttttttttttaattttaaag

SEQ ID NO: 211745 - DNA, 1065 bp, Homo sapiens
  misc_feature (726)..(726): n is a, c, g, or t
  misc_feature (760)..(760): n is a, c, g, or t
  misc_feature (813)..(813): n is a, c, g, or t
  misc_feature (911)..(911): n is a, c, g, or t
  misc_feature (922)..(922): n is a, c, g, or t
  misc_feature (929)..(929): n is a, c, g, or t
  misc_feature (940)..(940): n is a, c, g, or t
  misc_feature (955)..(956): n is a, c, g, or t
  misc_feature (958)..(960): n is a, c, g, or t
  misc_feature (978)..(978): n is a, c, g, or t
  misc_feature (989)..(989): n is a, c, g, or t
  misc_feature (991)..(991): n is a, c, g, or t
  misc_feature (1009)..(1009): n is a, c, g, or t
gtgccttgggctcaggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccntacacgtccaggcgaagggaccgagcccccagancaacaggaactgggaaactttttccggagcctgtggggaccttatgctggctngggccaagcggtgctgttcagtgccgacctgcgccaatgccgccatgctcaggagccaccagcaaagcgcagaaagggttccaaagggccggaaggcnagatggggcancctgganaaagaaattcnccaagcaccttcccnnannntccccacatctctctccntttcccctccnantctcatgttggggagggncctccctttgactacctcaaaggccaggcacccccaaatcaagcagtcagttgccc

SEQ ID NO: 211746 - DNA, 660 bp, Homo sapiens
ttccttgcacaggtcataacaacacccaaaacatgtctctgaaatacattgccaaagaaagagcttcaaatagagtcactgtgcctaactcccatctctgggcattttactcttcatcgaggggagtggtaccaatgttttgctgttgttgtaatggctgctgctgtttctttagttcttattcttctcagtttatttactgtctatagtttttacaaaaaacaaactcaaaataaatctgaggaaggcttattataaggttttaatgcagacagagatagactcaactgtaatacactaggcattttggcatataaatccttatatctgagcttaatcatatctatacttaaggtagtcctttgtcttcaatttaatttttccaaattggaagtctgcatatcatatctttattaaatctatgaatccttggctatctaatatgtatcagcaagttttctttaaattaagctggccttctctcaagaacctaaacctctataaatactgtaaaataaattttaatcagtcgtctgtgagaggggattctgaactaatttttgtactttcaaaccattatcagtaccattctactggaaacaaaataatttttcttttaattgaatcaatcgtgtttcagaaattaaataactgaaaact

SEQ ID NO: 211747 - DNA, 438 bp, Homo sapiens
ttccttgcacaggtcataacaacacccaaaacatgtctctgaaatacattgccaaagaaagagcttcaaatagagtcactgtgcctaactcccatctctgggcattttactcttcatcgaggggagtggtaccaatgttttgctgttgttgtaatggctgctgctgtttctttagttcttattcttctcagtttatttactgtctatagtttttacaaaaaacaaactcaaaataaatctgaggaaggcttattataaggttttaatgcagacagagatagactcaactgtaatacactaggcattttggcatataaatccttatatctgagcttaatcatatctatacttaaggtagtcctttgtcttcaatttaatttttccaaattggaagtctgcatatcatatctttattaaatctatgaatccttggctatc

SEQ ID NO: 211748 - DNA, 483 bp, Homo sapiens
agacatctcaaagaaatacactgggaattcccaaaggggagagtaagtttaggttgaaagtgaaagaggtgttcaggaggaaatgatggttgtagaaattgatttttgtatcatctccattctaaaaagaagctattttataacccagttgattgtatcacctacaactttatggcctatagaaagaactgctcttacgtaaagtacatgaattgagagctgtcctcccgaagccagtttccctgactataaaatctgaaatagtccatctactgcgtggcattttaatcccctcagtcctccattattctcagaattttccgcttataggataaatacattactcaaaggttttgtgttaatttttatacctgtttttacttatagcctgtttctttttttctttaccaaaaagcatcgtcttctgattttgagagttttaattcttaagtatcagttgatgaattaataaaatgtaaatgt

SEQ ID NO: 211749 - DNA, 464 bp, Homo sapiens
tcctctctggctagggctggtttaaatgatccttctttgggtggatgtcaaatggttttggtatagttttgctttccattaaaacagggcaacactgagttcaatgcctcacaattactgtgctctccctctcctcagaacacagaagcattctctataccacacctccacttgtggggcaaagagtagtggtaatgtcagtgattcaagactatctttcttctttattcagtgcctttcagtgatatgaagtcaaaaccaggtactgtgagtattcgcctgatttttggttcttatgaaggtgcttttgtgtgtgtgtagatagttgttaaattggtgtcctggcaggggagatgattagtgaagcctctatttcaccatcttgttccaccccctccctatttaacctttaacttggattttttaaaggccaaatatttaattatttaatattaataagttgt

SEQ ID NO: 211750 - DNA, 327 bp, Homo sapiens
cgcagaggggaactgctaagaaacaggattaaaggggtgactttcctctaaacctcttgtggtacaccttttgtaatttgtgtgcataaattcaaaacaattttaaatcttttttagtctgactcaattttactgtttcctgaataaactgttttgtttttttcaaatccttaaactcttaatccattttttttctgaaactgagttaggctaaagaccaatcatcccaagcacaggaaacaagttccaacaatttaattttttaaacacgcctaatcctacgaaccagatagcactaacaaagacagaatacttttcatagttttt

SEQ ID NO: 211751 - DNA, 868 bp, Homo sapiens
gcatcagatgtttcacacagataaactatctcacttaaacttcccaagtccatgagttaataacattaacaccatttaatagatgagaaaactgaggttcagagagatttagtaacttgtccagggtcacacagcaattgattagtggttgctctggaaagtgagtcctgcagtgggaatctggacctaagctcttatccctttgccacatggcccagacacttcacaagcatcattaaccgggtgttgccttgactcctaagccataaacaatgggaatgcagaggaagattctgcatttgccacgctgtgtaaggtccccacgtgtttactagtcataacttggggtagaaaaatgcttttaactttttttaaacttgaattacgaagcactttgagctcctgggatggaggacctccctgttctggccctcctcccctctggtcttggatgaactggcgcaaaccaggcttcttttcagaccagggccagtctggctattctaataatagcacgttgtctgggaagagcagaaactactaagaaaatcctcatctatccatcagatcatctgtttatggaaacaaaaagacagaggagactcagaggtgaaggatgctcagctgcattgaatcacatcttgctggtttggaactcctaggtgtccctggcaggacagaaaactcagatgaggcagagcccacacctcactcaacaaatattaaccccacagttacaaccaactttaaaaacattttatgtgcatgtcaggaagaaggcaaacaatagttattgtggtagggtgctaggatggagtaattttattttatttaggaaagtctaacggggaaccgagctcgaaatcga

SEQ ID NO: 211752 - DNA, 267 bp, Homo sapiens
tagcacagtgactgcacagagtaactctcggggattgtgtcttggctctctagccgcagttccgtgtctgggacacacaagtgccatgctgggatccctcttcgcgttcgttctggggaatccttcacttttctcccatgtgctgtgtctcatgtggtcctctttccggggtcactcttccatgctggaagagcttatcctgacaaagagtgtgtgggagataaattttgagatattgcagaaaacatctttattctccattctcat

SEQ ID NO: 211753 - DNA, 430 bp, Homo sapiens
attatattgcttatttcagtttttgtttaggaatgactgcaaattttctcatgccagtttgatattaacacttttttctgtaaatatttgtgcataataatgaattgtgtcagtaaattcctaatgtcgaactaatcttgcacccttgaaataaccctgatgatagtcttctaatacactactgtattctcctagctagtattttatttatttagaattttttcctccattcataatgaaaaatatattattttctctctttgtactcttgtcatcaagatttggatgttaaaggttctggtagcctcagattggaatgctgatgactagagtattgataattgtcgacgatgagtacatggggttttatgatactgttctctgtatggctgtatatgtttggaaataaagtttttttttaagtgaatta

SEQ ID NO: 211754 - DNA, 152 bp, Homo sapiens
aatgaaatcgcaggtttaaatcacctaccacaaggtctaacatgtcagagggttttatacacaggagtttccttcccgaggagaagcttggaagggccagactccaaggggcaggagacagtagaggactcagagaatcctaagttgcatca

SEQ ID NO: 211755 - DNA, 185 bp, Homo sapiens
cttttttgggacaatttggtaatgtgatcaagctttaaacacgataaatccatccaattgtatatatctattttcaggaagccctggcacagatatgcaaagacttgtcccaaggacggtcaccactgagtcacaagagcaagaaatgtaacatgacccacacccccatctgtccctaccacagg

SEQ ID NO: 211756 - DNA, 653 bp, Homo sapiens
atgggaggaattcaacaaactgaaataaaagtaggagaaggaaaagagaaaagaaggactcttaacagttcctttactacagagctgggtttggtaagcacttcagaatgcctattaaagcctaatgcgtttgacctgaaagccagcagcaactcaacttaacagacaatgtacttgatcaaacaaatcacaaggaagatgacaaatacaagttgctggacaaacctgttttctaaaagaacagatgctgaagcaatgatcctaggtgccaagaaaggaattcacaggaccatgctttgccaacaaataagttatcggatcagaagtaattgtcactggttcatcggtgtcaaaagtcaactccaaattgcaaagctggaaaacatctttgcaacatgtatgacagacgcctaatagcctatataaagagaacttacagatggaaaatcctcaaaataaaggcaatacccgtaaaaagaaatataaaaggctgatcaatagatgccatgatgttcagcttattggcgaagctgccccatttcacagcttcggggggggtgtctatttggaaacagacactccaaatagagaactgtgaaactggcagcctgcctgaccatattcagtgcccctgcttagtaaacaacaacaat

SEQ ID NO: 211757 - DNA, 369 bp, Homo sapiens
tagaacaagatagaaagagagtctgagtcttaatgacattactgaatccctaaattcaacattgctgaagccaaatgttccctgaaactcccagttacttctccagtaaaatctttgtcttttatttttcataagtaaatttgaattgggcatttttcttttgcaaacacaagtgtcctgatgaaatactaattttcccacccttcccaacctccctcatccttggacttccaggacaatgtaatgagcaccaaggatctgaactctagctcttgttgggagcttaagctcccaacaggaggagctgcagccccccagagagagctcttcacgttaccaagtaaccagcccccagccttcaggccccaa

SEQ ID NO: 211758 - DNA, 507 bp, Homo sapiens
cttgaggtgacagaagcaaaggacagttctgcgagaagggtatatggttattgggctgactgaaaggatgacataaacaggagctgccatagactcatctggtttgaaattaagtctgaatcatttttacttaaagaacattatgcatggtaagccatatattctgtttccattggattttggtcagatttagtctctatgctataaaaatatatgattattatggtgctctgggaaaaaaaaatcctatcatgttccaaacaaaacaaatgaatgcattgccatgtaaaatttttatgatgattttaaattttaggaatacttaactataacaaaggataaatgtttgaggggatggataccccattttctatgacatgattattatgcattgcatgtctgtatcaaaacatctcatgtaccacataaatatatgtacctactatgtactgacaaaaattaaaaattaaaaaaagatctgtgaaagtccaatactacaatgttaaa

SEQ ID NO: 211759 - DNA, 387 bp, Homo sapiens
aatgtttgaggggatggataccccattttctatgacatgattattatgcattgcatgtctgtatcaaaacatctcatgtaccacataaatatatgtacctactatgtactgacatgcaatgcataataatcatgttccaaacaaaacaaatgaatgcattgccatgtaaaatttttatgatgattttaaattttaggaatacttaactataacaaaggataaatgtttgaggggatggataccccattttctatgacatgattattatgcattgcatgtctgtatcaaaacatctcatgtaccacataaatatatgtacctactatgtactgacaaaaattaaaaattaaaaaaagatctgtgaaagtccaatactacaatgttaaa

SEQ ID NO: 211760 - DNA, 317 bp, Homo sapiens
tagacagagtctcgctctgtcggcccaggctggagtgcagtggatgatcccggctcactgatggctagctctgataagtaaaatagtaatcattaagaaacaaattacaggctcctatcttctcagcctgcctctagttcacttgctcctctgtttcccatccaggggccattttgtttctttcatcctttttttttttttaattttactttaagtcctgggatacatgtgcagaaggtgcatatttgttatgtaggtatacatgtgccatggtggtttactgcacctatcaacccgtcatctaggttttaagccct

SEQ ID NO: 211761 - DNA, 159 bp, Homo sapiens
accatgcccagccaataagtatattccttcgtttatattaagtgttacatttagagaaattacctagttccctaattcctattttctgctcctccagctgagttacctcggagaggcaacttaacctagatttgctcactcataaaatggtaatactgc

SEQ ID NO: 211762 - DNA, 452 bp, Homo sapiens
agtgctggaagtgaggcctaatgggcagggtttgggtcgtgggatggatcacgcatgaatagatcactcccctcccttgggagcggaggggtcgtgagttctcactctgttagttcttatgagagctgattgttaaaaagagcctggcaccttcccccaccttcttgcttcctttcacaccatgtgacctctgcacatgcctcctctgctttgccttctaccatgaatggaagcagcctgaagccctcaccagaagcagatgctggtgccatgtttcttgtacaacctgcatgcagaactgcgaaccaaacagacctcttctttataaattttcagcctcaggtattcctttatagcaaggatgcccaatcttttggcttccctgggccacattggaagaagaagaattgtcttgggccacacataaaatatactaacaatagctgatgagc

SEQ ID NO: 211763 - DNA, 509 bp, Homo sapiens
atgtatgaaggtttcaatttctccatactctcttcaacacttattgtctgtttttttattataaacatcctagtgggtgtgaagtggcatctcatcatggtttagatagcatgactcctgaacagctggtttgactgccaagtttattaattagctagaaatgagaaacacagggcccagcatcatgatactccaattttgaaaatataacatgtaataggctgggcacaatggcttacacctgtaatcccagcaatttgggaggccaaggtgggagaatcacttgagccctagagcctgagaccagcctgggcaacatagcaagacctcctctctactaaaacttttaaaattaactagatgtggtgacatgcactgtagtcccacctacttgggaggctaaaggtggaggatcacttgagaccaggaattcaaagctgcagtgagttgtgatcccaccactgaactccagcccgggcaacagagtgatgctctgtctccaaaaaaaa

SEQ ID NO: 211764 - DNA, 599 bp, Homo sapiens
acacgcacacacacacacctgactaggttaactacccatagactctcacagcacaaggcagcttacaaaattgtttagagtttgaagcctgtctctctcaccagatgataaaacagggactttacaacaatatctggtacatagtagctgttcaaagatgttttatgggtgagttaacacagagcaacaattctttgcatcctcaaggttgccaactactttaaaggagtctatcttggaagctctatacttatgtctgtagtttttgggatgccttttggaattgacttcagagaccacttgccattcacaaaagaaaatttgtcttccttcttcactgctacacctggatttttgattcaagatggtttcactccaatcaaagtgttcacacatttaatttgcaagacattgctctaagtgacatttgtttgtttccaaaaaaatcctaaccagctccaaaggctagataactaacaagagattagcaaaagaaggtactgtggagatgagagctattattgaacacttacagtgtgccaggcattgatgaacaccttacaatcattatttcacttagtcctcacaacaaacccatg

SEQ ID NO: 211765 - DNA, 275 bp, Homo sapiens
tcataaaatgaaataagctggactgagttactatttattgtagatgattagaaatgaaaggacatagagtgtttaaggaggaagatgctatttgatttttctaaactagtgcaaaagaaaattaggaaatcagactaggaccgaggcaggaggggaacaaattgtgaagggttttgtatgtagccatataggagtttggatttttatttagttttatagatgggaagtaacacaaacacttttgtgttttagaaaattgatcatagcagtcataa

SEQ ID NO: 211766 - DNA, 425 bp, Homo sapiens
accccagtccctgcatttttcattcctagtgtttgaccaggatggtgggaagaggttatggtaaccaaagaggctacctgatatgtatgtctcgttatcattactaatcctttattgcgctagatgttttagaagtattttctagacccggtgcagtggctcacacctgtaatcccagcactttgggaggctgaggcgggcggatcacgaggtcaagagatgaagaccatcctggccaacatggtgaaaccccatctctactaaaaatacaaaaattagctgggcatggtggtgcgtgcctgtaatcccacctactcaggaggctaaggcaggagaattatgtgaaccgaggaggcagaggttgcggtgagctgagatcacaccactgcactccagcctggtgacagagcaaccctccatcttaa

SEQ ID NO: 211767 - DNA, 408 bp, Homo sapiens
ggttcttaatgtccacatttgttgttccagaccttcacttgacattaacccacaatcccatctgcctctaaatctcattattcattaggccgcatctcctaaatgtgtttaatggttgatattaaggtttctctgaaacctcaagtttaagattacaatgagggtgaaacaaggataaatacaaatgtaacatttaaaatcaactacctgtcaatgtcccactttaaggaagagctggtaactgggtgcaagaagatatagtaacaggttaagttcattaaaggtaactggaaaagcatgtatattaatatatctaactatatcacctaactgttacatgtagataaagctaacctaattggacagcaatgtaatgagtcttgaagaaagaacagtataaatgaagac

SEQ ID NO: 211768 - DNA, 958 bp, Homo sapiens
cggccgcctcctcccctttaaggcggggctcgcaagggcggtgggggggcccgaggaagtccgggggccctcggtgatgcccccgcccccgccgcgtcagggttgctccctgcgcttccgagtggcgactgcagcgggtccggtgcaggtgaggggcgcgcgcctgcccagctttgcagcccccgaacgcggcctcgcacaggtgagggcggtgccgggttcacctggcagcgcgcgtgggccgggcagcacggtcgccgcctgggggtgggcgtcttctctcaaccgaagctgggagttggggagctggagggtccaggatgagaattcagtggcgctactaccccggagctgcttgtggttcagagatcagaaaggtgtcctgaggactggaggcagaaatccaggcgtggcgtactggaaggcgcactaggggagggcagcctggcccagaatttctttgcattttaaaggccacacattcagtctccccggggcgctacggaggtagtcaccgccacatccaggactccttccacagaggagtcattgcagattttcagtagagtgtgtacgttctgagaagtgggctctcttgggtcttcatgcagccatggacatctggataaaccatctgtaatggggctcattaggacagcggagcaggccattgttgatcaacttaaagcaagaagaaggtgaacaaagaacccaagtaagcccccagatctacgggcaaggcatcactatggaccggcgttcatcagaccgtactctggtgcctgatctcctggaggctgaggccttggacccaagagggccaggcctataactcccggagccacagggactaacatacagccacaggtgaccccaagacagggctgacacactagcagggagtcgagcaccaagaagcagcgagaaaggaccaaggaaacaggcgagaagaagaaag

SEQ ID NO: 211769 - DNA, 571 bp, Homo sapiens
cggccgcctcctcccctttaaggcggggctcgcaagggcggtgggggggcccgaggaagtccgggggccctcggtgatgcccccgcccccgccgcgtcagggttgctccctgcgcttccgagtggcgactgcagcgggtccggtgcaggtgaggggcgcgcgcctgcccagctttgcagcccccgaacgcggcctcgcacaggtgagggcggtgccgggttcacctggcagcgcgcgtgggccgggcagcacggtcgccgcctgggggtgggcgtcttctctcaaccgaagctgggagttggggagctggagggtccaggatgagaattcagtggcgctactaccccggagctgcttgtggttcagagatcagaaaggtgtcctgaggactggaggcagaaatccaggcgtggcgtactggaaggcgcactaggggagggcagcctggcccagaatttctttgcattttaaaggccacacattcagtctccccggggcgctacggaggtagtcaccgccacatccaggactccttccacagaggtcagttcctcagctgggtgggctttaa

SEQ ID NO: 211770 - DNA, 306 bp, Homo sapiens
tgacgttatcagcctctgcacctctgtcctcccttctgccacatgttgcctactctccatgactttggtaagagcttccttgtgtatgtggatgatgtccaggatgttggtctggtgtccctgagacagcactaacaggtccatgactgagtccacttcctggctgggttcattggcaaagagctcacagacggtgttgaaggcatctctggtgaagtgatggcctgttccagatccaagacctggctaaggcggaagaagaactggctgccttctgctgctctttcttaaagcctctgaccatca

SEQ ID NO: 211771 - DNA, 891 bp, Homo sapiens
atttctagcaagactctgtcacagtttcttatcttcagtcagcagcaattacagtggctgacctaaaagcacagatgtttcttagaatacaagattaagttggatcctgaaatgcctacgtggcaatctgaccttgcctgtgatttcattttaatgaatgcattccaccagaaatattagagagatcagatctgaggaaatggcatttgagcaaaaactgatgggtgctgtttttctgtgcaccagataactttaagtcatagaaattgttgcatttggaagtttttaaaaaatttccttgaaaagaatctgaatatatctccaaggtgatttctcttttctgaatacctatgagccctgtctgtatcactgagttactataacttttaacatttttgtttcatcatttatatttcaaattatctttacacatatatgccttgtcttcctgactagactgtgggctccttcatgctgccataactagataggtaggtaggtaggtagatagaagatatgaaatatttttcattacataacagatttagtttaataatttagtcagctctgttagcgtgtcatgtgtgtatgttatatgtatggaggaaacatgtacaacatggatatttcctctggaaacatggatacaattattacaattagccttgttaactcgtatttaatgtgtttgcttattcataacactgaaagctgagtcttttattaaaaggtagtataatttaaaaaatacttattgtaatttctctattgtagactgcaaattctgcttgatgaaattataattgcactctaaaaggcttgaataaaatataattttattttcctttaaatgtgtgtttttgttaatgttctaaaatatagtaggttaaa

SEQ ID NO: 211772 - DNA, 422 bp, Homo sapiens
taaggaaaaaaataggggaacgtggcagagaatggctgaggggtagggtagaatgcattcaataggatggtcaggaaagacctatttgaagaggtgactctgagctgaggaaggaaggatgagaagatgttcatggagcaagctgaggtcatcacattccagagaggaagccacaagaacaaagacctcgagatggaatgaactctgttcaagtaatctaagaacagaaagaaagccagtgttgctggaatgtagtgagagatgggtaatgtggtagaagatgagaggaaggcgtgcagaaggtgctcaataaatggtttgttgtggtaacatagcatgtgaagtgctttacagatttcccctctaggaatatgtacattgtgtgcattttcatcttttccccctttgggtgtctttattgt

SEQ ID NO: 211773 - DNA, 463 bp, Homo sapiens
ttgattagtctaaccttcatggagaataattgttttttcaaaaaaggtatttaattgaagagcatttacagtaaaatcaattgcagtttgaaacttccttgaacaattacttgtgaattcaagagattgctataatgaaggttgatatagtttggatatttgcccctgccccaatctcattgaattgtaatccccatttttggagttggggcctggtgggaggtgtttggatcatgggggcagacctctcatggctttggtctatctttgtgatactgacttcttaggagatctggtcatttaaaagtgtgtagcacctcctccccacctctcgctcccccttcaccttttgacatgattgtaagcttcctgagtcctccctagaagctgagcagatgccagtaccatgctttttgtaacgcctgcagaactgtgagccaattaaacctcttttctttataaa

SEQ ID NO: 211774 - DNA, 454 bp, Homo sapiens
gttacccatattggctggacgatcttaaaatagctgtgggtttgtatagtttatatgtcagagggacttatttatttttatcccaaggcatatcctgttggggagattgaagagtatataaaataatgttcccatattctccagttatttttggtgttgacgtaaaaactagagaacatggtttttagagattttagaataatttgttgaatgtaaatatttttttacatgacagcataatctaacttgctgcctcttttttgtttttaaacacatttctttcattttggaaaaaattactttacttcaggcactttaaagttttttttgttgtgttgttaaactaataaaacaaatagctaagtccccttagtgttctccttactattatatttcactgcatgtgtatctatacattttaacttactgctggattgttcaaaattgtgaacag

SEQ ID NO: 211775 - DNA, 626 bp, Homo sapiens
gaattgtgtaagctatggagaatacaggggaaagagtctacaatcttcttgggaaaatggcacatttcatgtagtgctattgttttaagttatatttgaaaggaatttgcaggtgtgctgtgtaagggaaatattatgcacagcatgtttggagatagagttcagtgtggcttagagcaaagtaagtgggactgtgagtggtaggtgtgactggatttcatagtaggcttgtaatcatagaaacctttgtatatgttacacactttttttcacccacccatctccttcctagatggatttaatcactccccactttccactacacccagggctctcctggcccacagcaatgtaggaaagtggaaaatgatttagcagattgaagaagacagagtttgtcagcatgctatacataggtgtacttgaagagttggtgaatacatagagacaaagggctgactatattgtgtgtgtttcaatcaggctgggtatgatctgctcatttggttttcacctcctcctggacatgtctgggattctgaagcagtgacccattcttcctactcataagaagcaagtgttttagaatatgagtgctattattattcaagtatggtagagctaat

SEQ ID NO: 211776 - DNA, 516 bp, Homo sapiens
tggcagatgttatttgtaactttgttttaaaatagcataatatttctgcttaaaaaatttcaaaaatgtcaacaatgatttttcttgaaagtgttaatattccttcttgacagtatccaaagctatactttggtgatttccatggtacctcaatactgaatttgattactctttgattaggcaactaaattttttgtcttacttgcttttttcacccctaagtcatccataaagacgtgattttcatggttgtgttaggtaaacataagttgtactacatatgtgtaattacaaagcaattgtaatggcaaatctagggtcttgtgacatctgttagtagggatcttcttatcatatccctcagtgatcatttgacaaaaataataccatgaagggatttcaaaggaagcttgagaagtgtagtttaacaagcacacaaatgatgcatttcaccctacattgatgtcgttaggaccattcaccatagatgtgtccccggtcctccctgaagtatta

SEQ ID NO: 211777 - DNA, 1023 bp, Homo sapiens
  misc_feature (820)..(820): n is a, c, g, or t
  misc_feature (841)..(841): n is a, c, g, or t
  misc_feature (1015)..(1015): n is a, c, g, or t
gctctgccctccgcctcctcttctccgcccactctcgccgcggtctcttggcggcggaggctttgtctcgtgggctggtccccagcggctccctccccgaacagctgctgctccagggaggaagcggcgcgggtgctgtccagcttcccggtgctgaaaaccggagggctcgtcatccaccactaccatgtaagggccatgagaagggctcatcctggcgcagcgcggacatggaggaggacttattccagctaaggcagctgccggttgtgaaattccgtcgcacaggcgagagtgcaaggtcagaggacgacacggcttcaggagagcatgaagtccagattgaaggggtccacgtgggcctagaggctgtggagctggatgatggggcagctgtgcccaaggagtttgccaatcccaccgatgatactttcatggtggaagatgcagtggaagccattggctttggaaaatttcagtggaagctgtctgttctcactggcttggcttggatggctgatgccatggagatgatgatcctcagcatcctggcaccacagctgcattgcgagtggaggctcccaagctggcaggtggcattgctgacctcggtggtctttgtaggcatgatgtccagctccacgctctggggaaatatctcagaccagtacggcaggaaaacagggctgaagatcagcgtgctgtggactctgtactatggcatccttagtgcatttgcgcccgtgtatagctggatcctggtgctccggggcctggtgggcttcgggatcggaggagttccccagtcggtgacgctgtntgccgagttccttcccatganagccagagctaaatgtattttgctgattgaggtattctgggccatcgggacagtgttcgaggtcgtcctggctgtgttcgtgatgcccagcctgggctggcgttggctgctcatctctcagctgtccgctcccctctttgccgtgctgtgtttctggctgctgaaatgcaaggnatgatgtg

SEQ ID NO: 211778 - DNA, 391 bp, Homo sapiens
tctgagacaggatctcgctctgttgcccaggctggagtgcagtggcatgatctcagctcactgcgacctctgcctcctgagtagcaagcgtgccaccatgcctggctaatttttttgtgtttttagtagagatggggtcttgccatgttgcccaggccggtctcaaattcctgagctcaagggatcctccggttgcggcctcccacagtgctgggtttacaggcatgagccgtcacgcccggctataagtgttaattgcattcttagtaacagcaaaacaatggaagcagcccaatccccaaggagaggagagtgaggaattgcatcatggtaaaattccactcaatggaagattatagagccatgagaactaagaggctacagctacaca

SEQ ID NO: 211779 - DNA, 121 bp, Homo sapiens
cactgagttcctgttaggttatagtctgtcccaaaccaaaatcctggaggtgggtgcaagagcagggactgggacatgcttgagctacaggcaacaacgagcctctctgatgtcttctcct

SEQ ID NO: 211780 - DNA, 699 bp, Homo sapiens
ctcagcagttcaagtatgtcaggtagacccaaattctctgtaactctctgtatgaaactttcagagttggctatatacttagctggtaataagatgtctgaagaagttctaagtgtcacatccagatgcaatactgtccgtaggtagagagaaacatgtatttattattttctcttagaagacaagaacttttttaaataagcaattcagctgaattgctttcattttgaatggattagaattggctcacatgcatatacttgtaccaatcaatggcagggaagattaatttactggaccaaccgtgcccactcatgagacttggtgttggttcactttatcatgaagtgcatagttatatgcatggtgcatgggggtggacacctgaataaaactgggattctataactaaagaaagcaggaatggataatgattaggaaaacatctgtgtccactacacaatgctaacaatatatggctatgtttataattggcaatgatggcataatcagaatagtaataagatcagacaaaataaaactaatttgaatctaaatagaattaccaaatattctaggcatttttacccaagtcttctctagccatttaaacctttgtaagaatcagcttaaaaataatggaacagatttgcataagtaataccaatctgaaagctttcaatgagttaatatttaggc

SEQ ID NO: 211781 - DNA, 553 bp, Homo sapiens
atcctaggtggacaaaaggggcaagatgcaaggtattttttttaaagtaagccaagtattgaagaactagctgccaataggggcaaaaagtcacatggtactttactgagtttccttggaagcttttaatattgtaaatctgcttaagatatgttatctacttaagcaacatgtaggagagaatataggtgtctttactgaaattgctttgttccttaatgcatgcttttgacatgaaatgtaattcgggcaaattaagtctgaaaatagttactgagaattggttttgtttacttattctcagactcctaccacaaagagcttgaggcaaacttataattgaaggtacaggactgtgcaaaagaaatcagactaacttttaaaaagaatatttcaatgaaccaggtataaaaatcacatcaccaaaactggagaatactgaaaatgtttacaacaaaaagcaagaatgtattttctaagtcataaataattttttaaatctgggaactatcctgaaaaaacataatgagtttttaaattcatagtttatcat

SEQ ID NO: 211782 - DNA, 537 bp, Homo sapiens
tttctttgttgactctccatcttgatgacctatctagtgatgtcagtggagtatcgaagtcccccactgttattgtgttgtgtctatgtcatttcttaggtctagtagtaattattttataaatctgggagctccagtgttaggtacatatatatttaggactgtgaaattttcctgttgggcaaatcgttttatcattatataatgtccctttttgtctgttttttgtttgtttgtttgtttgtttgttttgagatagagtcttgctctgtcacccaggctggagtgcaatggcatgatctcggctcactgcaaactctgcctcctgggttcaagtgcttcttctgcctcagcctccggagtggctggtattacaggtgcatgccaccataccagctaatttttgtatttttgcagagacagggtttcaccatgttggccaggctggtcttgaactcctgacctcaggtgatcctcctgcctcagcctcccaacgtgctaggattacaggcatgagccactgtgtccagctccttt

SEQ ID NO: 211783 - DNA, 986 bp, Homo sapiens
tgaggctgcaggtgttaatctggggggccctgggccctgagccggcagcagaaatatgaggacccagagccttctcctcctgggggccctcctggctgtggggagtcagctgcctgctgtctttggcaggaagaagggagagaaatcggggggctgcccgccagatgatgggccctgcctcctatcggtgcctgaccagtgcgtggaagacagccagtgtcccttgaccaggaagtgctgctacagagcttgcttccgccagtgtgtccccagggtctctgtgaagctgggcagctgcccagaggaccaactgcgctgcctcagccccatgaaccacctgtgtcacaaggactcagactgctcgggcaaaaagcgatgctgccacagcgcctgcgggcgggattgccgggatcctgccagaggctaattctgatttaggatctgtggctctgcacctaagctggggaccaacggaaagagttcacgatgggaggcctggggccctgcccgctggacagcactatctctaccagcggtggttccagccttctgataatcactggcctgctgacacttccctgcaacccatccacccctggtttctcctcctgggagtcaaagtccatagcctgagctcggaggaaggcctctgtatcaccccagtactctgcaccactgccatacgagcttcccacccttcctaacgctttcacaccaatccgtacatgctgcttcctccaccaaaaatgcccaattcaggcagaccctgacctctccctcaggcagcccaaccatccagaatgaatattcttgcagagttttccaaacatcagtcattcacctctttcatgattttcaccatacctacaaaatagcaccatgataggttgcacgctgcctgtaccaccatttacttaatgttttctttaaatggctcacttttgtatataaataaattcatttcaaaagaaaattgatatcactac

SEQ ID NO: 211784 - DNA, 411 bp, Homo sapiens
tcataaacttctggtgaagattaagttaatatatgtgaagcactttaacagtgctgagagcattgtaagcattatataaacaatctatcatttttatgattaaaatcacttaaaattttgaaaaggaaaatttttcacagcataattttaagtgaaaaatagaaaatgtatattttcagtatgatcagatttctaaatatgtgtatgacacaagcacacatatgtaagtttaaagaaagtaggaggaaggtgtttgccctgtttcccaaagtgggaactatatctgttttaaaaacaactgtcaaaagtaaatgaaataggttatataagttgaggaatctgttttgctttgaaaattgtgtaaaattgccaagtttctaataaaccaataaatataacatcagttcttcc

SEQ ID NO: 211785 - DNA, 277 bp, Homo sapiens
gtgtgcctgcagctttctcaataatgccgttcatctccattaagggtgggaggatgaagacccgccactggcctgggtgtccctgctgaaaaatgtccaattcactcagccccagcatcaccccagggtgttcacacctgctgctggccactccagtactcatctgctcctgctggttttccacacccttttccaaagcccactaaacacgaaactttcaggacattgtagaaaaggaggaggaggtggtgcagagggcacgtgtgtgctctttact

SEQ ID NO: 211786 - DNA, 565 bp, Homo sapiens
tctctaagccagaagtagtgattatccatgatgctgtgagaccatttgttgaggaaggtgtccttcttaaagttgtcacagctgctaaggaacacgggtgtagtgactatgacttggaatttggaactgagtgtttgcaattggccctaaaatactgttgcactaaagccaaacttgtagaaggatcacctgacctctggaaggtgacctacaaacgagatctctatgcggctgaatcgattattaaggagagaatttcccaagagatttgtgtagttatggatacagaagaagataacaaacatgtaggtcatcttcttgaagaagtgctgaaaagtgaattaaatcatgtaaaagtcacatctgaggctctgggtcatgctggcagacatcttcagcaaatcatcttagatcaatgctacaattttgtttgtgtgaatgttacaacctctgattttcaagaaacccagaagttactgagcatgcttgaagagagtagtctttgcattttatatcctgttgttgttgtttcagtaagtgaaattaatgcagatttttctcaaac

SEQ ID NO: 211787 - DNA, 932 bp, Homo sapiens
tctctaagccagaagtagtgattatccatgatgctgtgagaccatttgttgaggaaggtgtccttcttaaagttgtcacagctgctaaggaacacgggtgtagtgactatgacttggaatttggaactgagtgtttgcaattggccctaaaatactgttgcactaaagccaaacttgtagaaggatcacctgacctctggaaggtgacctacaaacgagatctctatgcggctgaatcgattattaaggagagaatttcccaagagatttgtgtagttatggatacagaagaagataacaaacatgtaggtcatcttcttgaagaagtgctgaaaagtgaattaaatcatgtaaaagtcacatctgaggctctgggtcatgctggcagacatcttcagcaaatcatcttagatcaatgctacaattttgtttgtgtgaatgttacaacctctgattttcaagaaacccagaagttactgagcatgcttgaagagagtagtctttgcattttatatcctgttgttgttgtttcagttcattttcttgattttaaattagtacctcccagtcagaaaatggaaaacctaatgcagattagagaatttgcaaaggaagtaaaagaaagaaatattttgttatatgggcttctcatatcttacccacaggatgatcagaagctacaggagagtttaaggcaaggtgctatcattattgcttcattaatcaaggaaagaaattctggactcattggtcagcttctgatagcatgaagaacacaaaaaattacctattttctaaaacatctatttgcgtatcttaattgtgctttgtgcccccgctgctgtgtgtggtagaatgtttcagttgtcttttatatcttctctataatttgtaggatgtgatgcttagattataaagcagattaatgttta

SEQ ID NO: 211788 - DNA, 210 bp, Homo sapiens
agcctgggagggtgaggctgcagtgagccatcatcgtgtcattgcactccagcccaggtaacagagtgagaccctgcatctttaaaggaaaatttaaaaagagataaatgcaggagatcttccatcttatcaaaagggtgctgttataatttatatatttttaagtactggatggggaggtggagtagcagctccaaggtacttttcagt

SEQ ID NO: 211789 - DNA, 259 bp, Homo sapiens
ggcagcacacgccacccgttcctcctgttgtgacaaccaaaaatgtctccggacattgccaggtgcccccagggggtgggggtggggttgggagtgggggccagaattcccccatttgagactcaatgaaatatttcagctgggcgtagtggccgatgcctgtaatcccaacacttcgggaggctgaggtgggagggtcacttgagcccaggaatacaagaccagcctggacagcatggtgtgaaacccatctctttaa

SEQ ID NO: 211790 - DNA, 526 bp, Homo sapiens
aaggttttatttatcccttctcttttagctttctgtctaaggcctcagaatgtagtctattttagaaaatctccaaggcaggaaatttttcataacctttcccctgttagtcattttttttaacttcaacaaaagcctgcatcagaagcttcttgctcgcttatatgaccctaacgctcactgctgcagtccaagcctggcttcctttgcactttcttttgctgttcatattcttcacagtgggacctgtcttagctgaagcccattattaggtcactccttggcctcttctctaaggctaaataatgagttatttttttttctccttttttggtacatcatattttttcaaccatttaatgatttttgttgttgaaaatttggggatttcctgtgtctggaaatgcattaggcctcaaactttgtacccctaagacttttcctgctaccttttaaaagacaccaagtaaaattaagactaggagaagacagctgctgcaatttttaaaaaatcacaaaagcaaaa

SEQ ID NO: 211791 - DNA, 570 bp, Homo sapiens
tctctcagcacagttgtgaccactctgttggattctttggggaggatcacagaaaaacaagacgtgacttttctgctctcacgaggtttgcctctggcctgaatgcctcctccagatataggcaatccaggtgtgtgctggcatgtccactcggatgacctgttgtgtttcacattcgacatactaaacctcattcatctaaaccatggcatgtggagcttggaggaaacttagctttacctcctagggtttgctgatggaatattgttgccggactcatttcttcttgccctgaggatcctttcccgttccactcctgccattatacaatcatcaattcacacagcccctcactgtgatcctcccaacagatcatgattgcactttggattcctatagtactatgtttgtacttcattccttaacttagtgtaaccaatgtttaaattaaatatttaaatgtatttaacccatacttacttccccatcactttgcgaatgtcttgtggaaaaagagtatcttactaatcttgtgtgcctttcatgtttctttgcacatagtgtactata

SEQ ID NO: 211792 - DNA, 303 bp, Homo sapiens
aaatgtttatgggacaaccaggtagatgtttttaacagtggctgaaaatgtgtcatggaactcagaagggacaggaatgggaacagacctttaggcaccacccacagaggtgatggctgaagcctggaatgggacaaggccacccaggaagagaggggtacagagcgccaagtgccacttttctctcagttcaccaacatttaaggaggaaagggatgatctgacgcctggacccacagtcatctatcaacacaacctgaaaaaaacaccaaaggaagcaaaggaagtaagactagagctgca

SEQ ID NO: 211793 - DNA, 578 bp, Homo sapiens
tgacaatcgtgacaacccgaatgtaccgttatctagtttcagtggctatcttcatcatttgattgacatttgttatgcatgtctatataaaattagttcatttttcctgtatgtatcccacatatttcccaaaagttcttgaggaaagtgaccaaatctttatccatccttatgtttcactatgttgtcacgagtattcgaaggctgacattcgacaaaagaatgagacttattttgtatagccttagaaagcagaatctacctctctgaccttatcactaaggtaaacttgccatttcagctaacacttttattgtgctaaaatacacataacgtttatcattttaaccatttttaagtatatagctctgtgacattaagtatatttacatcgttttgcagctgtcaccatcatccatctccagaacttttcattgtcccagactgaaactctgtgcccattaaacactcacttctcattcctctctccttccactcccggcaactaccattctactttcgctctgtgaatttgactactgaagttacctagagtgtaagcagaaaaccaagcaggt

SEQ ID NO: 211794 - DNA, 320 bp, Homo sapiens
ggtaagtgtagtggtgatttgactcatgtctcacccaccactcaacagaagcccaggaggcacagcagcctgtggtctctgctcatgattgaaagagcccctgaaacagggccagaaggcccaaaatagccactcaacaaacatctgtcgaataaatggaagtcatatgcgtcattccaagtctttgctattcttcgaaaagtaatcatactgactccaggctacagtgagctatgatcacgccattgcactccagcctggatgacagagcaagaccttgtttcttaaaaagaaaataattatattgactacctaatatg

SEQ ID NO: 211795 - DNA, 467 bp, Homo sapiens
tacaagtttttgtatagacatatgtttctatttctcttagatatatacttagaagtggaatggctgggtcatatggtaactcttttgaggaactgccagattattatcgaaagtatccctttacattccccccagcgtaagagggttccagtttctccacattcttagcaacacctgttattacctttctttttattattgtcatcctcatgagtgtgaagtgggtattgtggttttgatttgaatttctctgatgactcatggtgttgagcattttttcctttgtttattggccgtttgtacatctttggagaaatgtctattcaaattctttgccccctttttaattgcttttttaaaagttgtaacctaattttcttcactgacaatgtaacttgaatgtttttattcccttaaacagcttcctaaacttagcattaaatggttgcttaatatttcattatatg

SEQ ID NO: 211796 - DNA, 617 bp, Homo sapiens
cagtgagccaaatcacgccactgcactccatcctgggcaatacagcaagactcagtctcaaaaaaaaaaagaaaaaaaattacagtttcacaactcccccacaatacaattacatacctaagtacatccatgatgaaaagacttctcatatttaaatactgtctgtttactttattcttttgcagagtaagctacttggtgaaaggaaagaaattgaactgtcaggtttcactgttataaatctctcttcagtccttacccactccaaataaaataatgtaaggggataccgtagtagcgtcatatgctcaatgtttcaaaggtactgtgcttaccaaccagtgcaacctagcacccaagtcctttctttcagtcatccatccaaagatttcagagccactcagtgctaagcacacagtgcaacagaagtgtctgtatactctatgtctctttcctttccctactatcattccttcacatttaagaaaaaaaaaaaaaacagggtcgggcacggtggctcacacctgtaatcccaacactttgggaggcgggcggatcacaagatcaggagatagagaccatcctggtcaacatggtgaaaccctgtctctactaaa

SEQ ID NO: 211797 - DNA, 145 bp, Homo sapiens
ttgattcttcccaagctttcagacagaactgtaaaacctagaagtctaagttggaagtaacttatggttaggattatccattgtcttgcaatctgatgcctttttgatgtggtatgtctttttcttttatttccttttataggat

SEQ ID NO: 211798 - DNA, 449 bp, Homo sapiens
cctaagtgataaacgaacatcccaacaaccaggccccactcaaacctcctcaatgccctgtagtagggctaaaaacccagagacgcccagggaaaaagtccccagaagtcactgaggtagcctgctggctgcttcccaaatccattctctcattcttccttgctaagagaagccccttggtcaggcaacttaaagactatatttcccagcctcccctgctgctggtgtggccatgtgactcagttctaccctagcagaactctaaatccaggtcaggccactttttaaggagaaatggaggtccaggtgattcttatggcagggaactaagggcagtcaagtcaggaacagcttgaaatctagttccagctttatccaaaattttatgattttaagccagtcacttaacttttcagagtctgtttcttcagttgtccacttcatgggtt

SEQ ID NO: 211799 - DNA, 147 bp, Homo sapiens
gtaaagtgttatttgaaagtggacttggattagctgtaaatgaatattgcaaactctaggaccagcactaaagtaaaacaaaaatacaactaatagctaagaaaagagacaaaatgaaattatttaaaatgctcagttggtggaaga

SEQ ID NO: 211800 - DNA, 246 bp, Homo sapiens
gctcaggggctagtttcttccttgccccttagtaaaacctcaggtaggtgggttcctgtagcttctccagacactcagaaaaattaaaaagtactccagtcatttttagtcataaaacagtctcataatagtcaaaactctgaactttaaggcaaatttttcttctttctctccttccccagcccaagccgattcaggctggaagctgaatatactcagaggttcattcaggagggtgtgctttca

SEQ ID NO: 211801 - DNA, 524 bp, Homo sapiens
cttcccctgaaactaactagtcaatatgtccattccatgttggagtttttcagaagagaaaggggacatgaaatcaagctggatatggtggccctagttcctccagactgaagaactctttgctgaggctggggaagggcctatgtaaggcaagtatttatttggatcccatccaacatgactcaaggagctgcaaaatgtcatcactcctgtctaaagaatcattgaatactattccacagaggcaggtaggacctttcatttaataggctgatactttcatagatcctttgaaatcataggcctttcccttgagccccgtcatctccacttctctgtaaaaagaagcctagcatgggggagatgaggaaagaggtgggcagagacacagtttaggagaaaattcagaagcctgctttctttcagggattatgaacatgggcagcagaatagacaggtagctcctcctaagcaacaggagtgaggtcgttgtttcttccatccaagccaaactccttggaggg

SEQ ID NO: 211802 - DNA, 205 bp, Homo sapiens
ggagagagaccgggtctagagacacagatctgaaagcaatcagtgtgttggtcacgtagaaccattcagactgcccaggaaaagcagaaaacagcagaactgtagagggctaaaggggacaccttggggacatccactttaagaggcaaggaaagggaaaagaagaaatggaggcaggagaaagtggcaatggtcacagagccag

SEQ ID NO: 211803 - DNA, 568 bp, Homo sapiens
agcccaagctaagccatcatatcccttgtgacctgcacgtatacatccagatagcccgaagcaactgaagatcctcaaaagaagtgaaaatagccttaactgatgacattccattgtgatttgtttctgccccaccctaactgatcagtgtactttgtaatctctcccacccttaacaaggttctttgtgattctccccaccctgcagaatgcactttgtgagatccaccccatgcccgcgaaacattgctcctaactgcaccgcctatcccaaaacctgtaagaactaatgataatccaccaccctttgctgactctcttttcggactcagcccgcctgcacccaggtgaaataaacagccatgttgctcacacaaagcctgtttggtggtctcttcacacggacacgtgagacacaaacatcacaaaaatctgtatacaatttgaggggattccgtgggttttcctgaagtccttcagctcacaagctccaacagaagaatctttctttaaaaagaaagatcctgggtgtggtggctctactaaaagtacaaaattagccaggcat

SEQ ID NO: 211804 - DNA, 185 bp, Homo sapiens
acaaagcccgtcctcagccttatttcagcccagatctcggtatttatgccacagatactgttgagctcctctgggtgcgtgctgaccctgaggtcacacagatgagccaggagtggccctggctttcaggaaacgtagtgacgtaaaaggtcccggctgctgcgggataagggccagggcagagg

SEQ ID NO: 211805 - DNA, 422 bp, Homo sapiens
cttataatttctgaatagtattccattgtatgaatgtaccataatttatttatgcactcacccattgaaggatatattagttgcttccaaatttttgcaatgatagataaagctggttaaacactggcatacaagtttttgtgtggacgtaagttttcagttcatttgggtagttaccaaggagtgcaactgttagattgtatggctcagctatgtttagttttgtaagactatgcttagtttttgcaacatttggcaaccctattctcaatgagttgcacctcttttgaagaggtaaagaacaagcatatacttcaatgagaaaagccataaaggacatctgaaagtcatgttcattcattcatacattcattcattcacttgatatttgagcacagtcatgtgctagaccctggaaatac

SEQ ID NO: 211806 - DNA, 413 bp, Homo sapiens
tcttgcagaatatgagctttgatgatttgaatattttcccccagcttttcttctcatcccatatcctacctttattcattcatacctaagtgatatttcataaattctctcaaggaaaatagttcatccatttttgcatttggatagaacatcctgaaaaagaacacctgtaaaatacctttgctattattataatgctaaaaaatacaaagaaggtaaccagagcatcagtgaagagctctcaggaagaattcattgtgagtgcatttgtaacaagtcatgacatagagttaatgccatgacttacagtccattgtaactagcctgttagaatccgtgaaaagacacattaatctatatacataggtatatagcagtaatactttttttttttttgagacggagtctcgctt

SEQ ID NO: 211807 - DNA, 430 bp, Homo sapiens
attgtccttctagcctttttcatctctaaaactgttagccaagggtttactaattgatccataaaacttaagaaatgatattaaatatccccagttaaacatgaagataaaaggctaggtactttaaaatttgtccaaggccgcagagacaggattaaaacttgggagctccttatactgaacattagagtattgccactgaccaaaatcctacagtttcaaatcagatagctgtgtgtagaaaaagagcaatgaatatggggacagaaaatgttgtttctagttcaggctgagtaaaataagtttcttcacctgtgttctgtaccccatcaccttctattttctcaggaaacatatgttatcaataatatctaatatattttttctttgatctcattgtactagaaattctgttcacatttaaacatgg

SEQ ID NO: 211808 - DNA, 383 bp, Homo sapiens
agtctgggaaagttttgataattacttcagcattgctgtgtgatgggagacattgttttaaaaaccgaatgtggtagaggttaaaaggacagccgtcaccatcctgtttcaaccaacgcttgactgagaactctttctggaaatctctcgaacagacttccaaaagttatatgtgaaaaagcactgaaacctcacataacgcaaagatccactgcaatacaggcatttaggaaatcatttacactaccttgctgatcacttttcacacttgatcttagccaaaaggccaagaagcgatgtggataacttttcaacctgtaaaatagccaccaatctgcaaaaaaactaattgaacactaataaatgaccaaaattgatgcaat

SEQ ID NO: 211809 - DNA, 387 bp, Homo sapiens
aatgactaatagaatattttgttttctagaaaggaaactgtagaattaaagaattataggatgtcagataaactagaatagattaattaatttaaattataatagattatttatattataataaattaatttaatttaaaaataaccaaaattcacctcttcaactttacagatgaaggagtcctagagatgtaaaattaaacttgccccaaaaatacaaatttagaagatgcaaagttaaaaacaaaaatgactcctaactcccaattcagcactctttccattataacacaccattttcagctgggcacagtggctcacgcctctaaccccagcactttgggaggccaaggcaggtggatcacctgaagccaggagtttgagacc

SEQ ID NO: 211810 - DNA, 375 bp, Homo sapiens
agttatatggcagcagcatgcaaactcaatctctgccctgtatcaagtagactgaaaatccagtggtgaaagcctcagtatgacacttgtggggaagaggaagatagaatcatactcaagggggaggcaatgcagaaattaaaatcatacactgtgtcttgatttaatttcttgatcacccacacatccttttcagccatttcaaactgcagtggttaccttgacacttttgaaggtgcatttgtcagtcctaacttcccagcatccagacttggcttattgggtgtggcacacacaaatagagaaaagttataagaaaaaaagactgaataaaaatttttaagtgctgtgctctactttgcctagttgagcaaa

SEQ ID NO: 211811 - DNA, 694 bp, Homo sapiens
caactgtccatctacccatccactcaagcctgacatttgcctgggagtagccctcgccacctgcctgcctgacggcccccagaccaaccggccactgccttctgagtgtgccacctcccgcatcctcatcctcctcgcctccccgagacccctactggagtcagcccctcatcacctctttgtggccaccctgcctacagcctctccccttcctgccaagcctcctgcacatgggcctccagggtgacctaaaaaccaagcttcccattatacaccctggggggagcttccatggctccctggcccggaccccaaggccttgctgccggatcaaagccgtcgctgggcacccccagccctctggtgtgccgtgtcctgctagacgcccccctttgcccctgatttcctttaacacctagggaaattctactcctccgtcgatgcccagcatggcttctgtgaagccagatggttctagatcgctggagagctggccgccctctcgtgtgctcaaggtggctggagcacactggccctgcagagcctctccgaatgccgccttttgtttccatcccccccagcgtctgtgtgtggtgtcagaccagggccacgcattcgctgtccaaaaccctccggcacacttgaccagcccgcagagttccagagatcctcaccaaccccatctgagatgaaa

SEQ ID NO: 211812 - DNA, 142 bp, Homo sapiens
tgatgtgagatatgactctgaaaagacttagccttgggaacctgtaaatctgttggattctatcatagaatgcacattagtattaaattatttaggatagatatatggagaatcctctatagttatctgtgtagatttggtg

SEQ ID NO: 211813 - DNA, 458 bp, Homo sapiens
tcattcctgttcatccttacacctttggcacccagcacaagacctggtaaagtatcaataaaaatggctaataaaaaataatagaagaaaaacctggccctggtcatcttattgcctgagaagaggcaaggagaaggtgcttggacattaaaatacataaataaattcatatagaaagactcctgtgccattaggggtctcatgtcatatgtattttaaaactgtttttgtttaatcatattatgtccttctgaagtagatggtttagcttggggtaaacactacagctcctttgtataagggctgaatttgaagggtttatgctttgcagacatgtgactttgcctctattaccttgttttgtgttcatgggaaattttcaatggtgaaaatgtgaactttggatttctactctcatcggggcagaaataaattcatactttggagttgaacttgca

SEQ ID NO: 211814 - DNA, 110 bp, Homo sapiens
ttggattatggaccatggacatggagaagttaaggactgtcattctctttttaaagtgtcaactgtacatattttggcatttatttttaaggtttataaagcaacttttt

SEQ ID NO: 211815 - DNA, 482 bp, Homo sapiens
ctctagaggatacaaggatgattagagatctcgcacctgtacctatcaaatgtgctaggattacaggcatgagccgccgcgcctggccctatggcacatttcagttgttacagctgcctcacaacaccacagagggtgatctccccttcaaaatgacagcagagaacagtcctgagctaatttctctctctctctctcacacacacacacacacacacacacacacacacacacgttgttatattgatacatatctgccttcttttataatcataattttatttgcctaaaaatattattccaggaaggagtccacagacttgcctggattgccagaggggagagggtcatggccaaaaacaagtcacagagcctgcatctgactttttctcagtatggctttgaaattacagtcatccctgagtatctgagggggattggttccaggaccccctgcagataccaaatccttcaatgcctaa

SEQ ID NO: 211816 - DNA, 457 bp, Homo sapiens
tttgacattcaaactaagaaactcatgagagtgaaagggggtgctattaattaagacaggacaacaggcttacttttaagactaccctatgaaaacatattcttattgttaacctatatgcctgtttccatttttctgtttgcctaatgaagggaaaaattgctatccttgctagttgctttagcctgtacattttttttttttgtttgctattgccttatctgaaaagaaaaaatattattgatctctgtttaccaaagtgttctgattcttgttaatagtcctgcttaagggcgagggtggataaaggagcctggattatgcagatagctatgccctgtcttccctcagctgcatgttctccgtttgcccctggagacacactctcctctattctcctctccactctcttctcagtcccgagacattgacctgggatacatcaaaactccttccc

SEQ ID NO: 211817 - DNA, 340 bp, Homo sapiens
agaagcttctgtgtgggtcactcaactgggtcccctccctcctgctggccacattctagccacagtggccagtgttctgcctcaggacctttgcacatgctgttccttttaactggaaagctcttagcctcatcttcacaaggccaccctatgctcgcccttcgcttaaatgtcacgtcctcaaagaggccttttctggatgcttcaatcatatttggcttccccagcaaagtggggttttccttcatagatgggtgttactttgtggctgtccatgaactcatgtgattattcacccactgttggtctcaacaaccagactgcagacaccaccggggca

SEQ ID NO: 211818 - DNA, 372 bp, Homo sapiens
tctcatcatgtccagtttgacaactaccattttaactgagtgacccaacattttgtaataatttgagtgaaattcagagttctaggcccaagtggctcatgcctgtaatcctagcacttggggaggccaaggctgacggatcccttgaacccaggagttctacatcagcctgggcaacatggtgaaaccttgtctctactaaaaatacaaaaaatcagccaattagccaggcgtggtggcatgtgcctgtaatcccagctacttgggaggttgaggtgggaggatcatataagcctggggaggttgaggctgcagtgaaccatgatcacaccactgcactccaccctgagtaacagagcgagaccctgtctc

SEQ ID NO: 211819 - DNA, 283 bp, Homo sapiens
gtcaaggcattccctgggcttcaagcttgttccagtgagaaacaataagatctttatgcagctattcactttgaggtataaataaccagaaccccagataagaaaattatatttacagcctaactttattattttaaaattgttgtttttctccttagcagatcagctgactgtggattgctggaaatccctgcacattttatcatgcctcagtcagcaatatattcttggcttcagaaacattgatgttgaaaaccgaacatctggtcttccctttctaccc

SEQ ID NO: 211820 - DNA, 355 bp, Homo sapiens
tggcttgtaccaccgaagtttacaatgtgccttataagcaaaaaagaaagctggatagcactgtgtttaatatacatccaaattactgtattttggcccggtagtggctcccacctgtaatcctagcacttcgggaggctaaggtgggaggattgcttaagcccaggtgttggagaccaggctgagcaacaaagtgagacctaattacccgggcttggtgggtgtatgcttgtggtcccagctacttgggagactaagacaggaggatcacttgagtttaggaagtcaaggctgcagtgagccatgatcatactactgcactccaacctgggcaacagagtgagaccctgtctca

SEQ ID NO: 211821 - DNA, 458 bp, Homo sapiens
agaattagggaaattaacaggctcctaggagtcagaatgctcagcttctattcccagcactgcttaaaattttcaggggaaagtactttataatccttgcagcatttggtgcctttattagaaaatccttttatgtgagattttgagtttcttattttctctcctcaccaggataatgcacagaaagagctgaggtgggagtccgagagacaggggtctgacatgtataatatactctgctgcacaggattatcatgagggttaaatgaaataataaatgtagattacacttagctcaggacctgccacacacttagctgagggccaggaattcaataaccaatgactatcaatgtcaatcattctagctattttgtagatgcaaagtccaatagaaacagaaagggtgcaaagctaaaacttttaaaatactcagacccagactctaatccattaaa

SEQ ID NO: 211822 - DNA, 833 bp, Homo sapiens
tcacagagatacataaaatctagtaggatagcatagcctagaagagggtgagaaggaagtggcgaatgtcgagttataaaatcaaaccaggagtaagctgctacaaattgcatatcacaaagtcccatttgcttgccaagtggagccttggttttaatttaaccactcctcggattaaaaaatcatttctacatcttttccattcttatttgttttctgtctgtgagtttttattttatgagaaactcgaggggcttgattctgcctgcatcccttagcaggggcaatcctgttgtctgtccctctgctggccacagaaccaccaccctgggatttctattagccacagaaggagaagtgaatctggtcagtttcacaatgtctacaacttgacaggaaacaaattgctcagagggtgcatagctattcctgaaactgagccagacaggaatttctcctgtgagtgtccagaacgagatgactggccaaacccaaactacgtgtaggttttctactacacgcaagatgttgatgcaggtgcagtgagggagtacaaagaagcacaagacatggcctgctctcttggagcttacagtctgatttctggctcaagttctcttcctcttcccccagtgtccttctgaatgttgatacagtgtgccaggcaccctgtgggctaaatactgcagtgcttactttgtgcccaatgctcttccaagccctttggacattatctatttaatcctcactcttcaggataggcactataaatgtgttcactttcccagtgaggaaactgaagccccaagaggttaattaactgcccaaacaaa

SEQ ID NO: 211823 - DNA, 510 bp, Homo sapiens
ttgtaccagagcagcacttggttattcacttacagtatcaagaattgactcccttaatgacagggatcagctattgcaaattgatttgctggataccctttcttgcccaaactactgtttaaaacctggtcaccaactgcaaattgtcagcatcactgcctgctgctaatggcaaaatgctttctgactgaggaaggttctatctttccacaaacaatgcacatctccactttcattttttctacttttaaagaatggtcattagagctaactactcttttgccttgaatttcctgaggccctccagcctctcccaccactgttgattccaggctactcttctctctcctgggtcctatagagcgattgtgctgaagcctttcagttgttcttctctttccaccattcctccaagaaaaggagaggtaaggtgacctagagtctccatttgctagttctgccttctctcctgaattctaggtctctaatttctattttgaggtcaaaccg

SEQ ID NO: 211824 - DNA, 682 bp, Homo sapiens
gtttagttttcgaagtaactgctaagccgtcttccaaagttggctgtatcattttgcattcccaccagcaatgaataagagctcctcttgatccacatcctcaccagcatttggtgttactagtgttttggatttttgccattctaatagatgtgtagtagtatctcactgctgcttcaatttgcaattccttaatgacatatgacatttagcatcttttcatatggttatttgtcaacctctttgatgatttgtctgttcaaatcatttgcccattttttaattgggttgttcattttcttattgttgagttttaagtgttaacagtccttgatcagatgtgtcttttgcaaatatttttcccagttcatggcttgtcttttcatacttttttttttcttttttgagatggagtctctctctgttgcccaggctggagtgcagtggtgcagtcttggctcactgcaacttccaccccgctggttcaagcaattctcctcccttatcctcctgagtagctgggattacaggcgcctgccaccatgcccagctagtttttttatgtttagtagagactgggttttgccatgttagccaggctggtcttgaactcctgacctcaggtgatccacccacctaggcctcccaaactgctgggattacaggcatgagccaccgcttc

SEQ ID NO: 211825 - DNA, 359 bp, Homo sapiens
taaccaagattaaaaactttaaatccattttgctatatattttccattctaaacctcaaggtagatatatgcaaagtggacaaactgcattaaagcttctagattaaatttttctgactacctgagatagtacatcaatgaactgcagtggctctttttgcataaaatgatgagcctcagcctctggcatccttttctccttagttcccctcttgcttgtcctctcaagtttgaaacctatctgcttacagcaaaaatgatttaagacaagtacaaaggcgtaccacattaaaaaacgtcttctttaaagaattccaagactttggcagaggatgcaaaaatctttaacttctcttaca

SEQ ID NO: 211826 - DNA, 693 bp, Homo sapiens
  misc_feature (422)..(422): n is a, c, g, or t
  misc_feature (430)..(430): n is a, c, g, or t
gagttggtcatagagatgcagcacaagaagcggagacagaagagatccagggtcagaagaatttaatatgccattcctagttttgggtgtgcagagactacctacaatgactcaaaagaggcctctaaataccaagggagatgcccagatggcagccagcaaaggaaacagacctcagttctatagacattgatttctgccgactacctggattaacctggaaatggactctcccctagagcctccggaagggaaagcagctcagcgaatgccttgatttcagtcttgtgagacttgaaacagagaaaccagctgcgcctactggacttctgacctacagaactgtgagataataaatgggtgttgttttaagcccctaaaaaaaaaaaaaaaaaaaataaaaaataaaataaaaaatttanacatatantaaaaattataaaaattaaataaaaaaaactatgtggcccgcttgggccaattgaattttaaattggagcaagtttattcatgcgggcccaaatttgggctaaattggccaaatttgccccttaggggaggccgtttcacattaactgggccgggtttaacaaggtgggaactggaaaaacccttggggtccccaatttaattggcttggaagaaatccccttttcccatttgggtttccaggcccggcccgattcgcttttc

SEQ ID NO: 211827 - DNA, 367 bp, Homo sapiens
ttgacccagtgactgggcattagaaataccgatttctgcccagctcctctgcacgcccatcctgcaagtgagggatgagcccctagtgcagcgttagagtcagaatgtgatccaaaatctccgttccaggctcacagtctttaagcccgtcactagctgggcacctaccgtatctgttctgatcacctcctattcactgtgttggtgagagagggaacttccccctgccctaaacagcattaggcgattgaacacacagcgccgggcactggacagatgaactgacagcagcttattagttacataaactgaccccctggggaggagggcaccccgtgccacacagggcgtcacgggggcagcactt

SEQ ID NO: 211828 - DNA, 430 bp, Homo sapiens
aggctccgtgagtcattgtttctgtggaagttcttcaactctgctgttatgtcaggaaagcagcttgggcactacgtaaacaagtgagtactgccatgctcctggaatagtttatctgcaaaaacaggaggcagaaaaagtagaaataggccaggcatggtggcttacatgtgtaatcccagcactttacgagtccaaagcgggtggatcgcttgaggtcaggagttagaaaccatcctggccaacatggcaaaaccctttctctactaaaaatacaaaaaaattagctgggcatggtgtcaggcacctgtaatcccagcttctctggaggctgaggcaggagaattgcttgaacccgggaggcggaggttgcagtgagccgagatcacaccactgcattccagcctgggtgacagagcaagactgtctc

SEQ ID NO: 211829 - DNA, 347 bp, Homo sapiens
cagttcatggacatagtgacatttaagtaaggcttttgagagagtagtgttcaaatgggtaaggaaggccgggcgtggtggctcacacctgtaatcccagcacttgggagaccaagacgggtggatcgcttgaggtcaggagtttgagaccagcctggccaacatggcgaaactccatctctactaaaaatataaaaattagccaggcatggtggcaggcacctataatcccagctactcaggaggctgaggcagaagaattgcttgaacctgggaggcggaggttgcagtgagccaagatcgcaccactgcactccagcctgggtgatagagtgagactctatcca

SEQ ID NO: 211830 - DNA, 352 bp, Homo sapiens
ccgtggtcgcccaggctggggtgcaatggcgcaatctcggctcactgcaacctctgcctcccgggttcaagtcattctcctgcctcagcctcccgagtagctggaattacaggtgcatgccaccatgcctggctagttttttgtatctttagtagagacaaggtttcaccatgttggccaggccggtctcaaactcctgaccttgtgatctgcctgcctcggcctcccaaagtgctgggattacaggtgtgagccaccatgcccagccaagtgattatattctcgtagtctatagctgggtgcctctcatactcccatctagtcactaaccatgcccctacgggtaagcacc

SEQ ID NO: 211831 - DNA, 616 bp, Homo sapiens
aataaggtaattagatcttatgccagaaagacaactgacaactggggccaatgtgaagaacggagcaagaaagggaactctgttaggaggcaatggccagtaacgtgggtgcagcaatgaggcctcaacgaaggtagcagcagcaactagagacaagagggcaaatcttagagggaatgggggggtaagagcaagaagagaaataaaaaattaggtatgcagctcttggtggggaggtaagggacagtgtgagagaggaaaaggtcagaagtcaaggagaacatgaggcccacatctgagcctccacttttctaacttgtaattttacctataccacacagaagtcttagaattaaacaatacttgtacaagccctcagctcactgatggaacagagtaaatggttaataaatgttagctattatttttaggcttcttgcttgaggaaatcgcttttaagaacgtagttttttcgctgggcgcagtggcccacgcctgtaatcccagcactttgggaggccgaggcgggcgaatcacaaggtcaagagatccagaccatcctggccaacatggtgcaaccccaagggggatcgtctagatcacctgcataacaagt

SEQ ID NO: 211832 - DNA, 586 bp, Homo sapiens
atctatactacatttgcaaattaccagtaatctcctgtttcaacaaataatcccatttctgaaagatagtgatggagaaattactccattaccttttggatggacgtgtagtaactctgatatcattctccactcagaaagggctcaggcagagttgacaaaactgcctgaggcagctcaacatgtatacacacacacaggtctcctggtagcctgtgcttgctccaagaccaactacctatttttcaccatgttcctgcctcctgtggctaatggaagctcaaaggcttttttttttttttttttttaagtcaatggaggagctctgctcagaaaagatttgagggaaatgaagcaagggactacagagaaacagaccccaacctgccaaggagaggggctatttttaactcaggaaaggaggcattactcttgagggaaaaaatcctttgagcctttattactgcctcttagaaggacatccttttatgttgagtgtattgatatgaattcagtgcccatgtctagaacttttattttcagagagcaaaggccattttagtgtttctgtttctgcaccattagt

SEQ ID NO: 211833 - DNA, 195 bp, Homo sapiens
catctctgggcagaggagatggtgagcacaaagccctaatgtgggaacaaacaaaaaaaggacagtgtgcccgtggcagaggaccctagtggagcggaggcagggccacagcaggttagaccatgttggagctaggatgttgaaagtgaaaacctgacgagatgaggtggcgcacgtctgtgatcccagcacttt

SEQ ID NO: 211834 - DNA, 665 bp, Homo sapiens
ttgaccctggagatatccaggtcagcttcaactcaatggccagggttattatgggtgatagaattgtcctagacttccactttgcaggccagagcagtgtgggcaattgctaatacaacttgctctacccatattaatgtctcaagccaagtgaaaaggtcagcaggatcttaagaggaaaatcacctggctttcaaaggtaaatcctagcagtttatgggatttgtttagctggttgggtctaggaccttagggggcatggttgagtttactgttacgttattggtgtcatcctattgtttggagtcttcattatctttcttatcaaagtgttacttttaagatatctgataagaatctgattcagattctttgttcctttatatgtaacagatatttctgtaagcttttagaattacttgtttacatttcatgtaattaaaaatttttatttgattgaattcagtctttctataatatgactaggaatggggtttttcttttttatcttgtgcttttaaaaatttgtgcattttcaatctgaattccttttattttttgaaactgggcctccctccgtttcccagaaggagtgtagcgggccgagatcgagccactgcactccagcctgcgtgacagagcaagactctatctcaaaaaaaaaa

SEQ ID NO: 211835 - DNA, 478 bp, Homo sapiens
ttaaaaaatatcctgccagtccatgtttatttttctttcctttcttatcccctttgggttgatttttttttttcctaattccatctttttctctactggtttggaagttaagacccttccttatcctgttagtagtttccctaaaaattttaaaatgtataattaatgtcttaaaaaccacagtttatcttgtgtctttaccttcttcccaaacaataaaagggccgtagaatgcttttccgagcaccctttacctgctcaccaaagttatatactatgttgttatgtatttttaattttacctttattattcaacataagacattatcattgttttattccttcaatatttatttagatttattcatatatttaccactttccatgttcctaactctttgtattataggtcttacatctgggctcacctaacttttgccataagtatatcctttagaatttcctttggtgaaggtcc

SEQ ID NO: 211836 - DNA, 345 bp, Homo sapiens
gggccctttataccaggtgccaaacttcattatccaccccaccaccttgcccgggagggagatctgtgaaagcgaaacgtgatttaagctgggatctggcagcaacttcgtggactctgaagggcacgtgggaaaggagttttgattgaaggtgagggatttagtgaggtaaaattatatccaaattagagtttggtaaaggcttccaggttaatgtcctgttaacgcttatcctgatttgtggaggacacttaagctgtctaggcctaaccttgtgtttgatcactcaccttaatttgtagacattctaggagctctttgtcaatgcctcttaccatttttatc

SEQ ID NO: 211837 - DNA, 437 bp, Homo sapiens
ttagttgcttatttttttctggctactttaatctctgtcatgggtgggccctctgttgattatcaagcacctggcacaagaactgggtcttaggagatacttacattttaattgatgaatctctttcccttctatacattttcactttgagatggtaccagacaattgctacttacctatctctccctgactctgactttctctcctgaaaaaaaaaagcaaaaaaaattttttcactcgagttggaatgtttttctgataattgcaagttggactgagggaatgggagtttgaaagggaacaggagaaggaattggaaattttggagtggagcacttagtggaattgctatatagggaacttttgacattcagaagccacatgaattattagaaataatactttgacagaattaggtaattgtctaaacacctgtc

SEQ ID NO: 211838 - DNA, 404 bp, Homo sapiens
taggctcttctttctttttattttccaaatatctgcttttacttatttgtccatccatatttgtgaatgattgactactttggttcattataggcaggtggcatgggttcctctggaatcttttagtcttgttttcttagtagtcttctcatctctaaatgagagggcagctgcggctccatgtagataggtaggagtatagacaaaccttgagcaatgtggcggttaggggcgttgacccattgcacagttggaaatccatatacaacttttgactccccaaagccttactactaatagcctactgttgaccagaagctttaccaagaacatcaacagtcagttaacacatgtgttgtgttgtatgtactatgtactgtattcttacaaaaaagtaaactaga

SEQ ID NO: 211839 - DNA, 403 bp, Homo sapiens
ggtgcccagaaggtcaaggcagcagtgagccaagatcatgccactgcactcccatctgggtaacaaagtgggaccctgtctctaaaaaaaattaaaaaaaaaaaaaggaaaagaaaagaaatctgatgacataactgcacagcactggaaaatgtaataagcctcctgagacctctgccacccagccttataggaggcagtgagcctcctcacatacccagtacacggctactacaaccagcatttgggaaagccaccatacaaagactacccattaccaagaaacgcttatacagactcgttgccactgaaagcacccagaaccaaatccaaaggaccttacacaacataaactatagacatctcctcagatgaggaaaaaagtcacatccaaataaaagca

SEQ ID NO: 211840 - DNA, 473 bp, Homo sapiens
tctttctgtcctgtcacccttataatatggtctttttttaaaaggaaacttgtaacttttactaactatgccagcatttaatgcacagaattatttttataccatttcatcagccacaacattagagagaaaaatccaactgaaaagagaaatgcacacaaaattaggaatactaggaaagcattatgctttaatacagaggaaagggaacagaactaccatttatggccattactctgaaaggctatgattccttctgccaaaagagagttctcttccattcagtattgattaggcttttactacagtcagaaagaagcactttcccaccaacgagttgtataggttggtcccaggaattcctctgaagctggaaaagcctaagagatgtattcttccctcatgaagtgagccatagctactttccagctcctcagtcctcagcagagcatctaccatgcaggaaaaaaaaa

SEQ ID NO: 211841 - DNA, 691 bp, Homo sapiens
agagaatccagataaacctaaaggagaaaatcaaaattgttaggaacccacctgtcatagagaaccactgttaaccgtttggtatccagccttccagatggctttatatgcatgtatatttcccaaaatatgtgtgtattttttaatggatatttaactaggccacggtgggagttcacctgaacatactgtggtttacaaagagttcccatggatgttggctccttcttgtgatgccaagaaaacggtgtgggattgttgacccactttacagagggggaaacaggggccccagagtgggtagggacttttttgtgtcacccagcttgttgatggtacaactgtaagtgggaggtgggacatggggccagctgaggactcctgggggagccacaagcctgtgagaggcatgtctgggggcacagttcccttccaccaggtctctagaacccttgagtgccccgagggagtggtatccccctgactcatagcacaatcccccaccctccctgacaacctctgcccccacccaggccagccaccctggctaaaaatagcccagggccaagacctcctccgtccctgctgctccagcccttggaaatggactgggtgggaggaaaagtcaacacagcctgggccccaaaatagactgtcacccagactccgcggtttggggcctcagcatcca

SEQ ID NO: 211842 - DNA, 516 bp, Homo sapiens
ataccattcaggcataggcatgggcaaagacttcatgacgaaaatgccaaaagcaattgcaacaaaagtgaaaattgacaaatgggatctgattaaactgaagagcttctgcacagcaaaagaaactgcatggctcccttcatccctccttcaagcctctgctcaatgtcactttattaaaggcacctttggcaaaccaccctgtacataatatcaattctcctgtctaccctggcattctaatttctcttatcttgattaatttttatttagcatttattaccataagcattataacgaatacaggcagcccttgcttttcacagcagtgcaagattgcaagaatgactgtgcagccggaaacccaggaaagcaatctccacatccaatcagaaaaacaatgatcatattgtgacctttacaattttttgtcaaaatataggaaactctcatagtgtcagttacaaatgtagaaggcaataaaaaataataaatgaatatttattagtaccctgt

SEQ ID NO: 211843 - DNA, 290 bp, Homo sapiens
tgtattggtggtgctctcttctaggaaccatttaggggagggactgccaatacatgaccccattttacagatgaggaaatgggctcagagaggttaagaaactagtccaggccgggcgcggtggctcacgcctgtaatcccagcactttgattaaaatcattcccttgacagtgctggtgagtacctactgggtgccagatgttggggagaccccacctcttgaagccagcaagacccatcacagcttacccttaaatagctctcactgtgtgagagcaccaccaataca

SEQ ID NO: 211844 - DNA, 748 bp, Homo sapiens
tggaggttgcagtgagctgagatcgcgccattgcacactctagcctgggcaacaagagcaaaactccgtctcaaaaaataaaaaagaaccctagacccaacttgctctaggaggcagaagtgaaatggcctcgaagcctacagataaatcctgcctttaccatttaccagctgggtgaccttgggcagtttgcttgacctctctgagcctttatttccttgtggacaagttgggcatgacagtggcgtctactggcatgaacaaggttgctgagagggctgccatgaggggcgtggcccagcagttcccaccatgctgagcacgtggcaggagttaagggaatggaaggcaatccagaagaacccatgacccctgagaaaggcttgcggaagaaggtgggcagggagaggtttgggaggggacctggtgggatttggggagtcctcagaactgacacagggaggccttactcaagatccagccacctgccaggcgcagtggctcacgcctgtaatcccagcactttaggaggccgaggcgagtggattgcctgaggtcaggagttcaagaccagcctggcccacatggtgaaacctgtctgtgttaaaaatacaaaaatcagccaggtgtggtgatggacacctgtaatcccagctactcgggagcctgaggtaggagaatcgcttgaacccaggaggcgaaggttgcagtgagccgagattgtgccattgcactccagcctgggtga

SEQ ID NO: 211845 - DNA, 511 bp, Homo sapiens
cctattcaaccaagaatactgtatgcagcaaagtttctcaccaaatatggaggtgatataaaggcttttccagacaaacaaaagctgagactttttatcaacaacagctctgtcctacaagaaatgctgaaggtttaaactcacaggtaaaagtaagtaaacagacaaattcagaatgctcaaatattgtatttgtgatgtataaaccactggtatccttagtatgaagactaaaagacaaacctatcaaaaataataataacaagttgttaatagagagacaacataaaatatatgaagagggaaaacaaaaaaggtaaaaatgtaggggacatgaagttaaagtgtagaggtttttttttttttttaattttctctttgcctgcttgttgttctttaattttctttgtaatcagagttaagctgtcgtcagtttaaaataattgcttagaagatttttttgcaagtctcatggaagccatgaagcaaaattctgtaggagatacacaaa

SEQ ID NO: 211846 - DNA, 526 bp, Homo sapiens
ccatgaggcagatcattcatatgggtgcaaaatactgataatgaatgcttggcaagagttctttctgcatggccacttaggggacacacaagagccgatttccaaggctggcactaacaatcgaacagtaataatgagtaaaagcagccatgctgtattgggtacctgtttataggtcaggcattaagctggtgcttacatacattatctggttcaatcaatccttacaactgaggccaattttatcatcccaatttattggagaagaaaagctgagctccaagactttgcccacagtcacacagcaagttaagaagcagcactaaaatctggaccctaggcaatccaacaactacacttctcctttccccagaggtggacaggagtgagacaggacttcagaatgtctggagaccctcctcagttctgggtgccctctcttctgcctgtggataaggcaggtgggaacgaatgctggggatgggaaatctgtgtgtcagaaataaacgtgtaaacattttctcta

SEQ ID NO: 211847 - DNA, 437 bp, Homo sapiens
tgacctgacatgtgcagtattcttcattcattggcgcaggttggatagttacagtagattacattttctacctattaattccatcactctatctcattttgcaataaacaacacttacatcaacatcattatgtactggctttctaatttcagatcaacttataagcgtgcttgtcttatcaaaattacagatctgtatgtaaagttgtaaacctcaatcatgtcaaagtaatgacatggctgaaagagaactttaattccccacattacacactaaaattcaagagaaagtatctataaactggttctaaggaaagtaattaaggaaataaacccctaaaagtaaaggttaactagccaaatttggcaagagtgagaggtagtatcagagcactaattccataattcttttttctttttcttttctttttttttga

SEQ ID NO: 211848 - DNA, 1354 bp, Homo sapiens
aagcggcgctcgcaggcgctgaaagcgagcgaccatctgagcccgggtggtccggcgggcaagggcggcgcgggagacccgcagggcgcgggcgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgctggcagggacattggaaagaagggcggagagggagtacagcgaaaggtggggaccgcagaatttggaatctctgcggagaccggaaagaaaattaatcggagcacttcctacatgcagagccacggaaactgccttggaaagagaaagtggcagcgtctgggtcccctcggtcagcccgggccagtcggctgcgcgtgcgaagtctcctctagcggagcgggaccggccgcggcggtggatcgtggcggtccctgcacttctgctccagccgccgcgcctggaaacctgagcccggactcgcggctgctgcaaaacccgcttccagcccacctcactgcgaactttgcttccgaggggctggaaggagtcccaggcagctgtttcccaagctgtggaacacttcctttcccctaggcactttctgctgattccaactttctttcctgtgattttcgtcttttcccgtgcatttcatttctccgactccagctctgtactaaatcctcacaagtttctcgttttcatacgggaactggatggaatgactccccaaaaaatacagctttatttctcaaatactgacccccaaagcactatctagtaatatatttgattgatctttcaaagtcagtaaaccacaaaggtttgtgtaatggcttgtacttaacgcctgatacctgagtaaagtttgaagcattaacataggaacagttcacttggaacaaaaatttattttctgaatgacctataaaggttgtcagagaaggtcttagtacatgattgaataacttggtctaacttacaggaagaataaagggcatttattttaaacctgtgtgttccccattctataatgggctgcctaggcattaaaggctcttgacatacttaagctcttgactgagggcgtgttggagattaccccttgtttttgagtacaatagttttgtttgctttttttcttttttaagtaacatttgtttttagacgtttaaatgaaaagtaaaaaaaaaaa

SEQ ID NO: 211849 - DNA, 390 bp, Homo sapiens
agtgtgtttcagcctgcgaacttcctggatatctttacggggaatcattcccggggaaggaagggcaggctggaaataatataaggagatcaagaaggaagtcgagcaagtgacacctttaaacaggccaagcgagccgggctcttccccctgggacagttagagttatgcagagctgtaattaacccagcagcccactgggatatgtctatttctccgcacaaatgctgttgaaagaaggattcttgaagaaagaggttccaattcaaatggtatttgagtaagtcccttgtcggatatactgtttctagagtttatggctataatcaacaaaacatggccattctttcatgcaggtttctcatgactttctgaataccaatctttaga

SEQ ID NO: 211850 - DNA, 849 bp, Homo sapiens
ttggaactgactagaatatggaaaatgtttggcaatgctgttctatataaggtttctttcaagtaaaactattaagaaggaacttgaagtagtacaatgtaacgataattatgaacatcctttctgaagctataatattgtcactagacatctctgccatcttctaataacattgccctttcttccactgttcaaacacctaactgatgaaccccagctgtctgctctcagaagtggatgcaacaccatgagttaagcaacacctcgaacccagcagttttggaattcacttggatgcactggaagagtcgtatttccaagtttacagggtcacgattaactagtcttattaccttttggggatggacagctaaggtatttgagatgaagaaagataaagagtgtttggtagtgataggatttggagatgcaaacttcgacatctaaaatacagaaaattaacaaatactatcttttgaagtccttgaattgggaaattaggatgtcacagtaaagtgacattaagtgcagaagtgctctggttttctggtccgcagcagagttcacttgggtttcttcgtgaaagtacatgaggctgattgccccgaagtcacttcctgcagcatgtccttcaccccgggcttaccctgttgagtcggggaacccagcaggcggctctgcccctaccattacctactatgtctgcctctcacagtgccccagtttttgtctaaaaatgaagcagaaacaaagctggctgcgtggctgtttgaggacttaggagctgttgtccagcaccccataccatttccctggggagggctcagcactagctgaaatccactttat

SEQ ID NO: 211851 - DNA, 395 bp, Homo sapiens
aaaataaaatttttaattatgttggacatttcaggcccagcgctgtcatcctgaagaaaagtaacatctgttttgacatctccagtggtagagactttaaatcagtttccacattgcttatctgctggctaatcagaatggatgcagtattcttaccaactcattgacagggaaaaaagaaaagatatgcagagaaatagggtaaactaaaactgatatgatgaatttaaatgaaaaatgtaatggcctttgcatatattatatctaaactttcattcaatgtaaaatttgataatttcatttaattcctaactgtacagagatttatttttctttcctcttcctgatgtatacctttgcttccacttaaatataataaaacattaaagcatatt

SEQ ID NO: 211852 - DNA, 459 bp, Homo sapiens
cacagcagaaaccaggctgccaagtacactggcttccctcagaaaggaagtactctttctctaggacggtgggcactgacactcagtttctttataacataacaccaaacagtgtctacagagtctagcctgagaaatctgaaactggatgataaaactaaacctattacctccatcattcccaaagaaaatcctgcttcttttcctgctctacttgtgtcaatttgtgagtcacagtctagctaagcacttaagctagaaacttggagtcatacacatttctaactttcagaggcagggttaccattgaacaatgaaacaaatacctacagctttctatgggcaaggcctcatgttagattataatgacttcaagaacacaaaaccctggatctccgggactttcaaaaacaaaacaatataacggtacatgtaatttcaactgtttttagaggtaac

SEQ ID NO: 211853 - DNA, 166 bp, Homo sapiens
taccttctcagatattcactggacaaatgcgtgtactgagtgttggggagagaaggtagctatcaatgtgtcatggctgctcatgttcccaagggacctttaaaaagtctaatgcactctttggggatcagttgtaaacagattaattaaataaacattccttgtc

SEQ ID NO: 211854 - DNA, 367 bp, Homo sapiens
cctgcctggtcctggtgggggtcacgtgaggaaaaggtgactcagactctgacacctgctgagggagcagccaggcaggaggagtaccggtgtgccgagcgcccagggtcagccatacctgcctcacctgtggtctccccagcaggccccacctgtggcccaggccttctgcctgccacccagagcagcaggattcctctcacaatccttggctcagccgcagccccacgtggctctccacatgcatcctgcctacccctcggcagctgccaggcccagtcccccatccctgagggtggcccttgcttcctgctgcacgccctctacccccgggcgctgccagggcctgtcctcagcctccaatcca

SEQ ID NO: 211855 - DNA, 171 bp, Homo sapiens
caaaagaagggtaagtgcttgctgttcccatccctgaaacattgcatgtatttaagaaaaacaaaatgttagtggcatatttgcttctaatgttcccctaaccctacatgcatgttttatgtgcactcatatgagtatctttaaatataatccctttacatctgtgttcta

SEQ ID NO: 211856 - DNA, 329 bp, Homo sapiens
agcctgggccattggggcagcaattctgtcaaggctggggtatcactagcacagattaaacccaaaggcacaaagaaggatattaaacttcctgaagtggcttgtccatgcctagtagatgaactcaaaatgattctttagtctttcataagactgttaaatattttaatgaaatcagtaatttagaaatgtttactaatactttatattaatgttttttcctttattcccattatgactttccccaaggttaaatatgtctttgattcttcaatcacttatcatagaatctagctcaaattaaagactctaaagtgtttgggatcaga

SEQ ID NO: 211857 - DNA, 324 bp, Homo sapiens
gcacaacataaatgtactgcctaccactgcaataaacctttgaaaatggttaagatgaggccgggcacggtggctcatgcctgtaatcccagcactttgggaggccgaggtgggcagaaattgaggacactggggtgttaagtaatatatccaaggttatatgggtagtaagtggtagagctgttattgatttaggtcctctggggcttttcattttaaatacctcagaataaaatgaaaatattgcctaaactgaggcagcccacacaacatcatggcatctaggcacatacccagacagtgtgtgagtgatgggggggtgcc

SEQ ID NO: 211858 - DNA, 1596 bp, Homo sapiens
tgacaggttaggaagttttcatttcagtttcaaattcaaattcatactgtaaagtggtgatgaacacatcccatccgcaggtacttaacctccatacaaataagaactacctctcatatgggcaaaaagatcaaaattctacagaagaatctgatggctaaatggctaatttgcaaaacacaatgccctgtacattttgaggacatcctaaaacatgtgtaaacttttcagaattcagtttaccaaagttatcaaacttaaaaatgattaaaatttatttgctactgcaaagaattcaaccaatttctccaatgactactccatattcattttgaaaaacagtaccggatttaaagcttacacaacaaaattcacaaaagtgttatatgtgcctatatgacatataggcacaaataactgcagacattctgaagctaacactgctcaaccaggaaaaaaaaaggctgcaattggatatgtaataacagctatttaagacggcagtaacgtgttaaaatggttcataaaaatcacatcataaggccctgaaattctagtaaaaatatctctaagtaaacttgtgaactactactaaataactaattttctctctctctgtagtcactcattttatctttggattactttcccattctatcaccacgttgctttctctgaacttcattttacatttgcatattatttattccattagcaattgctcatcccagtctgaatctcaaaattctactataggaggcatttggcattctgtggaataagagaattttgagatggaaatgatcaaccagctcaaaacctcgtaagctagagttcagttaagcttagcacaatgatgaaaacaatttctcattaaaacttctttcattccctctacagaagcagtaaccctgggtacagttaaaactgcctgggtctttaagctttgtcacctcggacaagtcattatacctaacctcccagggcctcagcttccagagtagttaaatggaaaaacaatagcatctatctcaggttattagattatgaaatgagttaacacacgcaaacaggctgaaagagtccctggtgcgcagtgcaggtattagtcatttagaggtatagttactattacaggaaggtagtaacttagaaagacttacctttaaggtccaacaacctaatctacatatttgtatatttctaaggtaagagaatttttaaaagtctattttcaccccgtaaacctaatgcaggaggataaggcacgggttactacaggaaaaagtaatgcagactgggggatgcgaaccaaagcacagacgaatgtgccccgacgattcctccgagaacataatgaaatggcggaccttcctgccagaggagcgcacagtcacccaggcaggtgatgtgacacacacgttagggtctaaaggtcccaaggctggagtcccctttactggaccctaaacatgtctgcctcctgccccgcaatcagacttagagaactgtggacggtggaaagtcttatcatgaccaggccatccttcgctggggtgaacggaaagcattcagaaggggaaaattgaaaacaac

SEQ ID NO: 211859 - DNA, 589 bp, Homo sapiens
cagtaataatagtacagttgatcctcattcttctctggttctacattgagaatgtgcctacttgctgaattttatttgtaactcccaagtcaatacttgaaatgttttcatggccatttgtgggcatgcacagagcagtgaaaaatttgcacattcccagttaaggttcaacaaggcgtcacgctgctgctgcttgtttcagctctcctattgaatgagtgtccttctcagtctacttagtgcaacgtttttcacactttgtgcttttgctggggatttggcttttggaaatggcctctgagcctcctgctgaagagctgtgtagttcctaagcacaagaaggctaccttagggagaaagcgtgtgttagacacttgattcaggtgtgtgctatagtgccatcagcttagcattgatgaatcagcaacacatatactaaataaaatgtctttaaacagaatcatacataaaaccagattatatgctgttggttgatgaaaatgttgtgaccagaggctcacaggaacctaatactgtttgctagttcaatgttcactgtgattttatagaacataaccatcgcgaataa

SEQ ID NO: 211860 - DNA, 202 bp, Homo sapiens
cgtttatgatgtgagagaacacagatacaagttttcatacaaacaaaccaaaacatggacaaagggaacataatgtggagtcctaacagggatcctctgggtgaaattcaccatgaaaaattatttgggtgccatcacattttttccaaattgtgaagggtaacgtctttagatggcacttcctgtctctcacatcaaaacg

SEQ ID NO: 211861 - DNA, 433 bp, Homo sapiens
aaatgagtaaaccaagactgttttgcagggccatgttctctattggggagcagacatttctcacaaatttaagtaagttctgctactgaaaccaaatgttctattaaaaagaaaattagtagggcacagtagcatatgcctgtagtcccagctacttgggaagctgaggcaggagaatcacttgaggccaggtgttcaaggctacagtgcactatgatctcacctgtgaataaaccagccactgcactccagcctgagcaacatagcaggaccctgtctttaaaataaataaataaaaatttaaaaataagggcagggcaaggtggcttacacctgtaatcccagcactttgggaggccgaggcaggcggatcacctgaagtcaggagttcgagaccagcctagccaacatggtgaggccctgtctctactta

SEQ ID NO: 211862 - DNA, 493 bp, Homo sapiens
gggttcaagcgattctcctgcctcagcctcctgagtatctgggattacaggcgcgcgacaccacgcccagctaatttttgtatttttagtagagacgcagtttcaccacgttggtcaggctggtctcgaactcctgacctcatgatctgccaccccggcctcccaaagagctgggattacgggagtgagctaccgctcctggccgcttctatatgaaaaaacacacatcttcttgccatcatctttaaataagttaaaaaaaaaaaaccttcttacatggcaaatgttcagggttgtactaaaataatgaccttatttggacactttctaaagtttgaattggtttaattctgcaaactgcatttgtaaaggtaagaattaactgtcaagatagagccagtctgctgctaagataaattcccttaataaacatttccattttattttaagcagggagctttatctttaaatactgtaaaaaattacatctcag

SEQ ID NO: 211863 - DNA, 392 bp, Homo sapiens
gctgcatgagaagggctggccgctccttaaagcaaagcctgactcctgttagcagaaggggcaatgaatgctgagcaggcgaaaactagatgttcactgcctcattccagccagatgtcgtcagtgacctgtgctcccgagcttcatttttgttttttaaaagactctttagtttatctttatttatttattttagagatggggtcccactctctcacccaggctggagcacagtgctgcgatcatagctcactgcagccttgaactcctgggtgctagtggtcctcctgactacaggcacgtgccaccaggcccgctaatttgttttgttttgtttcgttttttgcaacagagtgagaatctgtctcaaaaaaaatttttttttaaatagt

SEQ ID NO: 211864 - DNA, 622 bp, Homo sapiens
ctggacatggtccaacaatgatacatttttatatgtggtgagttagataataaattttagaggacagtgcagtatagtggtgaaatgtatgaactgtgaagccagaagctatatgattatatgattgtctctgggcaagttatttcacctctcagtgccttggtttcctcatctgtaaagtaagcatgattatcatacttacagagttgttatcagtgagttaatatatgtacaatgcttacaatagtgactaatacataataattattatgtgtttgctacaataataataacattaatattatcatttttaacttaaagctctaagccatgatagtgtatctgaaacatggaaggatggaaagtattcagtaacatttagtaagtaaattaataatcaagttaggtccctattgtacagtctcataatacccagaaactttccctttgtaacctttttctaacttgttcaatgtctctctgactaaactgtaggatccatttgtgcaaggaccacatccaccgtgttcactactataaccctagcatcaagtaccatgccaagcacttagcaggcacatgtatatttgttagacataaaggttatagaggttatatatac

SEQ ID NO: 211865 - DNA, 294 bp, Homo sapiens
  misc_feature (91)..(91): n is a, c, g, or t
  misc_feature (128)..(128): n is a, c, g, or t
  misc_feature (263)..(263): n is a, c, g, or t
cattagcagactcaagaaaaaaaaccacattatcatatcagtagatgtagaaaaaaaaatttaacaaaatccagcacccattcacaatganaaatcccagtaaattagaaatagaaggtaacttcctncaaattgataaggaatatctctaaaaacctacaactaaaatcatacttaatggtagaaaactagaagccttcccagtaagagtaagaacaagtcaaagatgtatgctctcaccaatgcttttcaacatcatattnggaagtcctagctagtgcaataagcaaaaaa

SEQ ID NO: 211866 - DNA, 415 bp, Homo sapiens
gtgtcactccagattttttggcatcaattgatctttttttttctttttctttctctcttctttctgcctttgccctttgcctttgccttgcaacaagttctcactatgttgtccaggctggtctcaaactcctgggctcaagcaatctgcccacctctgcctcccaaagtgctaggagtacaggcatgagccaccatgccaggcccaattggtctgcattgaagttgcagaggggagcttctgattgaccaggccttggtcacatgctcaggcctcacagaggaaggtgggtggttgtcaggggcgtctcactttttggtttctgtagtggcgggtgggcactgccttccacaagatgaatatggtgggaattcatcaaacgaaaggtatctcaaaaaatgttaggtagctaaaa

SEQ ID NO: 211867 - DNA, 326 bp, Homo sapiens
ataacaggttcccggtttccaaattcatgcacaactggtccaggaaccaatgacaactcgtgaattgtcaggatgtatttcacagtgaaaacccctccctaagatctctgtcccgtctatccatcatggccccatcaccagggtccaggccacctggcccctcacctggatctcccacaacagcgtagggcctggcacctggtagggggtccacagatatttgttgaatgaatgaatgagccccatctgctggtctccctgcctctaatactgactccctttctacctggccattactgtagccagcaacctaaactcaaacctga

SEQ ID NO: 211868 - DNA, 328 bp, Homo sapiens
cgataacagtagttggggtcatgccccctcattccttcagtaaattttaacggagcaccttttatgttccaggcactgcattcagttctggccattcaaattgcctaagacatggtctctaaccccggggactgaacttcccagagagcatttaaattttgtttcctgctgctctctaccccatctggttttcgggtcaggaatggtctggtctctctctctctctctttctttctctctctctctctctcaaattaaataccaactatgtactggacactaaagattacaaaatgaataaaactccgtccatgctcttgaagagctt

SEQ ID NO: 211869 - DNA, 212 bp, Homo sapiens
cttgggaggctgaggcagagaattgcttgaacccgggaggctgaggcaggcagtgagctgagatcgcaccactgcactccagcctgggcgacagagcgagactctgtctcaaaacaaacaaaaaaacccccaaaactttacatagtagacaggccgccaactgatagtgctatgcagtttagtttagcacttggactgacttaatttttagg

SEQ ID NO: 211870 - DNA, 510 bp, Homo sapiens
ggaaggaatgcagagtgaatacttaataagtacagagtttccatttaggagatgaagaaattctggaaccagatagctgcataacactgtgaacatccttaaaacaactgaattgtacactttaaattcgaaatggtaaacttacgtatattctaccacaatagaaaaagaaaagatcttattctgcataaatggaaaataaaaaggctgttttactcgtctaggataattgcaccagttttttttggaagcatgttaattgatttcttaaaactgtttccttattctttaagatgaaagaatcttggaagcacgctaattgatttcttaaaactgtttccttattctttaagatcacttttcataccatgtacattgactacaatgtctttcctaaaagtgttacattttgcatatgcatgtattaagttaaaactgtgtttggttacctatttgctaagtgcttctaaaaccatgaatggctatggaggaaaaaaaatctctatgttt

SEQ ID NO: 211871 - DNA, 548 bp, Homo sapiens
ttccctgtggggtgccttctatttactctgcagtctccctgatgcctggcacaccacactgacctccagatacccctgctccaggaagccatccatgatttccctgccatcatttttgctagttggtcactcccaggtctattgctgcctattttatactttaaaaatgtaatctctttatttctgtggtgacagattcaagaaacattagccaggatataaggtcatgagagtagggactgagttgatgttgatactgttgtgcacctagcttccaaaacagtgcctggtccctggtgggttatcagtagacatttgatgaataaatgagtgagtgaatgcatgaatgagtttgctgagcacccagtaataatagccaacatgcattaagcaccattgctagaccctgtgctaactgcttcatggcaactgtcctgtgaggtgggtactattatccccatttacacgggagaactgaagcttagaaaggtcagagaccggctgggcacggcggcttccacctgtaatcccagcactttgagaggctg

SEQ ID NO: 211872 - DNA, 332 bp, Homo sapiens
aaaatactagcaaactgaatccagcagcataacaaaaagctagtccaccaggccaggagcagtagcttaggcctgtagtctcagcactttggtagccaaggcaggtagatggcttgaggccaggagttcaagaccagcctgtgtaacatggtgagtacctatgtctaccaaaaaatttaaaaaattagctgggtgtggtggcacacacctgtagttccagctacttgagaagctgaggtggaaggatggcttgggcctgggaggcagaggttgcagtgagctgagattgggccatggtactccaacctgggcaacagagtgagaccctgtca

SEQ ID NO: 211873 - DNA, 258 bp, Homo sapiens
ggaggggtggagccaggggtaagatatagcaatgaacagacagacaaatattcccaccttatggagttacattcaggttggggaggtggcaggaggggagaagatccaacaatgagcaaacaaactagcaagtacgtcaaaatgtaaaaggtgctgtggaaaaactaatggctggaaggaagatagggagtgtgaaggtgatggtaggtttctgttttaaactgaggtattagagaagtcctcaatgtaaagatggca

SEQ ID NO: 211874 - DNA, 505 bp, Homo sapiens
ggagaagaccacatgtaagcatttaaatcataacagattcctggtatttatggctttaatatccaaatgatgagcaactcctacgagtctatgacagggaattgtctggaattgtatatagctatgaattttaattttgcaccactgattcttaagtgggcgggttgtctattcatccacatataatatgaggctttgttttgtacttgtcattacaataaactttgaagtgtttaacacattgtgtctttgtggagaaatggtcatcaagtaagacaattttagggaatactgaaaatgctcttagcttgagatgtagcaaattgtatcagaaacatgtcccttgagagcagtgtggctttgaaaatgctaggagttgggagaaagatttgtttttattaatgtggagaattgcaaaagttttagaaaatccacccaccatgtcaaagatcttgtgtgtagaatttttaaagaactgctatagtagagggcattaagattttta

SEQ ID NO: 211875 - DNA, 385 bp, Homo sapiens
acttatagtccttgaagtttctggtactttggctggaagcgttaatgccctcttgaagccttacctttctaaatgtcagcctcacattgtgatcttagaattttatttcctcactctgcatatccactcctactcacctagagcttcaggttgagaaacttagtaacttccttattgtgtgtgaatttggcttcgcctcactaaccctgttccctgatgtactttagagtcacatgcagtgacaaacttagtcacaattagtttcgtcttcaccaaagggaaattgagtagaaattgcaaccaagattttggctaatagatttcacttattttagtgaaatatcattcaaaagtcgtctctaactgtctgactagaacactccca

SEQ ID NO: 211876 - DNA, 307 bp, Homo sapiens
tatagtcccagctgctcgggaggctgaggcaagaatatcgctggaacccaggaggtggaggttgtggtgagccaagattgtgccattacactccagcctgggtgacagagactccgtctcaaagaataagacagagagagaaagagaaaagaaaagaaaaagatattttacaaaataactggccagtactcttcaaaagtgtcaaagtcctaaaagataaaaaggattaaagaacactcaaagatggaaggagactaatgaaacaatacaattcaatgcaggaccttggattggatcctgaaacagt

SEQ ID NO: 211877 - DNA, 98 bp, Homo sapiens
tcccccaccctggtaagtcgggctggctcacttctccctgcaaaccagtttggtgtggactgctcctgccctgagtcacagcggccactgccggcaag

SEQ ID NO: 211878 - DNA, 604 bp, Homo sapiens
gtgacaatcttttgtggttcagtttcttcatccacaaaacggaggaaataacactacttcacagagatcttgtgaaaggcaattaaagtgttccctgtaaagcacttagaacaatgcctggaatagtcgccactcagtccgtggtgactctttttattactatagcaatgcctagtttaattgacaccaaccaaaatgagtgtcggttatatgggtggtaatgaaagggagtgcaattaactggcaaggtcagaagtagggtaagttaattcaatcttctggttaataggtgccatgtggaatctacctatgttctagggattgttattttcagtaataataattgcaattaagtcctcaactttaccattgaactgaatatgttgttgtccccagtcatatcaaatggtgaagaaacatctctaaagagccaggaaaaactactgacataactgtgtggtcactaattaaaggcaaagatattgattaatggaataatgaaaatgtctgatatataactggatactttatgtgtggaaacaacactgagatctctgcagcaaagttttggtgcagaaagcttgtattagggatttccagagtt

SEQ ID NO: 211879 - DNA, 392 bp, Homo sapiens
agtagtcattgaatgtcaattatgtctactcttcattatgtctctaagttgacagagaccttaacaggttgctaagcctctctggacctcagttttctcgtctgcaaaatgagtcccttagaatgaataatctctaaggttgattctcaaactaataaaattatatgaatccgtgacctatttcagaatgatgttgctgttttacataatggcttgcattgaatatttaaaccatctatagtcactgggttcagacaactaaatattaggtggggcaccatggcttacacctgtaatcccagcactttgggaggctgaggccgtaagagtgcttgagccccagagtttgagactagcctgagcaatatagtgagactcagtttctattattt

SEQ ID NO: 211880 - DNA, 451 bp, Homo sapiens
ctatttactgagcatttactaaatgatatatatatacacacacagatgtgggaaatattgctaatttacaaaagaggaaactggtttgtagccaatttgcatgatgtaaatgttcccaccatggccaattgcaaacaacaaatgtagtatcaatgaaaatggaattgggaagatacacacataatgggctgtcattgggctggtacaagccaggtccagcatatccctgggactagggacattaagtgagtcatagtttaggaactaaacacagaaagtcttgattttagacttgtgtacttaaccaagttgctgcactacttttatgatagttttcagctcaaataagcctacatataatactacatatttaaaagaccacagagcaactctttgtgagagagaggaactaggattactcttctggcttctagaaagtgattctacaact

SEQ ID NO: 211881 - DNA, 393 bp, Homo sapiens
gctggcaagatttgggagggatggagcagacctgggcagtcagtaataatcaagggaagccaagtaaactccagagtcttacctctggctcacagctgcttttgtgatacacaaagtcacaaagaggaaaagggaagggaggaggttgcttttcaaaatgcattcaccatggctcactgtgtggggcatgattgcaggcctgagctcatgaaagactgtccaagattttgtggtttcaacctctcttcagcctgaaaattccatccagtcgatttgtcacagatcaggatcttcctgtcccctgcagcccatggggacttcctagaaatagatatgatatgttgtagatgtggttaaaacaaatccaggccccattgtttattcagctcatta

SEQ ID NO: 211882 - DNA, 1196 bp, Homo sapiens
gcggaagcggcgccattcgtcttccgagcgctactgccagctgatgccgggagctaactaccgcgccggggccggggccggggccggggcccgacgtccccgcggggcccgggaccgcgaggaggacggcgggggcctggagcccgcggccgtggcccgcgacctattgaggggcacatctaacatgtcatttgaggagctgttggaattgcagagccaagtggggactaagacgtacaaacaattggtagctggaaatagtcctaagaaacaagcttctagaccacctatccaaaatgcatgtgttgcagataagcacaggcctctggaaatgtcagccaagatccgagtaccatttttacgtcaggttgttcccattagtaaaaaggtagcccgggaccctcgctttgatgatctgtcaggggaatataatcctgaggtgtttgacaaaacataccaattcttgaatgacatccgagcgaaagagaaagagcttgtgaaaaaacagttgaagaagcacctttcaggagaggagcatgagaaactgcagcaactgcttcagcgaatggagcagcaagaaatggcacagcaggaacgaaagcaacagcaggagctgcacctggccctgaagcaagaacgtcgggctcaggcccagcagggccatcggccatacttcctgaaaaaatctgagcagcgccagttggcactagctgagaagttcaaggagctgaaacgcagcaagaaattggagaacttcttgagtcgaaagaggcgacgaaatgcaggcaaggacaggagacatctccctttgagcaaagagtaataaggaactatcctctgctctgccactgccccagggagacatggatctgtgaggacagatttggccacggctggtttccgttcaagggcaaggatcacagctgcccttgaatctcattgcctcagagaagactagagggctcttggactatccctagggctacacaagaatagttcagccttctgccatgccacacagcctcagcttgaatctggttcattgcgtcctcgtgttcttctctcatccttgccttaaaccagggattctgataccgaagaagaggggccaatgaaaaccatggagtctgttcgtgactcccagggctgggacattatgtaggagccacttcataaacattctctttactcatctt

SEQ ID NO: 211883 - DNA, 1178 bp, Homo sapiens
gcggaagcggcgccattcgtcttccgagcgctactgccagctgatgccgggagctaactaccgcgccggggccggggccggggccggggcccgggaccgcgaggaggacggcgggggcctggagcccgcggccgtggcccgcgacctattgaggggcacatctaacatgtcatttgaggagctgttggaattgcagagccaagtggggactaagacgtacaaacaattggtagctggaaatagtcctaagaaacaagcttctagaccacctatccaaaatgcatgtgttgcagataagcacaggcctctggaaatgtcagccaagatccgagtaccatttttacgtcaggttgttcccattagtaaaaaggtagcccgggaccctcgctttgatgatctgtcaggggaatataatcctgaggtgtttgacaaaacataccaattcttgaatgacatccgagcgaaagagaaagagcttgtgaaaaaacagttgaagaagcacctttcaggagaggagcatgagaaactgcagcaactgcttcagcgaatggagcagcaagaaatggcacagcaggaacgaaagcaacagcaggagctgcacctggccctgaagcaagaacgtcgggctcaggcccagcagggccatcggccatacttcctgaaaaaatctgagcagcgccagttggcactagctgagaagttcaaggagctgaaacgcagcaagaaattggagaacttcttgagtcgaaagaggcgacgaaatgcaggcaaggacaggagacatctccctttgagcaaagagtaataaggaactatcctctgctctgccactgccccagggagacatggatctgtgaggacagatttggccacggctggtttccgttcaagggcaaggatcacagctgcccttgaatctcattgcctcagagaagactagagggctcttggactatccctagggctacacaagaatagttcagccttctgccatgccacacagcctcagcttgaatctggttcattgcgtcctcgtgttcttctctcatccttgccttaaaccagggattctgataccgaagaagaggggccaatgaaaaccatggagtctgttcgtgactcccagggctgggacattatgtaggagccacttcataaacattctctttactcatctt

SEQ ID NO: 211884 - DNA, 505 bp, Homo sapiens
gcctactactactactactactaaattcgcggccggtcgaccaaggagctgaaacgcagcaagaaattggagaacttcttgagtcgaaagaggcgacgaaatgcaggcaaggacaggagacatctccctttgagcaaagagtaataaggaactatcctctgctctgccactgccccagggagacatggatctgtgaggacagatttggccacggctggtttccgttcaagggcaaggatcacagctgcccttgaatctcattgcctcagagaagactagagggctcttggactatccctagggctacacaagaatagttcagccttctgccatgccacacagcctcagcttgaatctggttcattgcgtcctcgtgttcttctctcatccttgccttaaaccagggattctgataccgaagaagtggctcctacataatgtcccagccctgggagtcacgaacagacttcatggttttcattggcccctctggcgacgcggcccg

SEQ ID NO: 211885 - DNA, 484 bp, Homo sapiens
tagtttaaaatagtctcaagtaggctgggcgtggtggctcacacctgtaatcccaccactttgggaggcagaggcaggtggatcacgaggtcaggggttcgagaccagcctgaccaacatggtgaaaccctgtctctactaaaaatacaaaaattagccgggtgtggtggtgggcgcctgtaatcccagctactcaggaggctgaagcaggagaattgcttgaacgcgggaggcggaggttgcagtgaaccaagatcgcgccactgcactccagcctgggcgacagagcgagactccgtctcaaaaaaaaaaaaagtctcaagtagatagtgtctccagggtcctggcagaagcaaatgtaatcctttcttgaggattgttttttttttgtttgttttttgtttttgagatggagtctcactctgtcgtccagactggcaaaaattaaaatgtgagaagtataaaataaaaaatacaaaatgtc

SEQ ID NO: 211886 - DNA, 1405 bp, Homo sapiens
gcggaagcggcgccattcgtcttccgagcgctactgccagctgatgccgggagctaactaccgcgccggggccggggccggggccggggcccgacgtccccgcggggcccgggaccgcgaggaggacggcgggggcctggagcccgcggccgtggcccgcgacctattgaggggcacatctaacatgtcatttgaggagctgttggaattgcagagccaagtggggactaagacgtacaaacaattggtagctggaaatagtcctaagaaacaagcttctagaccacctatccaaaatgcatgtgttgcagataagcacaggcctctggaaatgtcagccaagatccgagtaccatttttacgtcaggttgttcccattagtaaaaaggtagcccgggaccctcgctttgatgatctgtcaggggaatataatcctgaggtgtttgacaaaacataccaattcttgaatgacatccgagcgaaagagaaagagcttgtgaaaaaacagttgaagaagcacctttcaggagaggagcatgagaaactgcagcaactgcttcagcgaatggagcagcaagaaatggcacagcaggaacgaaagcaacagcaggagctgcacctggccctgaagcaagaacgtcgggctcaggcccagcagggccatcggccatacttcctgaaaaaatctgagcagcgccagttggcactagctgagaagttcaaggagctgaaacgcagcaagaaattggagaacttcttgagtcgaaagaggcgacgaaatgcaggcaaggacaggagacatctccctttgagcaaagagtaataaggaactatcctctgctctgccactgccccagggagacatggatctgtgaggacagatttggccacggctggtttccgttcaagggcaaggatcacagctgcccttgaatctcattgcctcagagaagactagagggctcttggactatccctagggctacacaagaatagttcagccttctgccatgccacacagcctcagcttgaatctggttcattgcgtcctcgtgttcttctctcatccttgccttaaaccagggattctgataccgaagaagaggggccaatgaaaaccatggagtctgttcgtgactcccagggctgggacattatgtaggagccacttcataaacattctctttactcatctttttattctgttttttgtggccttctttttgtgtttcccccccgaaacagagtctcgctctgtcacccaggctggagtgcagtggtgcgatctcgcctcactgcgaacctccacactcccagggtacgggtgattcttgtgtgcctcagacttcccagtagctgacatccgccaccaagcccagctaatttctttcgtatttttagtaga

SEQ ID NO: 211887 - DNA, 1327 bp, Homo sapiens
gcggaagcggcgccattcgtcttccgagcgctactgccagctgatgccgggagctaactaccgcgccggggccggggccggggccggggcccgacgtccccgcggggcccgggaccgcgaggaggacggcgggggcctggagcccgcggccgtggcccgcgacctattgaggggcacatctaacatgtcatttgaggagctgttggaattgcagagccaagtggggactaagacgtacaaacaattggtagctggaaatagtcctaagaaacaagcttctagaccacctatccaaaatgcatgtgttgcagataagcacaggcctctggaaatgtcagccaagatccgagtaccatttttacgtcaggttgttcccattagtaaaaaggtagcccgggaccctcgctttgatgatctgtcaggggaatataatcctgaggtgtttgacaaaacataccaattcttgaatgacatccgagcgaaagagaaagagcttgtgaaaaaacagttgaagaagcacctttcaggagaggagcatgagaaactgcagcaactgcttcagcgaatggagcagcaagaaatggcacagcaggaacgaaagcaacagcaggagctgcacctggccctgaagcaagaacgtcgggctcaggcccagcagggccatcggccatacttcctgaaaaaatctgagcagcgccagttggcactagctgagaagttcaaggagctgaaacgcagcaagaaattggagaacttcttgagtcgaaagaggcgacgaaatgcaggcaaggacaggagacatctccctttgagcaaagagtaataaggaactatcctctgctctgccactgccccagggagacatggatctgtgaggacagatttggccacggctggtttccgttcaagggcaaggatcacagctgcccttgaatctcattgcctcagagaagactagagggctcttggactatccctagggctacacaagaatagttcagccttctgccatgccacacagcctcagcttgaatctggttcattgcgtcctcgtgttcttctctcatccttgccttaaaccagggattctgataccgaagaagaggggccaatgaaaaccatggagtctgttcgtgactcccagggctgggacattatgtaggagccacttcataaacattctctttactcatcttaaaaaaaaaaaaaaaaaaagaaaaaaaacatttgttgggcggcttctgggcccatcggaaaaggttttttaaacccttcggttggggcggcggggcccaagggggttcgtggccacgggtccaaaggcggt

SEQ ID NO: 211888 - DNA, 517 bp, Homo sapiens
gcctactactactactactactaaattcgcggccggtcgaccaaggagctgaaacgcagcaagaaattggagaacttcttgagtcgaaagaggcgacgaaatgcaggcaaggacaggagacatctccctttgagcaaagagtaataaggaactatcctctgctctgccactgccccagggagacatggatctgtgaggacagatttggccacggctggtttccgttcaagggcaaggatcacagctgcccttgaatctcattgcctcagagaagactagagggctcttggactatccctagggctacacaagaatagttcagccttctgccatgccacacagcctcagcttgaatctggttcattgcgtcctcgtgttcttctctcatccttgccttaaaccagggattctgataccgaagaagaggggccaatgaaaaccatggagtctgttcgtgactcccagggctgggacattatgtaggagccacttcataaacattctctttactcatctt

SEQ ID NO: 211889 - DNA, 706 bp, Homo sapiens
gcggaagcggcgccattcgtcttccgagcgctactgccagctgatgccgggagctaactaccgcgccggggccggggccggggccggggcccgacgtccccgcggggcccgggaccgcgaggaggacggcgggggcctggagcccgcggccgtggcccgcgacctattgaggggcacatctaacatgtcatttgaggagctgttggaattgcagagccaagtggggactaagacgtacaaacaattggtagctggaaatagtcctaagaaacaagcttctagaccacctatccaaaatgcatgtgttgcagataagcacaggcctctggaaatgtcagccaagatccgagtaccatttttacgtcaggttgttcccattagtaaaaaggtagcccgggaccctcgctttgatgatctgtcaggggaatataatcctgaggtgtttgacaaaacataccaattcttgaatgacatccgagcgaaagagaaagaggtatacagcttgagactggtttatggggaattttgtggggtggaaaatgagggcacaggttagagagttgggcagggggagtgggaagtatagtggtgggcagatttaactctctccaattcagttcatattcaaatcctggctcatcagtttactagctgtgtgattattggcatgttacttaatctctctatgctttagttttctaatcat

SEQ ID NO: 211890 - DNA, 481 bp, Homo sapiens
ctgaaatagttggagagtttaacactatcacagcctctgctgcctaggacttctaataatgattggtctgatggggtattaggattagctagctaaggaatggggatgggaagatgtcttttctgcagtgggacatgctgagctgagttgtatgtccctccccacttccacaggcacatctaacatgtcatttgaggagctgttggaattgcagagccaagtggggactaagacgtacaaacaattggtagctggaaatagtcctaagaaacaagcttctagaccacctatccaaaatgcatgtgttgcagataagcacaggtaagcaaggcttgccctagaagttggaagataactgggaccttgaataggtatgttgtcttgggtgacaggtgggaagcctttgaccaacactggagtcctcttgacttggcttttaatttctccataggcctctggaaatgtcagccaagatccgagt

SEQ ID NO: 211891 - DNA, 993 bp, Homo sapiens
ctggaacacactttgtagaccctggaacgcaactcgaaaaccccaagcgctggaactcactttgtagaccctgtaacgcaactcgacggccccaagcgcgcttggggctttcgagttgcgtctgtacggaactgcccatagagatgtccagtaggtaataccaatacagatctaaagtctgggggaagttgggggttggagctacgtatttgggaatcaccagcatatcagcagcaattgaggacatcaggatgaatgactccattttgggagtaaatagaaaggaaagacttgtgaaaaaacagttgaagaagcacctttcaggagaggagcatgagaaactgcagcaactgcttcagcgaatggagcagcaagaaatggcacagcaggaacgaaagcaacagcaggagctgcacctggccctgaagcaagaacgtcgggctcaggcccagcagggccatcggccatacttcctgaaaaaatctgagcagcgccagttggcactagctgagaagttcaaggagctgaaacgcagcaagaaattggagaacttcttgagtcgaaagaggcgacgaaatgcaggcaaggacaggagacatctccctttgagcaaagagtaataaggaactatcctctgctctgccactgccccagggagacatggatctgtgaggacagatttggccacggctggtttccgttcaagggcaaggatcacagctgcccttgaatctcattgcctcagagaagactagagggctcttggactatccctagggctacacaagaatagttcagccttctgccatgccacacagcctcagcttgaatctggttcattgcgtcctcgtgttcttctctcatccttgccttaaaccagggattctgataccgaagaagaggggccaatgaaaaccatggagtctgttcgtgactcccagggctgggacattatgtaggagccacttcataaacattctctttactcatctt

SEQ ID NO: 211892 - DNA, 943 bp, Homo sapiens
gcggaagcggcgccattcgtcttccgagcgctactgccagctgatgccgggagctaactaccgcgccggggccggggccggggccggggcccgacgtccccgcggggcccgggaccgcgaggaggacggcgggggcctggagcccgcggccgtggcccgcgacctattgaggggcacatctaacatgtcatttgaggagctgttggaattgcagagccaagtggggactaagacgtacaaacaattggtagctggaaatagtcctaagaaacaagcttctagaccacctatccaaaatgcatgtgttgcagataagcacaggcctctggaaatgtcagccaagatccgagtaccatttttacgtcaggttgttcccattagtaaaaaggtagcccgggaccctcgctttgatgatctgtcaggggaatataatcctgaggtgtttgacaaaacataccaattcttgaatgacatccgagcgaaagagaaagagcttgtgaaaaaacagttgaagaagcacctttcaggagaggagcatgagaaactgcagcaactgcttcagcgaatggagcagcaagaaatggcacagcaggaacgaaagcaacagcaggagctgcacctggccctgaagcaagaacgtcgggctcaggcccagcagggccatcggccatacttcctgaaaaaatctgagcagcgccagttggcactagctgagaagttcaaggagctgaaacgcagcaagaaattggagaacttcttgagtcgaaagaggcgacgaaatgcaggcaaggacaggagacatctccctttgacaaatgtaatcctttcttgaggattgttttttttttgtttgttttttgtttttgagatggagtctcactctgtcgtccagactggcaaaaattaaaatgtgagaagtataaaataaaaaatacaaaatgtc

SEQ ID NO: 211893 - DNA, 434 bp, Homo sapiens
gcggaagcggcgccattcgtcttccgagcgctactgccagctgatgccgggagctaactaccgcgccggggccggggccggggccggggcccgacgtccccgcggggcccgggaccgcgaggaggacggcgggggcctggagcccgcggccgtggcccgcgacctattgaggggcacatctaacatgtcatttgaggagctgttggaattgcagagccaagtggggactaagacgtacaaacaattggtagctggaaatagtcctaagaaacaagcttctagaccacctatccaaaatgcatgtgttgcagataagcacaggtaagcaaggcttgccctagaagttggaagataactgggaccttgaataggtatgttgtcttgggtgacaggtgggaagcctttgaccaacactggagtcctcttgacttggc

SEQ ID NO: 211894 - DNA, 583 bp, Homo sapiens
atttttttctgtatttagattttctttactattttttgtccatttgatgcaaacttcttcagctgtgtagaaactttatgaatagataagtgcttgagtgtctctggtctctaaagtggctggttttattctttcttcaaagttaataacatgtttcaagatttttggacaaaatattatggtacgtcatagagaaaagcagcgtgaattatatttaggtatagcaagtcagatcctttgaagtgactctgtctctgttcttagaagggttcttggaattggttgtggtttgaatctttctactgtcagaggagacccactaaaaaccagaatctgcataaagctttctttacttaacacactgaagctataggtgagccatcccatgtcagactttatactcaaagaaggaaaagccaagttgcagtgagcgggtaagacagctcagatccgaatgaaaatggggtctgaataagtaacccaagggagctgccctctagtcgggcagctagtattgcttccttgcatggatacataggagggatacattatagattaataaatgatagtgagataaacaaga

SEQ ID NO: 211895 - DNA, 185 bp, Homo sapiens
gaatcttcattggctagcccagtgcccagcacataggcacataatagtttctcaataaatattagttgcattcgggacaaattaatgatagcacctatgttcagataggtgtgtgtgcatgcatccattctagcctttctgtagaactgaatcccaggtgtggagtactgccatattgccttcca

SEQ ID NO: 211896 - DNA, 537 bp, Homo sapiens
cttttcccagatgaagctgaccagcggcagtatgaggagtggctgttccatacccagcagctcctacagatgcagctgaaggtgctagaggagcagattggtgtacaccgcaagtcccggaaggctctgtgtgccaagcagcgcactgccaaaaaagctggccgtgagttcccagaagctgatgctgagaagctcaagctggttacagagcagcagagcaagatccagaaacaactggatcaggtccggaaacagcagaaggagcacactaatctcatggcagaatatcggaacaagcagcagcaacaacagcagcagcagcagcaacaacagcaacagcactcagctgtgctggctctcagcccttcccagagtccccggctgctcaccaagctccctggtcagctgctccctggccatgggctgcagccaccacaggggcctccgggtgggcaagccggaggtcttcgcctgacccctgggggtatggcactacctggacagcctggtggccccttccttaatacagctctggcc

SEQ ID NO: 211897 - DNA, 639 bp, Homo sapiens
cttttcccagatgaagctgaccagcggcagtatgaggagtggctgttccatacccagcagctcctacagatgcagctgaaggtgctagaggagcagattggtgtacaccgcaagtcccggaaggctctgtgtgccaagcagcgcactgccaaaaaagctggccgtgagttcccagaagctgatgctgagaagctcaagctggttacagagcagcagagcaagatccagaaacaactggatcaggtgggggaaagcaaacttcagcctagcacccagaaggcagggaagagggttggcatggggggagcatgccccagcctgacctctccgaccctcccatgttaggtccggaaacagcagaaggagcacactaatctcatggcagaatatcggaacaagcagcagcaacaacagcagcagcagcagcaacaacagcaacagcactcagctgtgctggctctcagcccttcccagagtccccggctgctcaccaagctccctggtcagctgctccctggccatgggctgcagccaccacaggggcctccgggtgggcaagccggaggtcttcgcctgacccctgggggtatggcactacctggacagcctggtggccccttccttaatacagctctggcc

SEQ ID NO: 211898 - DNA, 998 bp, Homo sapiens
aggtagaattagacaaattttgaagttatttacatcccacaacatggatgaaccttgaggacattatggtaagtgaaataagccagtaacaaagacaaatattgtgtgattacacttacatggaatacttagtcaaattaataaagatagaaagtagaatggtagggctggaggaagggtggtatagggagtgattaatggatacagagtttcagttttgcaaaaattttatatatcttaacacaatttaaaaacaaaaaccttctgaaatacagtaaaactgcaaactgtattgagtgctgtcacttaccacagggtgctatgagaaataaaacctaacaagtttaaagtggaaaaaataatttttaagttgctgaagtcatcccagtgaacactaatgaaggcttaaacgaatattggcagccagcaagaacaaacaagccagatttgagcgatagagtcagcagttcttataaaaagaagggatttaagaagagtcagaaatgtgttttgaggtttttttgcctgggggttggggagctgaagctggtactgaaaaagagaataagtgagttctgaaaagaattaaatttaatctttgacattctaagtataaatatgttagtagaacatcctcttaaaaatgtgaggccagcagtagaaatttggaatttgataacatttaagagttgcacaggccaggtatggtggttcctgcttataatccgaacactttgggaggctggagcaggaggattgctttagaacaggagttcaagaccagcctggacaacatagcaagattccagctctgcaaaaaattaaagaaaaactagctgggcgtggtggcacacacctgtagtcctagctactcaactaggctgaagtgggagggttgcctgagcccaggagttcaaggttgcagtgaactgtgattatgccactgcactccagcctgggcaatggagtaagactctgtccctaaaagttaaaaaaaa

SEQ ID NO: 211899 - DNA, 543 bp, Homo sapiens
ctgttcctctggctgagggcctcgcatccacccacctgcagaccatcacagcaccccagtgagcagacggtggtttaagagcagcaaaacaggatgaggcaagagggatggaggcagcatggcggtggtgagggagaatgcagactcgagagctagtcaggaagcacgtgtagggcttggtgacggagagtgtgacagggatggctgaggaggtggtactgctctcaggcctcttgtctggcttgaataactggggaagcattcacagcagtgccacctccagccaaaaaccctgtgtgaatgcaaagcagttatactgctggccttttggagatgactacacaaatctcttcctctttcactgtcttgaagcaggaattccaaacctgccaccacaccccggccctgcctgtggggtagcatcagccacaaatgacttcacagcaaacaaagggatgccctccatttctgcagcctcagttactccacaaagcctacctcttctaaacaatagagaagatctgaaatgaaacccagggagct

SEQ ID NO: 211900 - DNA, 445 bp, Homo sapiens
agttatgttacggcataaatattcactcattggtaatgaatgataacacatacagaaaggctgcatgatattgctgaattgtaagaattttccgtaaagttgcttcttgggccattctagtttacatctaatttaataaatttagcaatttggagaacatctgcaggactgatgtaagtactgaaagtggaagtgtcagggaggcagcagaagcaggtgcttcctgatattaaccagagacggtcctggcacagatggggccgtgtgaatcacatgcagacatacgtatgcactcacgtgcgtgccattattttcatgtggaggtcaaacagtcagaaacgtttgggaagtgctgtgtaatgctaactgttcgtgcataatgttttcccatttagtaagtgctgttgcatgtgttttctgtgattctcaccacagcccaatgcaa

SEQ ID NO: 211901 - DNA, 405 bp, Homo sapiens
cttgtgatccacctgcttcggcctcccaaagtgctgggattacaggtgtgagccaccatgcccggcctgtttaacaattcttttacttcctgacatttagtttatatcaattataagtaatgttgtaatgaacatcctttgtacagaaagctttatttccttaggagtaaattcctagagacagaattactgagacaaagtatatgaatatctactttccaaaaggaagcctttttatgactataaattacatattttatgtttaaaagtaccaaataaagtataaaaaggaaaataaaaactgcctaataattgcacccatcagaggtaacagtcaatactttggtgaatactctttcgaaatatctaagtgttatgtgctcacttgtaaattctctctttttt

SEQ ID NO: 211902 - DNA, 148 bp, Homo sapiens
tcaagtgtcttctacatttgtccaattttgtgttgaatattttgaaagcacccctgcatatgcgtgtatgtgggtacagagacatatgtgcaatgtgatccttcatgttggttatcgtaaaaaaacaaacaaaaaaacactttttaga

SEQ ID NO: 211903 - DNA, 547 bp, Homo sapiens
catttattttctctgttagattttgaatagtttgggacaggaatatatattatttatctttgtgtacaatcatagagtcatttagagttttcaaggaaaacaaaacaaaaaattatgttgaagagataaataattcaaaggcatgtgcctcttgaggttttcctaattcgttgaacagagggtgtagtttccattaaataaaatggtcgccaaatgaataaagaaaactctctaatcatattatcttaatagtaggggaccagaaattagttatgagattgaaggcttcagtatgtggtatctcatctttctctgtttcagaacctcagagcttttttgttgttgttaatattaaatagttgtggtttgaaaaggcactgttattttctgggaggaattctttcctggatcctgtaacctccttgaaaacatgggacataccttgatcatcattgcatttcttgtatttaataaatgtttttttttggctggctagctggatgatggatgaactaataaagagcatgtgaccttgggcaagttattt

SEQ ID NO: 211904 - DNA, 1123 bp, Homo sapiens
ctcattgtactcccttggcatctcatggtgacgtgacttagaaggtggtgcagagacgtttgaaactattgctttgctgaaaacatctgactgccaggctaggatgtgacacttaagggacttaccaatttgggattcttccaggagctgaaaactgattgcaaatatgaaacagatttcactacaggacttgaaccctacattaaaaaacaacaagctccccaaaataattgaaaaagatcttcaccaaagagtagctgcaatgtgaatggcaggatatgaagcaagtaagagatggtgaaaagattatcttaagcttggaattaagtgatgaaagggaccttcgaaattatcaactctaaatacttctttacaggaaaattgaaagcagttaagaacctgccccctaccgtggagttcttggtgccgtgagttggagttcttggtgcctgggtgcgtccccaaggccactggtcttcagatctttcttacttgagaagaacgcctccgcctcctggctctcccaccagtggtattgccaccaccacacaccagcataaagcacagattgctgcccagctccttggagaggggccagtgcatttgtcaggaattgaaaagttttggagccagttcgaggactttctgctgcacaaagtgttggctggaagcatgaagcaataacacatggtttgccaaagaatctgcattgaataatactggtggtgaccacaagaacatgcctctctgactgcaaggaacaagagtgacccagggtttcagctgctgccttggaaattcatcacagtgcaagtctatgcttcccacgggctgctcccagcctgtgaataagcctggcatctttgttgaggcaggcctatttctggagatgcaggatcctccgatgggcgaatttggctctaggactgcttgatggccttgacagactttccttagaaatgcatggcaatttagggttcctccacccttccctctttctctccttcacctagggtcggacttgcatcatggcctgaaagctccaccagcctctcctgccctcctcctcattttctttcacaggcatatcctctaataaatttcttgcacattgaatctcatc

SEQ ID NO: 211905 - DNA, 1000 bp, Homo sapiens
  misc_feature (978)..(978): n is a, c, g, or t
tgcgccgaccgccggccccgagccgccgcgggctccgaggagtcggccgagctgctcccgcgccctggccggacgtttgaaactattgctttgctgaaaacatctgactgccaggctaggatgtgacacttaagggacttaccaatttgggattcttccaggagctgaaaactgattgcaaatatgaaacagatttcactacaggacttgaaccctacattaaaaaacaacaagctccccaaaataattgaaaaagatcttcaccaaagagtagctgcaatgtgaatggcaggatatgaagcaagtaagagatggtgaaaagattatcttaagcttggaattaagtgatgaaagggaccttcgaaattatcaactctaaatacttctttacaggaaaattgaaagcagttaagaacctgccccctaccgtggagttcttggtgccgtgagttggagttcttggtgcctgggtgcgtccccaaggccactggtcttcagatctttcttacttgagaagaacgcctccgcctcctggctctcccaccagtggtattgccaccaccacacaccagcataaagcacagattgctgcccagctccttggagaggggccagtgcatttgtcaggaattgaaaagttttggagccagttcgaggactttctgctgcacaaagtgttggctggaagcatgattatctcacacagagcgttggaattacttcatgatgatttcaaagaaaattttcttctctaaacactcttatcccaagggcatcctaaagttcctctggaatgcattgggtgggagagaaagttctatgtcaactcttctggcagagggaaaagctgaccgaggaagtcaaaatgaaagaaagaagcagacaggactgaggctccctgagatgcagaaactgaggcacagagcaaggatgtgccacagcagaagcaagttgtgttggcagtaggaaacaagatanagagaggactcaaagaattgag

SEQ ID NO: 211906 - DNA, 155 bp, Homo sapiens
ttttgagtatgtggaagctctgttgttacacgtgtacacatttgtgattgtaatgtcttcctaaaaattcacccttttctgtcttgtagtattctgtccaaaaatacacctgtttttttttttttttttttttgagacagtgtctcactctatcg

SEQ ID NO: 211907 - DNA, 568 bp, Homo sapiens
tgaaaagggaagaaccgctgctatgtgcctcgcctgatgaaattccaacatgtggagtgaaaaaggcaagtcacagaagcatatatactatacactaagaaatgacttatatgaaggttaagaatcagtaaaactcaagactgtcgtgtttacaaataataaatgggtattatggcaaaatcataagaacggcaaaggattcatgacttcaacttgactctgggtgctaagggggcaaacggctgtgagagtgagaggcatttctggataccctgggtgtgtattaatatcagctgtgcacatttatgctggttatcagaaaaattgtacattttactttatatacggttaattttgaaaggtagaaaaaaacaaaaagcaaacaggcaaaaccccccagattttctggttatagattcagaccccaaatgaatctaaataactgggctttgtgaagtttttagaccttaaaacgaaaggaacaaatctgaagggaacaactgggaggagttggatttgcttccgaggcgctgatctgaaggcgttcgtgagttgcccatacccacag

SEQ ID NO: 211908 - DNA, 524 bp, Homo sapiens
aaaaaataaaaatgaataagaagaaaatgaaataaaataaagccaaatcaaatttgtttacactaagcttaatcacagaaattacaaagttgatattcgaaaggagggaaaaatcttactgctattctgcaattattggcaggagaaatgatcatttaactagtaacattatcttttatgaatcaggataaaattattaggcttacatgactcaaaagggtttatatacagccaagaagcaataatctactaactactggctacgagcatgttgagataaattttaacaaattatttataaattaggtacagtaagttctcaaaatatctgcaatcccagtaaagaattgattgatcaaaaatgaacatacacattagacaatttttcaacaggcataataacttttcatacgctaggcatgttatagatatggtgccgagttccacactacctcataagacctgggcatctttaatcagcctggattctatatgtgaaaagaaagagctaagacattaaaaat

SEQ ID NO: 211909 - DNA, 309 bp, Homo sapiens
atctcaaaccatcagaataagctgtaaactctgagggaccctcacacactcccacagagcaagctggaccccatgtggagtttctctccttgacaaagccataaagccatggtcactggaacatgggtagaagttattatctggttgtgtgtgtgtgtgtgtgtgtgtgtgtgtgtgtgtgtgtgagagagagagagagagagagagagagtgtgtgtgtgtatgtatatagtttgaagcacagcctcagttttatagagtaaatacggccagaatttagcatgcaatatgttaagagaccctgacatg

SEQ ID NO: 211910 - DNA, 469 bp, Homo sapiens
tggggccacgccacgatggggacagcccaacgatgttaaggcagggtgtgacttcagatgagaggcatctgagctgaggcctaaaagaccaggtgttaggcaggaggaggtagggggagcgttggtaccacagggagaggaaagagcagcaggagtggggaggtggtggggagccaccagaacacagggacgcagtgggagacatggacaaaggtccaaagaggcaggctgccaggccttgcaggccaggatgtgaggggcaggtccaagggtcgctcagaggaggcacaaaagcaggttcactcaaagagtgacttgaggcaggaggaaggcagagcgcacctctctgtgctgtccctcgggacacccctcacacagaaccatccagtagccttccccacagtgccacggggacacctggtgatggcttcaagcctgtccttcatagggcagaaggccactgatgacc

SEQ ID NO: 211911 - DNA, 452 bp, Homo sapiens
catctatcactctataatcttatcttgttttgttttcctttactgcacttcttaatatttggaaattatgttttaaaaaatgatttcctatctgttttccttatgacaatggaagctccatgaagcggagatttgggttcatggagcccataaggcctcagcccataggagaaacagacaagttgtactggggattaaattccattaaattttccattaaattcatatctcgggtggatcataccttgcacatagtaggcacttgataaatatttgttgaataaattggtaatttgatattcacaggctttgtgagattggtggaaaggaaactgtattgtaaagatggccaggcatggtggctcatgcctgtaatcccagcactttaggaggctgagttggtgatccagcctaggctacggagagagaccccatctcttaaaaaaaagaaa

SEQ ID NO: 211912 - DNA, 531 bp, Homo sapiens
gtcagtattttctgtctagaaaatcccaaagaactttgtaaacgttctaccaagcaagtacaactggtcctccatatttgtgggtttcgcatctgtggattcaaccaactgcagatggaaaatatttgggaaaaaaatggatgattgtgtctatactgaatatgtacagatgttttgtcattcctccctaaacaatgcagtagaacaagtatttacataatgtgtatatttattaggtattacaagtaatctatagattatttaaagcatatggggggatgtgcctaggtaatatgcaaatactataccattttgtataacggacgagagcatttgtggattttggctctggtctgcagctcccagcgagaccaatgcagaaggtcggggatttctgcatttccaactgaggtacccagttcatctcattgggactggatagagagtgagcacagcagatggagggtgagcagaagagggtggggcgtagcctcacccacgaagtgcaaggaatgggggctttccctcccc

SEQ ID NO: 211913 - DNA, 544 bp, Homo sapiens
tattttacatgtgaatgcatctatcctccacccttctctctgctcattgtatatactccgctataagaattcacccactcccatggtttcaatgctgatgactcccaaatgtctacttttagctcagatctcacttcagtatccacctgcctattggatatttatatctacttggatatgagttgtggatatgtaccacgaacaacatattcaaaagttaactcattatctttagtgcttataatttgttctcttgtttgtttcctttctcagtgtgatttccaccaagttgcttaagtaagaatcctaagtgctatcgctggctctctttatctgccctgaggctcacatgtaatcactaaaatctgttaattttatgtcttgaatgtctctggaattcatccataatttcttcagcctattacaataactctggtctcttctcacctagatgactgcaacagctcctgtaatggtctgtcaccaataccgaatcttaaccctttcaatccattcccacacagcaaccagaatgaccttccta

SEQ ID NO: 211914 - DNA, 250 bp, Homo sapiens
atgctttccaatctaatactcattgttgaaatctgcagtgtctctcaggtcttacttaacttgtcctttctctagattatgtgactgctgtctgtcctccatccttaagcaattttctcctttttcagactctgtcctgattcccttgtcctcttcctatttctggaaatgctcttttcttttcctctactgactcttattcttttgcttaacatttaaatacctgcctggttctcctctccgtttatat

SEQ ID NO: 211915 - DNA, 390 bp, Homo sapiens
gttgcacagctccatgaatacactaaaagccactaaattacacacttcaaaagcaaacaaaatagagtaaaagtgtggaccgggcatggtggctcacgcttataatctcagcactttgggaagccaaggcaggagaatcacttgacccaggagtttgagaccagcctgggcaatatggcaaaatcccgtctctacaaaaaacaccaaaaaaaaaaaattagctaggtgtcatggcatttgcctgtagtcccagctacctgggaggctgaggtgggaggatctcttgaggttgaagcttagtgagctatgattgcaccactgcactccagcctgggcagcaagcaagaccctgtctcaaaaaaaaaagtgagaattctatgacatatgaat

SEQ ID NO: 211916 - DNA, 360 bp, Homo sapiens
gtgagccaccgcacccagcagaaggatatatttcttaacagaaattttcattatgattcccacgtgcatatctaaatagagaagtgcagaaaataaaatacaataggaattctagttcctcatccatctgccttgtgctgttagttggatgatatggtttatctcacggctgccagcacaaggctgatgggagaagatgggcctgtctgaaactctttttgtgatgttagtgttgacctaaaatgaagaagctgagtgaagagtttatttgggccaagcatgatgattgcaacccaggagcatagaccaagttgctcagcggcagttacaagtggatttttctgatgggacgaagatgcg

SEQ ID NO: 211917 - DNA, 587 bp, Homo sapiens
ctcaacagatcatcttcgggtgatgtgctgcctcacatctcagggaatcttgttccaagataatattcatacccctttcttcaaaatacaggctttggttttccactccattgaagaactgctgaagaataaatgtcttcatatgttttgccaactttgccacaagctgctttttgcgtccagctggccataggtcttttttattccctcctgcctggccccccgtcccgagatgcctggaagccatcatgttgaatctctttccatggaggtctgtttggctggcgtttcttcttgcttcagactggaatgccgattagccagtttcttggaatgattttaatctctcatctctccagcccatccatttgaagtaactaataggaccacaatgtcactgcatgagctcaccctttccttgctcaagaacaacgataatacttgtcagtgattgcaacagtggaggacagtgttggtgccagcgttccagtgactatttcaaggattaattttagtgtttctagaaagaagtagttcaaaagtcaggaaaaataaatgaaaataaatcttaaacagatttctaatag

SEQ ID NO: 211918 - DNA, 535 bp, Homo sapiens
tgaaatttaaggaaataggacagaaagttaaaaggtatatataaatgaagacattcataattgttgatacttgtgaaaaacagtttaaagcaaataaaaatatctaataaatagcgaggtaaataatgtatcaatctaatagaatattatacaccaattttaaattattgctgtcaagcccatgtggtgacatggaaagaaatattttaatatgagcttttaaaaaacctaccatttggccaggtgcggtggctcacacctgtaatcccagcactttgggaggccaaggcagacagatcacgtgagctcagaggttcaatatcagcctggccaacatggtgaaaccagtctctactaaaaatagaaaaattagttgggcatggtgctatatacctgcagtgccaggtagtcaggtgtctgagacacaagaatagaatcgcttaaacctaggaggcagaggttgcagtgagctgagatcgtgccactgcactccagcctgggcaacaaagggagactatctcaaaaaaaaaaaaaa

SEQ ID NO: 211919 - DNA, 304 bp, Homo sapiens
tcagttccgcatgcagaataaaaatttcaatggaaggcacagtgggaggaagaaaacaatagctccccaaacccacagtcattgaatgttgtgtccaggttcagatctgggaaacaaagaactgtgagatgagagatggctgtgccaaatgaacaggatgcattttccctgagcatcactgcaaaaggggcccaggggaagcctgatctcaggccaaacacacacttttcctacacctcactgctcagtagctgaactctgtaaaggtgcaactcacttgctttttagttttgtcttcataaat

SEQ ID NO: 211920 - DNA, 221 bp, Homo sapiens
acttggacttgttactcttatttttcctttttcagttctatgttgcatgtatttcttattctaatctttctaaaatgctgatttcattccatctatttgcttgatccttgccagaattccctgcaagaggcttttagctttagtttggtcgtctcactatccctgatacaaactgttgctaattaccatctttatggcctgagggtttctgcttcattact

SEQ ID NO: 211921 - DNA, 688 bp, Homo sapiens
aatcgagctggtaccaatccgacatacacccaggcctggcagctaaggccttctacaggccagctcaaatcacccttacagccttatctctcccaatattccctaacccactctcaactccagctaaaatcaataatcagattacactctgctctccacatatgtcttatgctgacttccatatttctccaactatttcctctatctggaaggcacttcccaagacttgctaaggaacagaattaccaagggaacttttttaaaaaatgcctgggctccattcagtaattctgattccacaagacagggtaggactcatgaagtgatgggtggtggtctttttaacagatttagaaacagagatccaacccatcccagtcttctcaacacaaaaactcacaaatctctcctttcccacaaaaccccagccagaatggggctcccttccctctgagttcctgtagtgtttgatttatggtttctttcggctctctagtcaagaatcagatcttgttcccagtgttcccacctcctcctgcaggccatgcacctagtactaagtgagcagtcagtatttgaaagatagtgtggtatagggggaactgggagtcaggattaggtgtgacagatatcgggctctgagcttctgtctgggaaacaaattaagggaatgacatacaaatgtcta

SEQ ID NO: 211922 - DNA, 444 bp, Homo sapiens
tccttcccaggcccaccattaccaccccagtaattcagatattgcaactgagattatgcataacctcctaacaagggggtccccgcctctgaccactcacccaccctccagtctcccctgccctgccccaagaaagcatgcttatcacctacacaaaactcttccacacttgccctttatttaccaaataaagtccacacacccaggcctggcagctaaggccttctacaggccagctcaaatcacccttacagccttatctctcccaatattccctaacccactctcaactccagctaaaatcaataatcagattacactctgctctccacatatgtcttatgctgacttccatatttctccaactatttcctctatctggaaggcacttcccaagacttgctaaggaacagaattaccaagggaacttttttaaaaaatgcc

SEQ ID NO: 211923 - DNA, 494 bp, Homo sapiens
ggtttccactgctcacatgatcaagctagaacctctaccaggctgtcccagtcttctaggagcagcgcccccacctgcctctccagataataattatttcgtttctcctgatagagaacaagttgcctgagggaagaggctgcagacaaacaacagggtctgggcctgacagccatcacttgtcatctccctgggtccagggcacatgtctgtctctttcactgcccagcactgtgcctggtgcacagaaggctctcagtgactttctgctgaatgaacaaataagtgacagaagcaggggcttgacatttcactacttgggaaagcttagtgcttgttaacttcaggagacatggctgtgccttcccacaagggccagttgtagtggctcatgcgtgatatccctaacaatttgggaggccgaggtgggtggatcacttgaggtcaggagttcaagaccagcctggccaacgtggtgaaaccccgtttccact

SEQ ID NO: 211924 - DNA, 199 bp, Homo sapiens
tggacttgttaggaccagggagaagggggctgctagagggcagggacgctgtggtggtcagctgttgcagtgtctcctgcagtcctccacagcagaggtgaacgtgaggattctttgactggggaacagtgacaggtgatggtggcaattgaggctgccagaaacaggaagggtgttttgacctcagaatacttttcta

SEQ ID NO: 211925 - DNA, 325 bp, Homo sapiens
aatgtatattgatatgctcatagataaaattacgatatctaggatttacttcaaagtaattgagaaggctgggcacagtggctcacgtctgtaatcccagcactttgggaggccaaggcaggtagatcacttgaggtcagcagttcgagaccagcctggccaacatagtgaaaccccatctctactaaaaatacaaacattagctgggtgtggtggcacacgcctgtaatcccagctactgaggaggctgaggtgggagaatcacttgaacccaggaggcaggaatgcagtgagccaagatggcatcactgcactccagcctggg

SEQ ID NO: 211926 - DNA, 433 bp, Homo sapiens
atgcggctccatttttaaaactaattgttgccccagataggcgactacatctctggaagcagcagctccatgctggatgtggtggaagaatcgagagggaatggactggaagtttggaatcaccggaaaataacaaggcatagctaagctgtgactagcaagataaacgatttgttcgaggtttgattgtcctttccctcctccactcggaagacatagttgtctttttttaaatcatgttttgtaccgaaatatttttattttataattgaatccctgttgttgggcctttaaaaacccatagaaacattgttatgtgccacgaaggtgggaaacacggctttctcagtcattgctgtactcccacaattctgggtcatgcacacaatacaggtttagtaaataaaatccgtatgtttttggccccacgcgg

SEQ ID NO: 211927 - DNA, 709 bp, Homo sapiens
tctgcccacctcagcctcccaaagtactgagattacaggcatgagccaccacgcctggccttgaatttaaaaaaaaaaaaaaagtattataaacccaatatctacaagaaaaaaaaattgtcagacttctcacatttgacatgacagtataaaaagattaacaaattatctttcagtacagctgtataaacctatttcagtgctctggaattcaatcaaaggcataaaacaaactgggagcatttatttattaagttactgaacttcaggcagaaatggtggttttcagttttgagctgctaccagactcctgcccctcccccaatcccagctctgtgggtatcagtttaagcagggcatgctgctgcctgagaggactcgttggatttggagtgttgtcaagttaatggggcaaacacggaagactagtgggttaggccagggatataacaggtagttgtaggaggtgagacagccacaagaggcttgaaaagctctccccaaatcggttgactctagacgatacacacacatataagagactggaacacactcaagccactcatacatccttggccatcagaagctgcacatacagagatttcaagagaatctggcagagaacaaaagccagggaagaactgaaaatggcctgaagtaagaatgcacttccagctcacatacagatccattagtagagagctgaaag

SEQ ID NO: 211928 - DNA, 518 bp, Homo sapiens
gtatcagttttctagtatggatcagacttgggctaactgcattttattatttgacttttgagacagggtctcactctcttgcccaggctagagtgcagtggtgtgtgatcttggctcactgcaatctctgcttcctgggctcaagcgatcctctagcctcaacctccaagtagctgggaccacaggtgcaagccaccacacttggctaatttttgaactttttgtagaaagggagtttcaccacgttggccaggctgctctcaaactcctgagatctaagggatctgcctgcctcggcctcccaaattgctgggattataggcatgagccaccacacccagcctgaattaatagttgtgattagtagtaacaccaccaccaaataaaaaatcagtcatcacaaaccatgagattactttttctccaagttctctaccctccagtcacattccttccatctctccccagtttccaactcctcctccattactcctccctctcccttctgtcgtcttctc

SEQ ID NO: 211929 - DNA, 974 bp, Homo sapiens
attggagggaaggcgtcttggcgccttctcttcgcaccgttttccggagactgttagaggaagagtcgctttttcctgcctcccaggctgcccagcggcgccggttgccggggaacgcaggcgccgtggggagggatggcgggaggatactgcttaggtgctggagacggagttgagctggtgaagaagagctcgggctcatcatgaaacaacgaaaaggccaagggtctgggggcagccgtgggcgcaaaaaaagaggtttaagtgacatttctccatctacaagcctgccacctctggttgaaggccagctacgctgttttctaaaacttactgttaatagagtcatatggaagattgcaaagcctcccacttgtgtacttgtccgagtgagatggtggggagaaacatcagatggaaccctcttttgtcccagggatgcattgcagactgaaccaaaagctgtgagaacaactacacgttacgctattcgttgtggtccaaaacagtttacctcttatctaacagatatggctgtgctggtgctggaagtaatcaccaaacttgatggtcttccaattggtagagttcagatcaatggactagctcaactttctccaacccatcaaatcaatggattttttaccattgtttcatcaacgtctaagaaacttggagaactccaggtctcacttgccctggaacctctgtcagaaacttacgacagctaccatccacttcctaccactgacatgacagaaaatgtgcttttatctaagcagggattcagagagaatactgaacccagcagtacccagtttcaggttccatcaaggcctcgcgacatacataccatcaaaattgatggaaaagagttagcagccaacagcagtagatcaaccactccgaggggaaaagaccatgtatgctttgcagagaacactgtgaaaagtaggtacgagctcgatgatcat

SEQ ID NO: 211930 - DNA, 489 bp, Homo sapiens
ttctcaaagatctttgcatattctgcctctccttcccatgagctgccagaaacatggaccctcccagcttctccctctcatgcacacatatacatgagacacagacacaaagaaagacaaggacacacacacccaaagagactcgggacaaaaaaccacacatgcagaaagtgggagactcagagatacgcaccaaagagtcacacagaggcatatacacacacagacatgcagagagacccaggaaaagacacacacttatagacacacaaacccatgtgcaccaaagagccacacagagacataaaaacacataggcatgcagagagacctagggaaagacacacaaacccatgcacacacacacatgcgcagatacaccaatacctagttaattcccaaacatttttgagatctcagctcactttctcagggattccttcctgacatcagatttcttggctatgcaattgcagagaaccccatttc

SEQ ID NO: 211931 - DNA, 302 bp, Homo sapiens
attagctgggtgtggtggcgtgtgcctgtagtcctagctacttgggaggctgaggcaagggaatcacttgaacccgggaggtggaggttgcagtgagccgagatcatgccactgcactccagcctgggcaacaagagtgaaactctgtcctaaaaaaaaaaaaagagaaaaaaaactagtccagtctgcctggtgaactttcatttgtcctctggaacccatcttggatatttaagctctctgtggtactttccgtgtcctctcttctccactctgatacagcttcctcctacttatctctg

SEQ ID NO: 211932 - DNA, 410 bp, Homo sapiens
ctatgtgagaacacagtaaaaagatggctgtccatgaaccaggaagccagccctcaccagacactgaatctgctgaagacttgatcttgaacttcaccatctctagaactgtgaaaaatacatttctcttatttataagccacccagtctttggtatgctgctttagtagcccagactagctaagacatctgacatatcaagtggcatacataatttctggaaactctgatgctaaattcttgatgccaaaaggtggtaagatctgactcagaaatgaatccatatgagccttccttccacaataaatctaagagtcaaaaaatgccaaatataggtcaaagacctctaaaagccatacctgaaagatttacaataatgattgtaatttaatcacacaaacaaccacagc

SEQ ID NO: 211933 - DNA, 475 bp, Homo sapiens
gcatgccagttactgctccttctgagggaagaatgctctaagtaattctttaagaacaggtcaccactgtttgctatcaccactcaagccacaactcataagacttggaaattaactcctgagttgagatcactatctccgagctggctgtagcccatgaggtagctatgcactaccacagtggccagtgagaatgctccctattaaatcatgacccctacagttgctgcccctgttctgactgtgtaactgctgagaagttttctttacctagaagataatcctacaataaacaaatctcttttccctgacataacctgaacatgacttacaatcagaaatgacttaaatgaccagaacagggaaaacaaaggcttaactgggacattggatgtaattcaggggagatatgatggtggcctgaactgaggccaggaatgagcacaggaatgagattcagaaactaacaaaagga

SEQ ID NO: 211934 - DNA, 293 bp, Homo sapiens
cccctaaaactttaagcgagagaagagggagtgattctccttcggaaaaacattccaaggcctttaatgggcctctggatgactgcctggtgtccacccttgtactaaaccagtttccctgcaacttccacctttggttctagtcaacattaacaccttaccaggaccattcgattgggcaaatgctactatacacttggacaaatccagaggtcaattgtttcccccactggttaggttatgtgccaatcctccacctgtagtcacataaaatgtgacattttaccagcaag

SEQ ID NO: 211935 - DNA, 505 bp, Homo sapiens
gcctgtgtggactctctggtgaatgagaagccctgagctgtaactgaagcctttgccacactcagcacatttatagggtttctctccagtgtggaccctctgatggataaggaggtcggagctgtagatgaaacccttcccacacacgtcacacacgtagggcctctctcccgtgtggaccctctggtggctgtgaaggtctgaattccgccggaagcccttcccacactcactgcatttatagggtttctctcctgtgtggaccctctgatggatgtggaggtcggagctccggccaaagctcttcccgcactcgcatttgtagggtttctctcctgtgtgcagtctctgatgcatgagaagccctgagctgtaactgaaactcttaccacacacgttacatttgtacagatgctgccccatgtgaactctctggtgagcttgaaggtacgagttgtgactgaaacctttgccacacttgtcacactggtagggcctctcgccg

SEQ ID NO: 211936 - DNA, 486 bp, Homo sapiens
caaacctgtcagaccagcatgcattgggagagctgcctgctccgcacccttcttggggatctaggtgttttgtccagctggcacatttgcacttcagaggtgggaggggcacgtagcccaggagagtatgccaggggagagagcacagccaagcctggggccgtaagactgctcatggcaagatgtatttatgttctgtaatggaatgccatcactcgctattttggaagcatgatggcatggagcaactgaaagattgtgggatgggttaaaaaccacatccattactttattgctatgggaacaataaaggaactggagcaagttcctctctggtctttagttacctccttggtaaagagggaatcatagttccaccttgtagagttataacacctccaacattcatgtaggtactcaataagcagcagctgttattaacaaactttcttttttttccctctgtaacagtctaagatacagagt

SEQ ID NO: 211937 - DNA, 288 bp, Homo sapiens
aagtggctttggaagcaacggggttaagggagaggcaaaagggttgagcagagagaggcaagaggcaatctccccctacccaactgcccctcccaggagcagatacggcaccaacagccggcgagtccctccggcctggaagacaaaggaaggatcagggcccagtggtgacggggagggtgggggcaacgactcgcgtgagctcggagacgtgagaacgcagcccccgccccgttctccgcctcccctgagaaaggcggggcccccacgccgccccgagacaggtct

SEQ ID NO: 211938 - DNA, 331 bp, Homo sapiens
aagctcagcaagatgaagatgtcttaatatggtggtatcttggctggcagagaaacaataaagagaggcagccagcagatgataaaagcccctaaaatgatccccagggtttctgtggctttccttgtttgaaagtaaatttcctgttgtactaggacactataagcatgcttgattttcatgtgattaacaagcagaggagagccagttaagcgcctttgcctctcatggaggctggggttgaggaagaagagtgagctgtgatgacctgggcagtggtgctgtgatgatggcttctggatgttcttgttgggcaatgtgtgaagatgat

SEQ ID NO: 211939 - DNA, 144 bp, Homo sapiens
cagagagaagctgcctggactgctaatgcctgccccgccgtgaggccaagtcagagggaggcagccagcgtctgcagggctaagaatggctcgattcttgggaggcggtcacgtggagtgggatctgctggcatttcctccctg

SEQ ID NO: 211940 - DNA, 554 bp, Homo sapiens
gagaaggccaagcttttcctcttagctagtcctcaactaacctgctcagggtttggccacactcagcacctccacttcctcttcccagcgtctcctgaactgatttcaatcgggcttttgtgttattcttatcaaggtcataacttccaccttggcacaattctcagatctcaggttactcctcctctcagcagtcttgaatggtagatcccacagtctgcaggaagttgtggcccttgactgagcccctcttctaaatggaggccagtctgtgtgcacaaggagaggataaaggggaacgttctgagaaggcaagaaactcacatgttcactcctatgcgtggatgaacagtgggagaaaacgtgctcatggtcataagaacactgctttgaggacacaaagatgggagtgactgattctatcttttgtgtgtttggggagatggcgggcagggagcatgtaaacatgttctataccagagaatctgaagatgacggtgacctagagtctattaagacttcactagagtaggactcctcctccaccccaaaag

SEQ ID NO: 211941 - DNA, 424 bp, Homo sapiens
aattcagggacattcataacttttggcttgacttagctatgtctgtacctcctctgagggaaattggttgccagctgatgagagtaccatttcttctactgccatggagtcacactcctctgcctttcatcatgctgccaaactctgtgaagagtggatcctttggggaaagacatcttcctgtctatgtctatgagcaatcattttttggttgaaaccattttttaagcattggttttatattcgtgtacctaaatttatttccaatttggtttcattgatcacattactggctgattattttcatttctgttgagcttcccaccatgaatagtgccgagtatttttccagcactatttggtgagatagggaaaggttagggaggaaagcctgatataaattcagaaatggccattgtcctat

SEQ ID NO: 211942 - DNA, 547 bp, Homo sapiens
  misc_feature (225)..(225): n is a, c, g, or t
  misc_feature (371)..(371): n is a, c, g, or t
  misc_feature (392)..(392): n is a, c, g, or t
  misc_feature (396)..(396): n is a, c, g, or t
  misc_feature (399)..(399): n is a, c, g, or t
  misc_feature (515)..(515): n is a, c, g, or t
  misc_feature (531)..(531): n is a, c, g, or t
ctatagtgcttccaagttcacatgttcatcgaatgttaaagtaggaagggactttttgtgggactttcgcaagtcctttctcctttctgggctgcagtttgagaagctgccatgcagcccctagccccttccctcctcctggggcctccagcccctcacactgctgttcccagtgatatttgggatctgactgaagccagaggctctgtaaaatcagaccatagnggaagtcctcagccccctggccccttccgcaatctcctcccccagtctcccaaagagccatttcaacagagaagggaaatgacaaaggggcaagctggccagataagctaggatgagagcagagactcagtgtgtgggtgtccctncctgcttccccttcaggtctnggtntgntctgaagggacgttttatagtcactatccacatgccagtgtgaaatgggcatctatgacgtggtcaggggtgtccattcctaatcaatggggcaaaatgcccacaagcatttcaangggagtcttgggggtnggccacggccccccgt

SEQ ID NO: 211943 - DNA, 506 bp, Homo sapiens
tctcaaaaaaaaaaagcccgtaatgagaactctcaagagtaccatggtaatataatatggtaatagataataaaagagtcatgatcattaataataaatataatacttctacttcaactgaggaatggaaaactaaacatcatatgttctcatatgtccctaagctatgaggatgcaaaggcataagaatgatacaatggactttggggactttcagggaaagggtgagaagggcgtaagggataaaagactacaaattgggttcagtatatactgctcgggtgatgggtgcaccaaaatcttaaaaatcgccaaagaacttatgtaactaaataccacctgttccccaaaaaactatggaaattaaaaattaaaaaataagtataatttctgctttagcgatattaactattcagtacacaataagtgagtttagcaattcagtgatttctgactgttgggtagctctctttgttaacaaataaaatataaatttgaagaaaaaa

SEQ ID NO: 211944 - DNA, 755 bp, Homo sapiens
atcgggatgcaagatttttgagactcactggtctgaaactgcctttcctcttaaatttagttaagtatttccctgggcatggaattcaaaggtggttatgacttttcttcaggattgtgaatgtatttatatcctcccatcttacgttgctattgagaattctgaagttcttctgattcctgattctttgtatgtgtattcctcattccacaccttccccagaatgcatgcagaatttcttcctttctattttcttttctctttttctgaaactcttattattgggatcttctgcctcttggtttagggctctaattttccgacattttctctgctattttttactactttatttttctcctctactttctgagagatttcctcctcttgatcttccaaatcttgtactgaatcttttatttttgttaacatgttcttaatttccaagaactcttttttcttgtcttcggagtttcaacacttattgttgttttgtgcatgtattattttttcttctctctctgaggctatttaggaaattttttattgaagctcctcccccctgcttccttcaagttgcttttatctgcttttttatttgctttttcatgcaataagtttttctcacatgtctggtaactcttggggattaccaaaaactcatagaaaattctgaccatgtgagtaacacttgccaattttgagcttcatgatagaatgatctagctggaccttttgctgcggggaaatcggag

SEQ ID NO: 211945 - DNA, 949 bp, Homo sapiens
aacaatttcattagttttaagagaatttgtaatgctttttgaaacatttttatgatagctgctttgaaatctttgttagatcattctcacatctgattcatactagtgtagtatgtgttgatggtcttttttgattcatgcgattttcttggttctcgttttgatgagtgattttagaatacgtcctggacattttgcctaggtcttgagtcctcatcttgctctgtgtcattaagtcttaatgttgctgagtggaggttttattgctggttgctggacctcactgacactaattttgtaggggaatcagattactgcctgcttctgctggttgggaatggaagatagctctccactcagacaccttaatactgtcacagcagggaaattaaagaatggcctgtttctattgggcagggaatggaggatcagccctctgctgggtcttatagacactacccctccaggggaattgggtaactgttactgcttccactttgcaggggatggaatattagctccctattctgctttgcctgtacttctcagttgaggaattgaagtgggccacctgtttccctgggggtgggttaaggtagaagataaaattcccatggtcccactaaaactggaggactgggaagggaagggttgtatgtgattttctgttggtgtgttgtcagagcagggcaggtattgctagaaagaatttctgttgttaggccatcttttttcactgatcctttggccagggaaaataggcttttcttagcacttttttggggggacagttctgggttggaggcttgtctagcaccctcttggaatacatgagaggcgataaagaagggaaggagacttactgctatgttgttcctcaggtccttcattctgtagccagtccaccttttttccacctttcagagtcttcctgtgtttgttttgatcc

SEQ ID NO: 211946 - DNA, 280 bp, Homo sapiens
tggaggacaaaggtagtgagaacccagcacagaggtcaggactgtagtcaaatagattagcattcaggacagagtccagtctaagagcgggaaatcgccatatcacactagtgatgataataattactctttctttctccctttctgtctttctccctttctctctctctgtctcctctcttttcttgtgaatcatagttgttaataaacaagctaaatctatatagtgcgaaataaacatattcacatattctcaaaaaaaattactacttgttggatg

SEQ ID NO: 211947 - DNA, 642 bp, Homo sapiens
ttcattaaatgcatagacgagaacaccgtttattacaagaacacaagagatagcttagggaggctttccggaagcactaagaaatagaactagtttgtctaatttggaattaaaagagtaaccaactgagtgtcttcagcagtgacaatgaaaatgtaccacttcccattttgataattcaaagagccttaagaaagatcgttttgcttgaaagcactatttcacactgacactggtcattcataggcttcagataagaaaaactccagcagtgtccagatcaagccatcctgactttgtctctaggcggcttaacctcaagtcacagcctggtctctgcagcagagccaggcattccggagcctgcacggcctagctcttctggagcagatgggctcacttcccagggtgctgctagcttgcattcaaagtgacttcacatctcactccctcaggtggtcaggatgatgcccatccctgatctgacacaggcactgatgtccactagactctggccagcaaaaagccctctcacagaagaaggggtcaaaaagggctaaatctgagacagaagccagtttctcagatgtgctatttctgcctaagcatcctttcttgaacaataaaaaaaaaaggctgaaa

SEQ ID NO: 211948 - DNA, 839 bp, Homo sapiens
cgagaggcatggcttgggagagaagagaggaaaacaggcaggtgggatatccaacagctgaaaaagaagtaaaacctatagcccagccatttgtaattcacatatttagcttttataaaaagtaggctctctcggggtacgtacacaaggaacggatagcctatagggtttgttttacatatcttccatgattttagggtaaagtcagaaaaatcacttgtcatttacaaatgtatccttattttttttcttctaggaggctttccggaagcactaagaaatagaactagtttgtctaatttggaattaaaagagtaaccaactgagtgtcttcagcagtgacaatgaaaatgtaccacttcccattttgataattcaaagagccttaagaaagatcgttttgcttgaaagcactatttcacactgacactggtcattcataggcttcagataagaaaaactccagcagtgtccagatcaagccatcctgactttgtctctaggcggcttaacctcaagtcacagcctggtctctgcagcagagccaggcattccggagcctgcacggcctagctcttctggagcagatgggctcacttcccagggtgctgctagcttgcattcaaagtgacttcacatctcactccctcaggtggtcaggatgatgcccatccctgatctgacacaggcactgatgtccactagactctggccagcaaaaagccctctcacagaagaaggggtcaaaaagggctaaatctgagacagaagccagtttctcagatgtgctatttctgcctaagcatcctttcttgaacaataaaaaaaaaaggctgaaa

SEQ ID NO: 211949 - DNA, 540 bp, Homo sapiens
tttgtgttaccactgtgcaaaaccatggtcagccgccaaagaactcagctgaagatggtaagaagaaatcgacaaagaaaattttaataagggattttaaaaaaaaggaagaaaagaaaaataaaaacctgttcaatctcctgccttccacctgcactgatccccacaagagaaggagtagatgatactgaaacaaagtgatttcactgccagttcatagttctggggaaagatgagttagaaaggatcacctgaattggaggtagagtcatctgtagatttcaaatatctgcttcacttttgttccatgttactgtaaataattatcaagtgacagtaaagatttataaaagcatttaaaacaatgaataaggagagttggtggagttataaggtggttttcttggttcatgaacttgtttgcaaaagacgcatggccttatacttaaacatgatataaaggtccaacaaagctattacaatctaataataaaattatacaatgtttctttcctctatagctaatgcaggctttactta

SEQ ID NO: 211950 - DNA, 850 bp, Homo sapiens
gcatgcaccaccatgcccagctaattttgtattttttttttaagtagatatgaggtttcaccatgttagccaggctggtctggaattcctgacctcaggtgaacctcccaccgcagcctcccaaagtgctgggattacaggtgtgagccaccacacctggcctaattaatctctctttttcatttaagctcattctccattacaagttaagatatgacagccaagcgtttactgagggctaataatgcagatgactgaccccaatggcagccacacctggagaggtgccgagcacttgcaactctggtcagaggcttgctccaggggtgaggggtaggagcaaagtcatccagatgagtgttcatctctctgggaagaagagatcagagaggggtctcgggataaagtagaaccaaagaccttgaaggtcaggcaagcttcagagagacttaacacaggtagttgcccaaggcagaaactctcctctatttcaccccatcccaatttatctgttaactttacctctcaaatatctcttgaccacatccacttgtaaactgccctcttcccacattgtagctcagctaccaccactccttccttcctggacggttgaagcagccttctctcaacgttctgttcctacacactcactgttctctaacccattctccatgtggcagtcagaaatgcaaaactcatccttcccttctccattgcaaacattcaaggacttcccattgtctctaggattgagcctaaacattttaatccttatgtcaaggcttaagctgatctatggctcttcagagcggattggtcccagatgttagcatggggcccgggctcg

SEQ ID NO: 211951 - DNA, 447 bp, Homo sapiens
tgatgcacaccctggggtgagatctgaatttgagactagccccctcagagaagtcaggatagtgaagtggaaaagagcgagtggtcattgccacacagaccagggtttggatttcagctctgtccacgtacagcagcatggtcttaggcaagctgctaaaccctgcctctgcttcctcatctgcaccacaggcaccatagcaatgacctcacagggctgctctcagcactaaatgcgatcatgtggatgaggcatgtggcaaatgcctggcatgtgagtacaccgtaaatgttacatcttgggtgtgagtatgtctgtgtgtgttttctgctgtactgttatatatggatagaatcctctcaagaaaagtccaaggcagaactcaatcaagaaatgagatggcagtgctctattatattagtgtaatttggtaataaggaaaccaat

SEQ ID NO: 211952 - DNA, 762 bp, Homo sapiens
  misc_feature (537)..(537): n is a, c, g, or t
ttttgagacagtctctgtggcccaggctggagtgcagtagcgcactcttggctcacgggagcgagccaccacacctggcttccgttcgttgcctgtgcttgtggggtattactcaagaaatctttgcctagtccaatgtcctgtagagtttctccaatgttttcttctagtagtttcagcttgaggtcttaaagtcttttaatttgatttttgtatgtggtgacagagaggggtctagtttcattcttctgtatatagatatccagttttcccagcaccgtttattgaagagattgtcttttccccaataaatattcctggtacatttgtcaagaatgagttcactgtagaggtacctatttgtttctgggtccattctgttccattggtctatgtgtctgtttttctgccagtactatgctgtttttgttactacagctctgtagtataatttgaagtcaagtgttcccccagttttgttccttttgctcaggatagctttgcctattctgggtcttttttggctccatgtactangagttacatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcaaa

SEQ ID NO: 211953 - DNA, 558 bp, Homo sapiens
agtgatcatcattagtactgagaaaagtcaaaatcatatgtcacctaataagatacacagagaactcagtatagcctctgtgatattcctggcaaagatacatgacctgtatctaataataaggaagcataagctaactcagattgaggaacattctacagaatggttttctggtaatcttcaaaggttttaagatcatgaaagtcaaggaaacactgagaatgttacacgatcgaaggagattaaagagtgatgacttgggtgattctgaacctgatcaatttgctatgaagaacaatataaagatcactgaaaaaacttgaatgggatttaaagattaagtggccataatgaatcaatattgattttctgattgtgacttttgaattacagttatgtgggagcatgtacttagttgtaggtaccctaaaacttaaagtaaaaaaaaaaatagaaaaaaaaagaagacacacgctaataaatttaacaggtgatttataagaaatgttttttgctagaaattgaaattctcaaattaataaagttcataagagaaat

SEQ ID NO: 211954 - DNA, 410 bp, Homo sapiens
tgagcccctcccaagctgcagagggagggagcaggcgtggctgtcagcaccgaggtagcagagaattaacattcttgtcagcagagaatgaagcaggaatataattaaaactttgcccttggaatagctgattcatttgaattttattccacacgtttgaaagaggaaagaaaatgtgaagacttgcagcctggttctcgcctggcctgggctggcccagctgtcaggcccggttcctttctgagcattcagtccactgatgttgactgagggccaggagagaccctcagcagggtattaccatatcagcctcctatcgctgctgggagaaattaccatgaattcagtggcttaaaacaacacacgagcctctctgagcctaccctggctcaggacgctgcccaatttta

SEQ ID NO: 211955 - DNA, 487 bp, Homo sapiens
aagtctgagcttcctcatctggagaggggctggcctttagcaggctccatacacattcactcacctcccatctttcctgcatgccagtgtcaggatagttctgcccttctgtgctcagctgggaggaaaggatcttgggaagtcagctagttcagtagtgagtacgaatagtgagcgtgaggcctcattgttaccttgtgacatttacagttcactgtattggggggaatctgggaattttaaaaatatctgtccattgtcatttagaaattattgtggagggggagttgcccaggggctggcctttaaaagacctagtgtaatatatcaaagatgtagtctgctagatatgagaattgatggccagagttcctctctgaaaggtcactggatggaaaagtagttttgtgtctttacaaaaagaagcacatgatggagttctgagcaggctaagatgcgtgtaaaatgtaaatgctgagaaggacgc

SEQ ID NO: 211956 - DNA, 455 bp, Homo sapiens
ttcatctgtgttaccagagttggtatgctggctgtaatgctgaaaagtcagaagtaaacgcgttccccgggacccagggcatgcgcttcatctcagcggcttcttacaaggattgggtgcaagtgctgcagcagaaagatgtttccaggaacatgggaaccaaggctaggtctgcatcttctctgaaaaactagcctgttgtttctcaaacacacatcaacatagcctgatatttcagagaggaagggaaggtcggttacaaacggtatcgccatgagccgcaaacgaatggaagaaattccacgttaaaaaaatgtgaatttcattccataagaaaaacctttagtacgtagctcagaaaacagtcaagaggcccatgatcatctcggttcaggaaatgctaggctgctggagacagccttttgtttaacctcataaacatctaacaaacacgg

SEQ ID NO: 211957 - DNA, 563 bp, Homo sapiens
atgctttattctcatgatgatctcctatttccaaatcttctcaacggtgctcagaatcccttcaggacagagtcgagcaaaagccttctccacctgctccccccagctcattgtcatcatgctctttcttaccacagggctctttgctgccttaggaccaattgcaaaagctctgtccattcaggatttagtgattgctctgacatacacagttttgcctcccttcctcaatcccatcatatatagtcttaggaataaggagattaaaacagccatgtggagactctttgtgaagatatattttctgcaaaagtagaacatcctggtctttactatagaagatctgcaacaaaaccccaaaaaagcataaatactttatgacaaaaaaagatgaaaaaattgttgatgaaatgatgaaaaatcctgaaaaaaaaaacctgttgaatgggagaaagacaatatttgcactactatatgtagatagaaatgcaaatgtttcttcaaaaactaaaagtataaaagtataaaagtaccttcataaaatatttcaaggttgtgtaact

SEQ ID NO: 211958 - DNA, 413 bp, Homo sapiens
tatgaaaagtacttttgtttttctcagccccttaatgatttaggagattcaaatgtagagctatgggtgaatttcttttcatatgatcattggaggatattttttttctccagaatgagagaggctgagatcgattgctaagagagctcttaggacgagaaattgtaatatttgactttggttttcaactctctaagaagggatatattccctccttatggcccgtaagtgtttattcaaggtatttcatatgcaacagatgtttatgcatgtttactttgggaaggaggtgaagaaatttcaaggagaaaataatttaaaatgcagactaggaatcagtaagcacagggagtctgaatcagtgatgatcatgaaaatgtccatcacagatcacagaggatttttagggcaat

SEQ ID NO: 211959 - DNA, 761 bp, Homo sapiens
aatgagccaagaattattcctgtatactatcccctcagttcatctaggcattacctccatttcctcatgttttacttcctcctgtatctttagaatccaatctcagatgtcactgatgaagttgttgcagagaaatatgataacagctgtctagacctatcagttattgaattgagatgtcctgtagcctttgatacagtaggtcattttttgtttttgcaagaatgtaatcccgtgattctccatgtgcttccttgaatggggtagaaactgagctcattttcccctcccttttatgcttccctatagtccaccaaagtgccactgtcatcctgttccatcaacctcagggttattttcagccttttcctcttttgctttttatattaagtacatcaacagtacattatcctctgtgtctcttaaatctattctttccctgagaatttatcctcttgcttatcatttatcatatactgcctttatatgttaattaacttttcatttactcatgtctgttactcccagtaggccataaactccatgaagacagagttcatatcccacataagaatctgagacttatacttaatttataagtgactcgtcactttgaatctggggagagacactgagccacagtccccataggaactgttttcctcttttcgcccatgtgaaaatgcctagctaatggaggttccagtgagccgagactgtgccactgcactccatcctgggcaacagagtgagaccttgtc

SEQ ID NO: 211960 - DNA, 631 bp, Homo sapiens
aattgggcaaaagggttggacagatcctttatcaaaaaaggatctatgtgtgtctaataagcacatgaaaagatgtatagcatcattagtcattagataaataataacttaaaaccacaatttcataccacatgccactcactaaaatggctaaaatttaaaactcagaaaataccaagtgttggtgagaatgttaactagcctggaactctctcatatattgccggttggagtgtaacattttacaactaccttggaaaactagaagtttcttaccttatgacccaccaatttcactcgttattacctgttaaaacccaccaatttgactcctaggtagttacccaagaggaataaaactatatatccaaaaatgatgtgtataagaatgttcacagaagctttatttgtaatagtcccaaactgtggacttgtaattaccatgtagttatttttaatttttaaaaatccagtccagtaatctttgttctttaattggagtttttaatacttttacgtttaatatattactgataatgaatttaaatttaccatctatttgtttcctcttggcatcatctgttcttttttgttttttttagaattggtgttaattaaatatttattttat

SEQ ID NO: 211961 - DNA, 582 bp, Homo sapiens
cacacacacacacacacacacacacacacacggactttccatcattaacaatagggagaaagaggatgccaaaaaattacccatctgtccagacaaccaacgccaatggaatccatctgagggctggcagtgacacaaaatcgcaaattcagaaatacttttaagccccttgcttcaaaattatatgtggctttcactcatgtaggtgcagaggaaaaaagaaaggattgaaattttaacttgcgttcatctggttgggcctttgagggaaataaattattagagaaggaagtaccctaacgaagggagccaccaaagaccagaaggcactcaggaataggacccagaagacctggaccccaggaccaccgcagcccaggaccaggttgcccattgtgggaccctgtatggcaagtcacattcctgcttccgcttctagcctccccatctctgcaacagtcatactcttgtaagctcccatgccttggtgagaagggaatggataggcaaaggctctgggctggggaaatggccaggcagccatgagcagccagtgctgcattatccttagagttgcagaga

SEQ ID NO: 211962 - DNA, 394 bp, Homo sapiens
actgtgaccatcccagttcaggtctcatcactttgtgcctatactcccagcctctgcccttctctgtcaccaccaaaacactttctgctaagatagctcttaccgtgtcacctccttgttcactgtttacagcatagtctttggagttactatgggatttaggacttataccacttgggccctaatctacctctccatttacttttcccattacacagtccttctcttcatcaaaccggatagtccaccaactcttaaaatgtcatgccttgtttcatcctagctaacctaccacttctgcctagaatgtccttcctacctttcccttcgtccctttctttttttttttttttttttgagacggtgtctcgctcttgtcgtctagggagtgcag

SEQ ID NO: 211963 - DNA, 324 bp, Homo sapiens
tcttgtgtgaagacgggaaaggaacaacaatgaattactatggatttttctttttaattaaactgtgttgttagtttctgatggcattttgattgcttataattcaggatgttttccatttcctttttatacagaattgaggcttgtgaatcagggtgagtcagccacccacgaatggctaaaaaagtggccatttatctgttggcagacttattggaaaattagtgttttaattagctacagaaatagaaattaagcctggacaaaccagtatttgtttactgagtaaaaactcagtaaaccaatgagtattttagttgtata

SEQ ID NO: 211964 - DNA, 371 bp, Homo sapiens
cctttcagctcagctttcctagaagggctttgacagatggaagaggacttgtggaaacaggcccaagctgactcaaagatgagattggagaacggctctcccttcccccaccagaagggggttactgaaggtcatctcatccatccccctgcctccatacacagctgggtcatctgagcataggctgttctgcagacactaccaatgtcaccaaagtgggctggcatctttccccctttccacaccctctcactactgttgcctcctccacatagccccagggcaaccattttaaaagcccaattagatcctacctaaaatctttcaatggctcctaatcaagtaataattaatacagtccagaatcttta

SEQ ID NO: 211965 - DNA, 419 bp, Homo sapiens
tcaaagaagtgggtgatctctcattatcaggataattcaagcagaagagaatgagatgcattgtcagggagggcttggtatttttacacacaaccccagtggagacctaaggagactcaggagctaaagaaagcattctgaggaaacgctcctctcttgagttccttacaagggatttcatcccaactgatattcaggcaagaaaccctagctttcccaacctccattctgagaggtgctttttctttaaatgacgttaatgggacattgtttcttctttttcaatgaaacctctgtaagagacaacctccattaaaatatatatatatatatatatatgtatatatatatatatatatatatatccattgggcctgaggtgaaagaaataaaaagcaaaagtgaaggaaaaaaatagg

SEQ ID NO: 211966 - DNA, 388 bp, Homo sapiens
aatattacctcaagataatagattccgtctggaataaagctctgcaaggccctaaactgtgctggtggcatggttattgttctattttcttaaaccatttaaaattagatttggccaggtgcagtggaccacacctctaatccagaactttgggaggccaaagtgggaggatctcttgaggccaggagttcaagacgagccttggcaacatagtgagaccccatatgtacaaaaaataattaactgcatgtggtggtacacgtgtgtagtatcagctacttgggaggctgaggtgggaggatcacttgagtgccagaggtcgaaactgcagtgagccatgatctcacccttgcacttcagcctcagcatcaaagcgagaccctgtctc

SEQ ID NO: 211967 - DNA, 636 bp, Homo sapiens
gtacccaaacaaagcatttgccatctgcatttgccagagtcactggcaggtggcagagtaattgaactttcactctacatgtttttgtttgtttttctggcagtttactcaggataccactcatgtattgaaattttatttcacttgattccagacatctagagaccgcatcatttctgtggcacccaaacattcgggaaaagaggcagatgtaggtcattaggatttctctcccctgtgaactttttctgaagaaaaccattttctctctggtttctagccagagaggaaagcaccaattttaacatctcctaaaattgtgagatggatattttaggttttgtccttccttactcttgtccattcttccatctcttatattttgttttctcttccttgatttttctcatctctggctttactcataaattcatgaataaagacgtgattcaggttattaatgagaagagttttatcttgaaacattttgcatgtttttaaacattaaaattttgctgtgatatttatcacacatgcacgtatataatgtatatgtacaatttaaagaagatgactaacgatgaaaacacatttgtatatccctacacaggttaagaaatagaacattactaatgc

SEQ ID NO: 211968 - DNA, 535 bp, Homo sapiens
cactgaggggcaaggggccaaagggcactagacccaagtcaagacggatcctgagtctgcacacctggctttgctgcagcggatcataaggacatgctccctatggggaaggagagaccgactgcttttgctgccacagccaccacggccatcacagctaccacggccgccactgccactgccactaccaccaccatcacaaccatggccgccactgccactgccacctcctccctcttctccttgctctcctcctcctcctcttcttcctcctcttcctccctcttttccttccgtctcctcctccctcctcttcctcctcctcttcctcctcctcttcctcccaccttctcttcttcctcttcctcctcctccttcttcctcctcttccttcctcttcttctttctccttcctccttctccctccccctctttctccctcttcgccttcctttcctgccttcttctcctcttccttttcctccttcctttttcctttccttctccctcctcctcctctttctccctcttcttc

SEQ ID NO: 211969 - DNA, 684 bp, Homo sapiens
gatgagcaaacataactcatattctccattattgagttgtactaattcattggacaaaattgattgaaccaggcagtgtgctgaaaactgcatcttatttatgcttttgataaaggtgtgcttaattgtgtcagccttgttacaagaatatgttagaggagcacagatatcataagcaaggatacgtgctataatagagagagttctcatctagaaccgaggagaatggtattatttgctcattctctctacctgtgttattttattctccaaaagccccaaataaaattcctgtgtttaaattaattaatcattttgggctttgaacaagcacaaaaattaaattaggtaggtgtctaagtaggaaggaataagcaaaatcatttgggtataaaaccatgaatctgcctttaaagggatgtattaacctgttgaaaaaaatacatgacaggggagtcactgaatgttttcttgtgtcacagtgactataaccttacggtcgacttatgtttgtttgttttaatgcatattggtttctacaaagctaaatttatgttataaaaattattctactttacacatctaaagtaatgatcactgtctgtcaactctctggagcactagtttttctctgactttgagacataggataggtgcttttctgattttaattccttctatttt

SEQ ID NO: 211970 - DNA, 2611 bp, Homo sapiens
  misc_feature (1286)..(1286): n is a, c, g, or t
cctaagtctctgacatcttgtacaagaccgaagacagacaatggaaaataaatgatgatcatcaagtgtctgccaaatgctttctcttatccatccctggagcaccatgttcctctgctttgtagcactattcagaggacttgtgttacttccatttgtgagatgattttcttattgtaaatcttcttccactactttgtgaactcaacaagcagagggtgtgtgactgtcatatttgccattctactctccagcactgcacagtacctctggcacataggagatcttcaataaaatttgctaaatttatgaacaaatgagtagcttaaatgaagggaaccatgcctaaattaaagaaagactccatgcagtataaccaagtcaaacaaattctaattctgaaaagaagatagagtacatgtgctctggaacatctctttgggtggggtgttgggctgtttcttccaattatatcactcacagcacaggactgaaatgattaggactttctgacaagttcagctttgtgttactttgccttgggctcaggagacagaagtaatcctaggaaattaacaataatttatccagttataggcactggagattaaaaataaaaatataaaggaaagtaagcaacaacctctgtcatcgcaacatgcagacaggcagcatcatttttccaagaagagatgccatcctttatatccaagacccaagttatgtgcatgacttcctttatcctatatattatctttgccaaattcttccctaagacctgaagaaagggtttaagaaaatttattatcattattattttttagagacagggtatctctctgtcacccaggctggagtgtagtggccctcgctgcagcctcaaactactgggctcaagcaatcctcccaccttggctccagaagtactgaaattactggcctgagccaccacgcctacccacgggtataagaaagttaaatttgactgataacactgactgtgtaatctttaacaagttaatttatctgtgcctcagtttctccacctttacactggtgataataacagcaaccacttcccagagttattgggaggataacatggattaatattggaaagtcctggaagttgtacctgggacatagttagcactagttaagtgttggctattattaataattactataacacaaaattagtgccttaaaattttaagagaggtaaaatagcacaccactttagtagaatttcttttttccttaggcactcagagggatagaaaaangataaagatgacactcataacatgaattcagaagaacatttgatacattcttccatattattcttaccttcagtggctagacagcatttagagatagtgctactaaataataattatcttaaatagatgaaatgtcagttaagctagacacagtatcatcctcttcattatacttatagagcaattcacaataacaagctttcacatatatctcatttaacattataataaccctgagaattattaccacctctatctttagaggaaacaaatgaggctaatatagattggataactcacacaaagtcacacatctaattgatagtagcaccaaaattcaaaccagcccttctgaatgtaagcctagtatccttctaaggaaaaaaaaaaaaagttgccacaattaaacaaaaaatacagaacaaaacggtgagctcaagtgcttctttaagagacgttttttaaacggacaatttcttaaaaagagtttcatagccctaaaataaacctattttaagaaactcatttggaaacattttaataaagagtattaggaagtatgaaatatagtgctttgaattttccaatttggagtagtcaaatatcactgctaattgattcctatactatgagctagcctagtaagtaattactttgatctctcttaagagtcagggctacctaattagatggttactgaagtagccactgaatgaggtattggtaaaatcaggattaacacatattctaaaagctactcaactcaaagcatctggctcaatatgttctcaaagacagatatggtaacatattcttacatataattataaaagcaaggttttcaagtaatccaaacaaacaacaaaccaaattccaccctcagttcttgcctatgcttacaaatatttagcagtaatttacttgtgcgtatttttacaagtttatttttcaatgaaactctaatctataatgaaaagtcttccagtcacgccaaagcctaattcaattgataaataacattttgatatagatttaataatcattaacttgtgaggttttttttttaatctcagatttggattcttactctacctttgccacaagtacttctttataaaatccaaatgcctattctttaaaatctctttaaaacaagaattttagatcccaagagataaatcaaaatggagatcaattttagcttctttcaacacagatttgtggatgatattgaataattgcttcttctagactgtgttaaatggtgaacaaaatgaattcatttaagtaaatcttgatctctatttgaacatatataaaattgc

SEQ ID NO: 211971 - DNA, 450 bp, Homo sapiens
aggaatcggttcatccaaaggacataaccattgtgaaattatatacatccaactctggaacacataaatacataaagcaaatattaattgacataaatagaaaaagagatagcaatgtaacaatagtagaaaaccaatactccactttcaacaatggatggatatacggggcatgtatttcagaagctacaaagtaacagttatgtggtataaacaagtctagagatctaatgtacaatatgagaagtatatgtgaaaaatggtatatacaggattcaagctaaatggagggattttatctgctcttgccataaaacacacaaaaagtgggtatgtgaggtgatgaatatgttaatttgtttcactatagtaattttttgctatctatatgtatccaataacttggtgtatacctgacatacacacaataaaatttattttttaaaaaat

SEQ ID NO: 211972 - DNA, 629 bp, Homo sapiens
attggagtaacccacagactcatcaaatgtcactattatctgtgcagttcaagtacctgtttcccaagtttcttttattctcatcacatcatgtacttgaattactcatatttctaccaaaaaaagttctctttttgaactaaaagttgaataggggtctcatagcactcatttttaagactgagaagagaaaattttatgaaaaaaatgtttcagaacatattctaaattcacttgccaaagactagaagacacaggcagatacttgttaaatctatcccagtgcctttctgtactactgtgaaaaccaatagcaatgttattgtctcacacaatactaccaatactcccaaatgaaaaagaaataatatttcctggccaaggaagtagactccaccctattacaggccctaacaaactataaagatcataacctaatgttgcatactctaagacagtaatgtatctggttttgttactaaaatgaaggacactagcgcatttaattaacggaaattggtaattgtccaacaaagcaccttaagcatcagaaatgcactgttgtgtaggataaagaatatgggctgggtagacttggattccattcctacctctgcaattactagctg

SEQ ID NO: 211973 - DNA, 571 bp, Homo sapiens
attggagtaacccacagactcatcaaatgtcactattatctgtgcagttcaagtacctgtttcccaagtttcttttattctcatcacatcatgtacttgaattactcatatttctactaagactgagaagagaaaattttatgaaaaaaatgtttcagaacatattctaaattcacttgccaaagactagaagacacaggcagatacttgttaaatctatcccagtgcctttctgtactactgtgaaaaccaatagcaatgttattgtctcacacaatactaccaatactcccaaatgaaaaagaaataatatttcctggccaaggaagtagactccaccctattacaggccctaacaaactataaagatcataacctaatgttgcatactctaagacagtaatgtatctggttttgttactaaaatgaaggacactagcgcatttaattaacggaaattggtaattgtccaacaaagcaccttaagcatcagaaatgcactgttgtgtaggataaagaatatgggctgggtagacttggattccattcctacctctgcaattactagctg

SEQ ID NO: 211974 - DNA, 254 bp, Homo sapiens
accccgaatctaaaaaaatataaaaattagctgggcatggtgtcaggtgcctgtaatctcagctactcggggggctgaggcaggagaatcgcttgaccgggggacgcagagttgcggtgagccaagatcgcgccattgcactccagcctgggcaacagtagcgaaactctcattcaaaataagtaaataaataaaaaataaaaaaactaggatcatttctcaaataaactattggtttgtcacttaattgattt

SEQ ID NO: 211975 - DNA, 411 bp, Homo sapiens
ggctttctgatcagtggtaaaagagtatgtcacctggggacaagaggatgaacagagtcctgctaaaggccctgtgtgctttccagcttgactgcagtgagtgaagaaatgtaagcactgtaaggagtactgcagatccccaaacttctgatatgtcttagcccaatgatgaagtttggatcatttttttttcctgaagcaaaaggaaatcatttaagggtattaaacagagatgtaacatgacccattttgcccttaaaaatatttctagttgtggtagggggataaattagagggagccaaccaggaagaagaagccacctgagagggctgcagtatcctagctcctagcacggaggctaaggcaggagaatcgcttcaacccgggaggcggaggttgcagtaagcccg

SEQ ID NO: 211976 - DNA, 494 bp, Homo sapiens
  misc_feature (420)..(420): n is a, c, g, or t
  misc_feature (450)..(450): n is a, c, g, or t
aacaagatatgtcaaaaatactgtactgcttgcattaaagataaaatttattttgcatttcctttccaaaacacaaactgacaacaactctgctaaaacagaagaaaacttaagttataaatattagcatccagttggccaaatgataaaaaactaattatgaaccagatcataaatttgagaaccagtgataggacgaaaaaggcttgattgttgcttaacatgtccactgaggggacagtgtccacttggacagttttatgattgttatgctctttggcataactgaacatgaacttggtcaattcaattcagagagaaattctaaatcaaaagtaagcatcggccacaagaggtttttcaaatatttcttcaaaaatataaaataggccaggcatggtggctcttctgatgattctntattgcaccttactctccatgatacccagnagactcttcaatatcaccagcgaatgacgtattacaccaaaact

SEQ ID NO: 211977 - DNA, 691 bp, Homo sapiens
aacaagatatgtcaaaaatactgtactgcttgcattaaagataaaatttattttgcatttcctttccaaaacacaaactgacaacaactctgctaaaacagaagaaaacttaagttataaatattagcatccagttggccaaatgataaaaaactaattatgaaccagatcataaatttgagaaccagtgataggacgaaaaaggcttgattgttgcttaacatgtccactgaggggacagtgtccacttggacagttttatgattgttatgctctttggcataactgaacatgaacttggtcaattcaattcagagagaaattctaaatcaaaagtaagcatcggccacaagaggtttttcaaatatttcttcaaaaatataaaataggccaggcatggtggctcacgcctgtaatcccagcactttgggaggctgaggcaggagaatcgcttgaacccaggaggcagatgttgcagtgagccaagatcatgccattgcactccggcctgagtgaaagagtgagactctgtctcaaaaaaaacaaaaacaaaaagccatttttgacaagaagacttcattagtgttggtggttttttttcccccactcagatccttttaccccttatatactgcaatacatatatctaaaatatgtgatatttaacatatgtaagatacatgttccatat

SEQ ID NO: 211978 - DNA, 402 bp, Homo sapiens
ggagactgaggcaggaggatggcttgagcccaggaatttgaggtagtggtgagctatggtcatgccactgcactctagcgtgggcaacagagtgagaccctatgaaggtttttacctcagtacaaacagttgagtcactcatactctttagttcttactcctcagtgtcattgctgtgagagctctgctgttatttaattaatttgttaattcccatttatctcattcccatacctgccaccacagttctttgtaatttatgtatgtttctttttctatgagttgcatagtgtgtgtgtattttaagtaaatggtatcattgtctgcattgttctgtttcttttcccactcagcatcatgatgagtggtgcattttagggtttctccctgttgctgtgtgta

SEQ ID NO: 211979 - DNA, 771 bp, Homo sapiens
gcctagtgaagaaatgttttaaagttttgagggaatgattgttgtctccaaatgtctgaaggaagtacctgtagaagggcattagtgaaatagtttcctcccactgacagcaaaatccatgagaacagggaatgtgtcgtgtcattttatcttcagcatttgtggtacagattaggcactcagtcagcatttattaaatgatgaataaacgaatgaataaggtacaaaagtcagatttgggctcaagtacaggcagaccttcataaaaggagaattgttcaaaaatggaatgccctttctgggtggcaagttttacaaaatgtagtccataaaaataaaatgtggataaccatcagctgggtttaattctaagatttcctgatttatgcatgggacttccaatgagttactaaatattttctgggccaatgggttctgaaagttatacccaagtatgaatgtgattgataatcacacaaactgcttcaccagtgagattatccagtcatctagaaaatcatagtattaatccagaggcctccagaaaagaagcataaatagaaaaattcaatccatcattactgccccagtctcatttcaaaatgtttttcaaaagaaaaacataggaatgataacaagatttcaaagtaggtattctattaaactctttcaataaggcacttcaaacaatgaaaagtatgttttatgtggagaatacaattgctcatgaaaatagacaaataaaaacaacaaaaatctatcctattacag

SEQ ID NO: 211980 - DNA, 857 bp, Homo sapiens
aagtgaatgaaaatcaagagaaagaatgagtaacagaaagaacttgaggtgatccagatattggaactcttagataggcttttaaaataaccgatttatgagtttaaggaaacagatgaagagatagagagttttaccagagaactggaatctataaaatagaatcaaatgaacattttattttattattttattttattttttattttttgagatggagtttcactcttgtcacccaggctggagtacaatggtgcaatcttggcttgctgcaacctccgcctcccaggttcaagcgattctcctacctcaggctcctgagtagctgggattacaggcacctgccaccaggcccagctaatttttttttttttttgtacttttagtagagacggggtttcgtcatgttggccaggctggtctcgaactcctgacctcaggtgatcctcccaaagtgctgggattataggcgtgagccatggcgcctggccaaatgaaaattttaggactaaaaatacattagcttgagttacaaactcccaagcatgtgtttcacaaccactcaacacggaaaagatttgtgaattagaggactgatcagtaagaaatatctacagtgaagcaccgagaaatgaaaggatgaaaaaaatacagtgtagtggagacacaggacataatagaggggttaagacacatacaattgggttatactaagagaaaagagagggctaggagtgtcataagtgctaaaagtcaaggacagcaaaaaaaatctttaattgctagagaaaaaagatactaggttaagaggaataataagattggcagccgatttctcaatagataacaaaaagagg

SEQ ID NO: 211981 - DNA, 303 bp, Homo sapiens
gtgcttctgctccgactgcttttcccacgggcgtcatctatagtccggaggacagccccagggcagaggcctctgtttttccatgtccgaagactcaaagattctcattagtcatccattttttccctccgttctgctgaatatcaacctgaactttttttttgcatcactgggcattatcatttcacactttgagttcctggagctggaagtacagaatccaaaaatatgtttatattttcaaatttctcttccactccaatgtaaaaataaactgacaaatgtttatatgttaaaaaaaaa

SEQ ID NO: 211982 - DNA, 419 bp, Homo sapiens
atgtgggtaatagaggtttgaaatgtatacagccagaggctggactctaggaaattcttccaaatcttgtagcttatacatgaaataaagttgacagagcttttccccattttaaaatatatcaaaaatttacacagcattataaataatgagtcgtgatgcagaagtaaagtttttctaatattaataatagcaaaaaaatcacttatgataggaaggctaaattattttttataaaaaatgatattgtataattcatgttatttgaagtgacaatgaaaaggtctgaagacaaaagacagtagtatagcagtgtgttatgcatttaatttatagttttttagattttgtgatgcttgtggtattgtgattccttttctctttctaaataaacgtttacttatatacttacttttaaa

SEQ ID NO: 211983 - DNA, 444 bp, Homo sapiens
catctgtgagtgttgtttcagaataatgggtgaagaaatcagactacattgggttccttaatttaaggcactatgatgaacaccttctgtgctgggtgctagagtccagaatctgacataatctctgctctcgatacagcagatttgtggcagattgaaaagtaggccgggcgcggtggctcacgcctgtaatcccagcactttgggaggccgaggctggtggatcacgaggtcaggagttcgagaccagcctgaccaacatggtgaaaccctgtctctactaaaaatacaaaaattagccaggcgtggtggcgtgcgcctgtaatcccagctactcggaggctgaggcaggagaactgcttgaacccgggaagcagaggctgcagtgagccaagatcatgccactgccctccagcctgggccacagagcaagactctgtctta

SEQ ID NO: 211984 - DNA, 438 bp, Homo sapiens
aggctcttcttcatcagctagactgtctttgccttgacaagccagagcccagtgtttggagcgaagcccaagttaaatttgatgagttatgtgaccttggacaaattcatttcatttctctgatccctgagggtggtgaaaacaatcaaaaagtgcttccaaataaggaataacatttggctcagagagctctctgcagagggtccagaaagagccacccactttctggagaattctttcatcttcagaattcccaatgagacaccgaggagaagcctctgcagcccccaatcctctccctggaggtctgttcatcctaatggcttctgtcctttctaagtgacacgtctacacctccagctctgggtttaaagatgcatcccttgaagggtccacagacacttacatccaatataaggacgtcttcctgacagcaaa

SEQ ID NO: 211985 - DNA, 386 bp, Homo sapiens
agtggtgacactctgtaagagaggaagtgattgtcatcatgctgcaattgcagcggtacctactagttaagatcaaagaaccattctctgtcttctaactctaaagaggtcagacctgcaagatgtcttacaagcagtcctcccaggaacatagttaaaaggtaggactgaggttccacaagatgtcaggaaataacactgaaagcaaagccagacccatgaatgatgagttcaccagttcaagcactggcacctgttcccaagcagactggtacagagaggctcccagctgaccaaactgcactaaattttctctctgttgtcttgcatggcattgtcttacagagcaaacaaataacatcagccatccttttttaccttgtaca

SEQ ID NO: 211986 - DNA, 444 bp, Homo sapiens
atagaataaatgcactgtagctaaaaattagatggctgaatccatggctaaaatgctacttttcttcaggattaattgagtgcaatcttttatctgtttctattcagcatatgtagtatatatcggctatgcatctgaggacagctgccattctatttacagcattatctaaaaatggcaacattaaatccatcttccatctctttgagatctttttcaactacagaatcatctcagatgttctgcttttagagcaaaatatatgaggtgtgaatgtgtgtaacagtaaaagactaacaggcagaaatccacgacggtggaaatatctaccagcgcttgataaaactttcctcctttccccatctcaagaaaagctagggcaaggaagctagaaaacatcagggggcaaattaaaaaggtagaaaaccctgcccttataccccc

SEQ ID NO: 211987 - DNA, 132 bp, Homo sapiens
ttctcgcatagggggatttggcagggtcataggacaatagtggagggaaggtcaatgctgtctcttttaaaaacacatttacagccaggcgctgtggctcacgcctgtaataatcctaagcactttgggagg

SEQ ID NO: 211988 - DNA, 610 bp, Homo sapiens
acgaagatcaaaaataaagagggaaagggtcttctctggcactcgttagtcttttacaacattctaaaaaacaatgtaggtaatggaaaaaggctaatttataatcaggcaaacaaatactacaacttcctaggttacagctatctgttagtgactcaagtcctataatcacattcttttaaggctcaaaataatttaaagtttcaacagctttggtcttgaattacttattttcattaaaaaaagacatcaatgccagagttaattatattctactggtattgaatattcgaagactatgccattttccataaaccttgctcaccccgtcaagcaatccttctccttaggaaccctttatgcatcacacggtattctacagaatatggaaaccagcctagctcatagactcttatgggatagtaagtgtgagaatattaatgctgtttatctctaactttatgttacccaccagcactttgggaacagacataattcagtgtaactgaaaataaacttccatgaagttcaattcagatacagtatcttcttgaatatgttccaacattgctccattcaattggtttattgatccataactcctatatca

SEQ ID NO: 211989 - DNA, 408 bp, Homo sapiens
cggtaccactctgccattgttgtcgttattttcattaaaaaaagacatcaatgccagagttaattatattctactggtattgaatattcgaagactatgccattttccataaaccttgctcaccccgtcaagcaatccttctccttaggaaccctttatgcatcacacggtattctacagaatatggaaaccagcctagctcatagactcttatgggatagtaagtgtgagaatattaatgctgtttatctctaactttatgttacccaccagcactttgggaacagacataattcagtgtaactgaaaataaacttccatgaagttcaattcagatacagtatcttcttgaatatgttccaacattgctccattcaattggtttattgatccataactcctatatca

SEQ ID NO: 211990 - DNA, 504 bp, Homo sapiens
attccctcaattcagatactttttttttctttttgaaagagatgtgtcttgctctgttgcccaggctagcctcaagtaattactcgggccttgggctcaagtaatcctcccacctcagtttcctgagcagctggtctacaggcacacaccaccaagtctggcagtcatctactttaaactaaatgttagggtaagccatttgattgaatgaattcataatataatgttgtagagctctgttcataaaacttgtatgattttatgataaaatttggtaatgtgattatctttagtgaggattgagccaatatggaatcagagtttagccctgcctctctaaattgttctttatccttaaatgtgtagtagctggattgcctacaattctacaattttctgttagaatttatggcagtagttttcaactgtggactgagaacattttgggaactgtgcccattataaagtttgtctgaagacctaataaataatttgcctttcaaa

SEQ ID NO: 211991 - DNA, 666 bp, Homo sapiens
aaaagcctaaatagccgagagtcctcagttcactggaggctccagatatcttcacaattgtaaagacagaaacaaaaaatttgaaaaataccaaaaggaaaaataagtgcaaaccaaaacagggaatgacaaaggaagccatctgaagatgccttcatcatctgaacatttctcagttgctattttactttttgaaagtagactgttatttaagagtcaattgcatttatctgtgcctcatctcccctatttattatgcctcctcaaggcattggacaatgttaaccacattccttttaactccccagaacattgagtcttatgcatcaagtgagagcaatttataagcccttcgttatgttttcccggaaactagatgaaagtgttttaagtaaggagaaatcacttaaaatggtaagcttgtctatttctctgcatggttgaggacgtccagctgctctgggctgcagtttgtgtcctgccatccctgcaaaacttctgcctgatatctgccttcaccaccacccaacccaaagcaactctgattctggcaagctgacctctcttttttcagggcaatttatctctccctgtgccctgggagaggccagacaacagtcctgagagacgctgccagcaagttgtttatgccaggagagtgttgcc

SEQ ID NO: 211992 - DNA, 426 bp, Homo sapiens
aaaagtttgaaccaacagcctaatgtgaaaagaaactgcactgaaaggtaaaggaggaaatggtgatgaactgggcttatgtgagaatgtctatattttcataacacagccccagaatctttctctcagttacagcctcaggcaaaccacgttctggttggtgggttctgcagggatctctcccaccactgagcctctagtcccaaaaccatccttgacaacatcgtgtgtctgttacttccctttgcccacctccaggccacctggggaagcccacaggcagccaagacccaaaaatgaaactctgtatttgttcttcaacacagcagtctattatctttattgtgacacatgacaagattcggtgcacataatgtataatacgagaggagtagagaaacgtaggaaaatcgcccgatctagtct

SEQ ID NO: 211993 - DNA, 764 bp, Homo sapiens
caagggcttcatgggctgggtcagtctatggtctggccctaatattttgtatcattatttttggtttctttgtttctgtagaggactatgcctgttcctgttctggtgtctgcgttctgatctctttctcccctgggtgtccctcatctctgacagcagcaggagtcatttttcctgtcattaaccccacaaggtggaaggcagcccctgcacacagaagtctgtggtattaagagatgaattttcaagcccgtgcagcttttaccctatttccagggctctttcttggattgtattttctatcttttccccaacctttttaaaggaactagattctgaaattagcagagaagagggatgccacaagttctcatcttaggtaactttctagtggaactcctcttctgctcagctctcctacccactctcccttccctgagttgtagtaatcctagcactggctctaatgcaaactcatggatctataaagcaaagtctaacttagatttatatttgtttggaaattgggattcatagtcaaagattgttctttcctaagagggaaatataattgcatgctgcagtgtgcagagggttggtgtgaaggagggatgcagggaggaagggagggaggacacacaagcagcactgctgggaaaagcacaggcggcctggatgtcagtgtgaggggaccttgtgctgtcgttgctgcaaaaccgcatttggcctgaggctatgttaataaagatactgcctttagaata

SEQ ID NO: 211994 - DNA, 401 bp, Homo sapiens
gccaagttggctcaagactcagggtaataaactctaaattacggtaagtctttaagttacattgaaaaaaccaccaaaaaaaagaacttaaagtcagaagaatggaaccatttgtctcttatctacctaggacctggaagcccaccccgcccctcccccaccgcgccgtcgagtcctcccagctttgcttcaagttgtcttgcctttctagacctgccccgtctttccagaccgaaccaatgttcatccagcacgtattgatggatgtgttatgtctccctaggaagtgtaaaagccagttgtgttctgaccacctcgggcacaggtcgtcaggaactcctgagagtgtcacagacaggtgtgttcaactttggcaaaataaactttctggattaactgca

SEQ ID NO: 211995 - DNA, 172 bp, Homo sapiens
atcactaaagtaacattttaatatatttttcaaatttgacatcctaatattcctttttccctcctccttactcactacgggtatttgcatgggacaaacagtctttgagggcaagatttttaactgcaccacgtatttgtgccataatttattaatcacagtttaaaaaaat

SEQ ID NO: 211996 - DNA, 552 bp, Homo sapiens
tttgtagacccctttcagatttactcaagttaatttctgtctctggcaggctcttacatcgtcgactaggcagcatacctgtgctaatcaaagacagtctggagggagtgacctgctttaggctttattggtttggcaacgttttaattcttacgcaactctgggtatgtttatggcactatgtaaatgttacataagaacatggaggctgagaagtggccagaatggtgactgtgaacacaggaaggttagactgaggactttatccaaaaggaccttgggaatctgcaatcagtacaggaagaacctgcacttattttcctctaagaacctttttagatgattatgtctttcaggtggactgctgtgttataaataggtttattctccaccggtgagctaattgtaaccttgctaccaaaatatgaatcagtaaacgatgagacgtgctgcttcttccagcatgtcctgttgaagctgcttgttgcattttggaacatgagttgaattgggttgcagtctgttctcataatagctgaggagcacagggtg

SEQ ID NO: 211997 - DNA, 401 bp, Homo sapiens
agaaataaagaagaatgggatcaagagaggaaaaggcattctgctcaaaggacgtttatagctttgctgtggttatccactaagtgcatcagttaaagaagcacgttttatcttcttttttgcttctgtttagacttcatgttaaaatggctctaggcttttctattaatagctctagctagttggtctttatgaagacatgctgcactaaatttgttctcatgattagaatcttgtaatcataattacaagaaggtatcttctcaacccctcaaattactcatttgtttttatagaggctgaaataatagagggctgtaagatttgacattcatccaagttaacccctttattgggttgttatggtgaggggaataaagactgagcttctttcttactta

SEQ ID NO: 211998 - DNA, 525 bp, Homo sapiens
aagatgctctttgtggagtgaatcgttaactggggaggaggccacctagattcagttatagaacatcgtggattagattgtcatacatcaaggagccgaggaccattccctgggtagcgaaggacttcactggacctccagaatcttcttcatggatattcattgcgccttcaggacctggacttcctttggaaagtccaaacttcctttggaaaaaagactaagaggaattcttcctgaagttccttgtctgactgtggccactgtctccctggagaactgcacttatttcagaaagaagagagacttctagataaagcgaggtgatgctggcttcaaaccaaattaaaaaaaaaagctggagatatgcaagttgctaaaccagcccttccctcaggctcaaatcagaggacaattggtaacaaccacctttctctcatttggttttgcagctcaaacaaaactgtcaccctcgccaaaacccctgaaatacagaaatgtggtattaaaacagttatgactgga

SEQ ID NO: 211999 - DNA, 419 bp, Homo sapiens
tcatgttttcatgtagcttgatgttttaattattcttcaatcagtcttcacaagcataatgattaatgttttcatacagttccttcaacaaatagttattcaagatagactgtgtgcattctacattcaggtgatagagcaggggataggacaggtgaagtcacttttgctctcagggaacttgcagtggtccatatggctttaccataattaattcactagttttgaaaacatgtttactatttattactagcataacaaatgcaatggaagtctcatgtaattatgttacatatacctgattatcaactgaatatagtgtcctcaaaataagtcattggtatagtttgaagtttttgatatatactgcaaaattactttgaagaagaattttataaatatccacatgcatatctgct

SEQ ID NO: 212000 - DNA, 155 bp, Homo sapiens
gttctgccctccgttttacgattcgcctacactgaaaatgcgtgagtggagtggaaagccttcctactcctgcctcagcgaccccttctaaaatactgcctcgtttggcctgaaaatgtgatttgcaggcttcctgagcaaagtagatttcactc

SEQ ID NO: 212001 - DNA, 490 bp, Homo sapiens
agagctggctttctcactctctaaatctatcacaggctctactcatcaatatactaataattcctgctgaactctaaggaactctttcccacagaaggaatataccctgggccgctcacagacaacgctctcccgccgctggcgctggtccgggatgcggccccgagacccctgcagccgcgcgctggctcaggggacctccgcaggacgcgggcgggcgccggggccgggtcgggcttgggcagagtgacaggctcccagtcgtgagcctcacaagcagatctatttacaatatcccggataggagtccaggtcgcgtcgctcgcgtcgcccgcggggacccggcgtgaattcacacgctcccctcccaccgcctcgccgcctgtcacggccccgagacccggtcagccccttcgggggttcccttcgccgcgcagtactccgcccgtgagcagcccccgcctgcgctcctccctccctagggcggccg

SEQ ID NO: 212002 - DNA, 995 bp, Homo sapiens
aagaaaaagaagaaaaaaagtgcatagaattctgccttgaacatcactgtccacgggctgccttcaaaagacagaagggctctaccacggaatgcctgtttcagatttaaaaaataacctgctgagatatgctggcagggcttccttcagcagccacaagaagcttctcaggtgagaagaaacccactgctgttagcactatagatttctttaaggtcacaggcctcttccaattaggggtatcatccatctctggtggcctttccctcctgaagctggggaaatatttcctccccctccaacccatttaccacccgctccatataaccgccttgaagacctctttgggcttgaagaataacttaagacagttttcctattgagtgctgaacatttgcctccccctccccctccagcctgtcactctttccgggcttgtgactgcttcagaattgtgaacttcaaatttccccactgttttgttgatcctgggcttttgattcaagggcctgtctggcaggagatggcctaagcacatcagcaatagcagatgacaaatgccaaaacagaaagaaaataggatacaaatgatttcctcctacatatttacatttacctgctccagagattgtgcatttggggttctacccgttattaagtaggagcctacgttatgcctataatgacctcatcatgctgcgtgattatgggctgcagccgccaaacactttcagacgacactgtgaactttaaattggcactccaatctcccagtggcctgtcagtcatgagaatcgcgtctttatgccagcaagccccttggatggagtctgacattgcaatcttcagtaaattaccctgtcactgacaatcttgcagttatctcgcaaacaatcaagcaggcaatcaaactgttctgaattgccagttcaggacctgagaggtggccgatgtctccattcaacagcagagggaaagcggcctggccctcctat

SEQ ID NO: 212003 - DNA, 860 bp, Homo sapiens
tttgaggtttagtttcactcttgttgccccagctggagtgcatggtgtgatttcggctcacagcaacctccgcctcctgggttcaggcgattcccctgccctcagcctcctgagtggctgggattacaggcatgcgccaccatgcccggctaattttttgtatatttaatagaaacggggtttcaccatgttagccaggctgctctcgaacttctgacctcaggtggtccacctgcctcagcctccgaaagtgctgggattacaggcgtgagccaccatgcccagccattccttctaatacttgtaatttcattattcccttgcaaccaatcttttcacatatctccttacagattttcttttacacaactgaatcatggtttcaatacagttttgtatcctttggtaattaacatttcagaaatatttttctgaaatatttagtgtgattccatttttcttaaaaaaaaaaaatgtacatcaggtgtggtggctcacacctgtaagcccagccctttgggaggctgaggcgggctaatcacctgagcccaggaatttgaaacaagcctgggcaacatggcaagatctggtctctacaaaaaatgaaaaaattagctgggcatagtgtgcacctgtagtcccagctactcaggaggctgaggtgggaggatcacctgagccttgggggtcaaggctgcagtgagctatgatcatgtcactgtactctagcctgggcgacagagcatgaccctgtctcaaaaaaaaaaaaaaattctcatctgcatttaggatttttagaaaatctcctctagttagaagtacaaaaaatgaagttcttatttattcatttattgagatgg

SEQ ID NO: 212004 - DNA, 486 bp, Homo sapiens
attatttttgcatattgcatattctcttgattcagttctcagtaaagatgtattgaccttactgaagtcattttgaaatattaaatcttaacctaggtaaagcattctttaaaatattcctggtgtttgttggatacttacagattctggaacctttctttaaaaagtgttttccaaacagaagttgctctacgttagagtatgatggacttttatgtcgtaacacccccgaaacactttaatgatggcacagtgaaatgtgaaggttgagaatgtagagagaaatttctatgtaatttgggacttccaatggctaatagaccccaaaatatgtaatacaatgttcagtgaatctagaggtacccaattcattgattcttttttttttttttttttttttgtttttgagacacagttttcgctcttgttgcccaggctggagtgcagtggcgagatctaggctccctgctatctctgcttcccggt

SEQ ID NO: 212005 - DNA, 407 bp, Homo sapiens
agagttccccttaagaggatagcacctgttaaatggaaaagtgattagctattataagtttagaaaaaacacaacaaactaccatagaatctttattcataaaaatccttaaaacgagaatgaaataatcactttcattcatttcatactagcgtgtattgtgcccagtctttttaaatacggtgtcatccaggcaaagctgaatgagacatgaagcctaccctctcttcctgttccagaaagctcctggttagaattttactaaaggaactccccttaacgtactcttcctgtaaaattttctttctttctccctcatcaccttcattagttgtctctttatttgtattttgtttgaatgcttgctggtcttaattgttgaatataatgtttcatttattataaac

SEQ ID NO: 212006 - DNA, 333 bp, Homo sapiens
ctgtttctccaagtgagttccttggaatactaatagatgctataaaaatgtcatctaggtgtggtggctcacatctgtaataccagcactttggaaggccgaagcaggaggattgcttgaggccaggagtttgagacccaaagccctatctcttaaaaaaaatataggtggatgcagtggtgcatgcctgcctatactcccagctactcagtataggctgaggcgggaggatttcttgagtccagagttcaaggctgcagtgaactgtgattgcaccactgcactccggcctgggtgactggtcaaataagtttgggaaatgctaagggttcc

SEQ ID NO: 212007 - DNA, 440 bp, Homo sapiens
ccagcacttgggaggccaaggtgggaggattgcttcaggccaggaattcgggaccagcctgggcaacataatgagacctcatctttaaaagagaaaatttaaaaagatgtttcagatttgcccataccttagcacatgtacatttaaagaatacaaacatggcccagtgcagtgtctcacacctgtattcccagcactgggaggccaaggtgggaggatcacctgaggccaggagttgaagaccaacctggactacatagtgagactcagtctgtacaaaaaaatttttaaaattagctgatcatgatggcatgtgcctgtagtcccagctactcagaaggctgaggtggaaggattgcttgagcccaggaggtcaaggctgcagtgagctatgattgcaccacttcataccagcctgagtgacagtgagaccctgtgtc

SEQ ID NO: 212008 - DNA, 637 bp, Homo sapiens
aaggtaggaactttgccttttaactccttatattcttcccagcagcatttttcaaatataggccctgacccagtagcaaatcatgaaattagtttagtaagtgtcaccaacattaaattaaaataatcagaatgaaatagaacagaaaatttctgattgcaaaatatctagtgttatttagtgcatgtatatttccctcacccccaaattcatagtttgaagccctaacccccagtgtagctctatttggagtaaggaagtaattaagattaaatgaagtaataggggtggatctgataggattagtgtcattctaagaagaaacaccagagagcatgctctctctctttccctcttatatacacacatgtgaagatagtgagaaggtggccgtctgcaagccagaagagagccctcaccagaagcctaccctgaaggatctgggtcttggacttctagcctccagaactgtgagataatacatttctgtttaagccacccagtctacgatattttgttatggcagcctgagcagactaatgtgcctacaggagagttgttcagtgaaatgtgtgtggttgtgtgtgtgtgtgtgtgtgtgtgcatatgagagagagctgggttttgggttttgata

SEQ ID NO: 212009 - DNA, 239 bp, Homo sapiens
caccgcgcccggccccaaaattcttaatttaatcatgcctgcaaagactcctagccctttttgctgtaaaaggtaacattcacagattcccggtattaggctatggatatcttttgggccatttttcagcctatcatagtctcttctctgctcgtctgttccacaggcaaaatacacccatctcattccaacatccccaaaagtctcaacccattgcaacatcaactcaagcccgagat

SEQ ID NO: 212010 - DNA, 511 bp, Homo sapiens
tagctgggattacaggcgcccaccatcacgcccggctagtttttatattttttagtagagacagggtttcgccatgttggccaggctggtcttgaactcctgacctcaggtgatctgcctgccttggcctcccaaagtgctgggattacaggcatgagccaccgtgcctggccagatatggccaattcatttttttccctctcagatatcatagttttcatctctacaagtttgacttgggccttctacactcttaatctttcctttattctgtattcctcctttccactgtttcccacctatacactgcattcaaatgcaacgtggtgttccttctataatgtgtatccctcctatcctctgcatcccatatgtaatctacagcctcctcatcctgcttatttttctcacctcagcatctacatttatcttgcactactctgcttctgtccaggtaggaaacctactcaagatttcaactccacttccaactcttccacctgtcattcca

SEQ ID NO: 212011 - DNA, 487 bp, Homo sapiens
ggggcaggggtcctggcgctcctctgtcctccacatcctctgagtgttctgagcatcctgggctgctttggtgttttctactcccctgctgccctctggtcctgccaccccgagctgacaagcctgccttctgctggctgccttcaaccactcagagaaaccacagctcccccctccgcagaagccgcgctcggagcagcagaaggaaggcgagtggacaccaatctggcctccggacggcaccagggcctcccacagagcggagtggacactgggcccattctcctctcttgctctctacagccccgtggccccagcgcaggagccagcccatggcagctccaccccagaccgatccgatcccagcacctgggcccaggaatgtgcttggccaccagattcccagcgattctcaccaaagtcaggcaacctctggcctacagcttgagaatgacgtccaagcagctcgcctttccctgggcggccg

SEQ ID NO: 212012 - DNA, 446 bp, Homo sapiens
aacctattcttcctgtctgaaactttgtactttgaccatcatcaccccttccctgttcactcctccctcccccagcctctggtgactatttttctactctctactaatgtgagttcagcttttttagattacatatgtaagtgagataatgtgttatttgtctttctttgtttgacttattcacttagcacacacagtgtcctcttaaaatgacatttaatatcccatttctagttcgttattatttaagtaatttgcaagtacattctcattttaaaagattaaacgaaaggaacatgtaaagaataaagctgggggctgggcttggtggcttatactggtaatcccagcactttgggaggctgaggcgggtggattacctgaggtcaggagttcaagacccgcctgaccaacatggtgaaaccctgagtctactaaaaatacaa

SEQ ID NO: 212013 - DNA, 817 bp, Homo sapiens
gatggctcctgaaatatgtcactttggtgaagcatgacggttgggtccctagctgagagtctgagaaaatgtttaggaatgcaaccctagacttcgctctgtcttcacctttgctgtttctctccctttcttgtgatccagttggagcatcagttttagaggggtgaaaagagctgaggaggcaggaggagactgagaattagggactactggctgggaagtactttagccccagctagctgctgccaactgctgttcccggccacatggtgttatgtggcgatagctagttagtggccttccgtaagcaaaggatggcccagtattcagtttaaacaaactaaaaaaacagtgtggaaagagcaggcatcccttccacagatgtggtgagtcctgcatcatatcctctttggtgggcattactatgtaatttaaaccacatcattccaacatgtaatcaatatggaaaaaaataacaaaattatgataaaaataatttttttttctttttttttattattattatactttaagttttagggtacatgtgcacaatgtgcaggttagttacatatgtatacatgtgccatgctggtgcgctgcacccactaactcgtcatctagcattaggtatatctcccagtgctatccctccccccttcccccaccccacaacagtccccagagtgtgatgttccccttcctgtgtccatgtgttctcattgttcaattcccacctatgagtgagaatatgcagcgtttggttttttgttcttgcgatagtttactgagaatgatgatttccagtttcatccat

SEQ ID NO: 212014 - DNA, 327 bp, Homo sapiens
gctgtgtgtggaaactgggagttgcaagaagagataaggaaacccatggtgacagcaaatgtctaacaaggtagatagatggattaatcataagaacatagcgctgaatttagaaagtgagaaatactaagtgctagagcacaaaactatttgtgtagatttaaaaacacacaaatctcatctgccataataaccacatacctcaaatgattgccatgagtagggtaaaacatgaaaatagtccctgtcatgtgttaagcacttagtaaatattcactattgttagataaaaagatgttcacagtatactataaactttctattaca

SEQ ID NO: 212015 - DNA, 545 bp, Homo sapiens
tccagaatcccctgtgtgggtcagcagctccctgctctcccggttgctcagcccagacatctggaaatccctcctgactcctctgtatccatccatcaggtactcccataaattccgccctgcaaagcccctctactcttttctgtccatctcgactaccaccatcctgtaagccaccattacctcttcccaagtgctctgttccttgggtaaccacctcccttactaggcccccacttcactattacttcctccaattcatgtctgcacacagccagagtggaccttttaccaaagacctgagcatgcttcatatgaagccagacctcggcctgcatgcggtgagtgtgcagcagcccttgaccttggtccttgtctcctacctcgggtcatgaacagcaaaggtgagcacacatccctgagtgccctggacgggcctggctggggccagcgtatcatgctgtgcccagtatattattcatagctccctttcactcttaaaattgcttcagttacgacaataaattatatgatcacagaatgaa

SEQ ID NO: 212016 - DNA, 646 bp, Homo sapiens
actggggccgtatccgcgtttcactcagcctccttggcggccgagtcttagtttgcctctcggtgacatggggggaaagaaggaaactcgctttgcggggtgttcgtggattcagggagggaactaatatgtgaaagaagtgtttaacaccgacagggaacatttaatgagacttcacccaggaacttcccaagccttatttcatttaatgttcacaacggccttctggtttatcctcatttacaaaagcagaaattaaggcgcagaggggtcaagtaattttctccaagtcacagtagccacagaagtgcaaaggagtggtgccagtacctattatttattaatatttcctggtgtgagcatgtatcatctcttagtgcagagggtatttttacctagccttgggtcacaccatttaattaggggcataactctgggttttccctgacttctgggccgttgtccactatactgtggatgaaatcccattctggggttaccatagttctaaagggaaaggtttggatgaattccttgctagtgttgcggcagttagaagttgatggatgcagactccaggtctcagacacaactcaaattccctggggttttggctcaaggaagctttgagactgtaaacggtggg

SEQ ID NO: 212017 - DNA, 1012 bp, Homo sapiens
  misc_feature (52)..(52): n is a, c, g, or t
  misc_feature (130)..(130): n is a, c, g, or t
acatgaaaggatgtgaatttggaatcagagaaacctgagttccaccatgctntcttcctcttgcaatccatgaaatccacagtgggttagtggatattacaaaacctctggtcccacctcattaagatgnaaaaaaattatactaattgaaagaatgaatgtgataatgagaagaaatggcatcaataaagtttctggaacacagttatgtgcagtactgaagagcaacttcagctattgagttacacctcaatgcaacctcctggcaggccagccttaagcccagcagtcccaccatgcatctaagctgcgttctcatcagacccaacttcaattataaataactgagatgatgccagaggccagaatccctgagaacccaatttgctgtcatcaccatggctgaaacaaggcgcttggcatctagaaaagctgatctgtaggaaatttccaatagagttcaatttttctaagtttaaaatgtacaatatcatcaaggtcagacactcgagataaaactaggcttgtttttaaatataataaaaatatttgaagaatagtaagagtggtgactacttttacacaggaatgttttaaataaattgtttttttctggtgccttttaaattttgtgatttgtcaatgagatgctgatatatttttaatgaagcatgccttgtaaaataataagtgaatgaaaaatacacagtaatattcacatcaacaaagctagaagaagactgtatgtctcaagaggctccatcatctacccagtggccacttgaccaaattaagatccaaataccaaaaagaaaagtaattaaaatttgtgttgtatgccttataagaccaaacctataaaatgaggggaaacttcacaattacttgtaatttgctgtgtggaattgtaacagatggattattaagatgattcctgataacctctaaatgtggttactacaaaaaaaaaaaaaatggccttcgtggccttcaccggggaacctttccgccc

SEQ ID NO: 212018 - DNA, 851 bp, Homo sapiens
  misc_feature (40)..(40): n is a, c, g, or t
  misc_feature (46)..(46): n is a, c, g, or t
  misc_feature (60)..(60): n is a, c, g, or t
cagaagatacccggcacgcgagagcacaaaaacgggcttnagggtnactagcagtactgnattagcacttcagctattgagttacacctcaatgcaacctcctggcaggccagccttaagcccagcagtcccaccatgcatctaagctgcgttctcatcagacccaacttcaattataaataactgagatgatgccagaggccagaatccctgagaacccaatttgctgtcatcaccatggctgaaacaaggcgcttggcatctagaaaagctgatctgtaggaaatttccaatagagttcaatttttctaagtttaaaatgtacaatatcatcaaggtcagacactcgagataaaactaggcttgtttttaaatataataaaaatatttgaagaatagtaagagtggtgactacttttacacaggaatgttttaaataaattgtttttttctggtgccttttaaattttgtgatttgtcaatgagatgctgatatatttttaatgaagcatgccttgtaaaataataagtgaatgaaaaatacacagtaatattcacatcaacaaagctagaagaagactgtatgtctcaagaggctccatcatctacccagtggccacttgaccaaattaagatccaaataccaaaaagaaaagtaattaaaatttgtgttgtatgccttataagaccaaacctataaaatgaggggaaacttcacaattacttgtaatttgctgtgtggaattgtaacagatggattattaagatgattcctgataacctctaaatgtggttactacaaaaaaaaaaaaaatggccttcgtggccttcaccggggaacctttccgccc

SEQ ID NO: 212019 - DNA, 851 bp, Homo sapiens
  misc_feature (36)..(36): n is a, c, g, or t
  misc_feature (40)..(40): n is a, c, g, or t
  misc_feature (46)..(46): n is a, c, g, or t
  misc_feature (60)..(60): n is a, c, g, or t
tcgtttacaaatctctgaatagttgaagtaaagatncttnagggtnactagcagtactgnattagcacttcagctattgagttacacctcaatgcaacctcctggcaggccagccttaagcccagcagtcccaccatgcatctaagctgcgttctcatcagacccaacttcaattataaataactgagatgatgccagaggccagaatccctgagaacccaatttgctgtcatcaccatggctgaaacaaggcgcttggcatctagaaaagctgatctgtaggaaatttccaatagagttcaatttttctaagtttaaaatgtacaatatcatcaaggtcagacactcgagataaaactaggcttgtttttaaatataataaaaatatttgaagaatagtaagagtggtgactacttttacacaggaatgttttaaataaattgtttttttctggtgccttttaaattttgtgatttgtcaatgagatgctgatatatttttaatgaagcatgccttgtaaaataataagtgaatgaaaaatacacagtaatattcacatcaacaaagctagaagaagactgtatgtctcaagaggctccatcatctacccagtggccacttgaccaaattaagatccaaataccaaaaagaaaagtaattaaaatttgtgttgtatgccttataagaccaaacctataaaatgaggggaaacttcacaattacttgtaatttgctgtgtggaattgtaacagatggattattaagatgattcctgataacctctaaatgtggttactacaaaaaaaaaaaaaatggccttcgtggccttcaccggggaacctttccgccc

SEQ ID NO: 212020 - DNA, 815 bp, Homo sapiens
  misc_feature (14)..(14): n is a, c, g, or t
gactgaagttatcngcagcactgccttacaggttaaaactttgagttacacctcaatgcaacctcctggcaggccagccttaagcccagcagtcccaccatgcatctaagctgcgttctcatcagacccaacttcaattataaataactgagatgatgccagaggccagaatccctgagaacccaatttgctgtcatcaccatggctgaaacaaggcgcttggcatctagaaaagctgatctgtaggaaatttccaatagagttcaatttttctaagtttaaaatgtacaatatcatcaaggtcagacactcgagataaaactaggcttgtttttaaatataataaaaatatttgaagaatagtaagagtggtgactacttttacacaggaatgttttaaataaattgtttttttctggtgccttttaaattttgtgatttgtcaatgagatgctgatatatttttaatgaagcatgccttgtaaaataataagtgaatgaaaaatacacagtaatattcacatcaacaaagctagaagaagactgtatgtctcaagaggctccatcatctacccagtggccacttgaccaaattaagatccaaataccaaaaagaaaagtaattaaaatttgtgttgtatgccttataagaccaaacctataaaatgaggggaaacttcacaattacttgtaatttgctgtgtggaattgtaacagatggattattaagatgattcctgataacctctaaatgtggttactacaaaaaaaaaaaaaatggccttcgtggccttcaccggggaacctttccgccc

SEQ ID NO: 212021 - DNA, 806 bp, Homo sapiens
tactatgagtgaacaaagcaacacaaaagagtttagttacacctcaatgcaacctcctggcaggccagccttaagcccagcagtcccaccatgcatctaagctgcgttctcatcagacccaacttcaattataaataactgagatgatgccagaggccagaatccctgagaacccaatttgctgtcatcaccatggctgaaacaaggcgcttggcatctagaaaagctgatctgtaggaaatttccaatagagttcaatttttctaagtttaaaatgtacaatatcatcaaggtcagacactcgagataaaactaggcttgtttttaaatataataaaaatatttgaagaatagtaagagtggtgactacttttacacaggaatgttttaaataaattgtttttttctggtgccttttaaattttgtgatttgtcaatgagatgctgatatatttttaatgaagcatgccttgtaaaataataagtgaatgaaaaatacacagtaatattcacatcaacaaagctagaagaagactgtatgtctcaagaggctccatcatctacccagtggccacttgaccaaattaagatccaaataccaaaaagaaaagtaattaaaatttgtgttgtatgccttataagaccaaacctataaaatgaggggaaacttcacaattacttgtaatttgctgtgtggaattgtaacagatggattattaagatgattcctgataacctctaaatgtggttactacaaaaaaaaaaaaaatggccttcgtggccttcaccggggaacctttccgccc

SEQ ID NO: 212022 - DNA, 391 bp, Homo sapiens
aactcatcatttttatggctgcatagtattccatggtgtatatgtgccacattttcttaatccagtctatcattgttggatatttgggttggttccaagtctttgctattgtcagtaatgtctcaataaactccttctttctttgcctagttacacctcaatgcaacctcctggcaggccagccttaagcccagcagtcccaccatgcatctaagctgcgttctcatcagacccaacttcaattataaataactgagatgatgccagaggccagaatccctgagaacccaatttgctgtcatcaccatggctgaaacaaggcgcttggcatctagaaaagctgatctgtaggaaatttccaatagagttcaatttttctaagtttaaaatg

SEQ ID NO: 212023 - DNA, 390 bp, Homo sapiens
ctagaggatccccatgactgctgtcagctactgcagtagatagggatataaaggtgtgcgccaccagaccccagactacattttagtatataaagtagagacagggttaacacaaaacaggagcttctagtcccaattcagccattaactgattagttgggtgacctcaagtcactttcccagatcaagacagtcctgggggaactgacatgctacactctgtctggcaaaacaatggtgggcggtaagtagccaaaagttcactgggatccgacgctgctgggctgcatacaccggtgactcctggtcatccaaacgccgcttcattctgtgctcatgctcagggatgcactacaaccgcagagctgcttcggccgctcgtcactgcgt

SEQ ID NO: 212024 - DNA, 362 bp, Homo sapiens
ggctaagtgactcacaggtgaaaagctgttacagcgtggatctgctggacaaagggaagattcatgtcctgagagggacggaacctgacggcccaagatttcatcacactactcagaactgcagttgctgctgtaaatggattccaaaaccacttttaattgacccaccctacattgcctcagttcatctctcattctgcaccagctgcctgttgtcccaaagtttcaatgctaattccactacagcatgctcctggaaacttatgataaggaatctggaaccatctggttttagttgactttttaaaaatacgttttagtgtcacagttgtattattaaacataattatgcctggtaaaaa

SEQ ID NO: 212025 - DNA, 411 bp, Homo sapiens
tacacttggcagaaagagtgaattcagatcgagttacttctgtgctctttgtttctgaacctgtcccttgagggtgagcagctgctgtgtcctccacatccaccatgcctggaaccccttctggcactcagccctctctcacgtccatctagatgtgacattctccctccaggccaagccctgcttcctccgtcgtgtgagcttgctatcatgtcataaattgctcaaaataaatgaggcatagactggtacttggaagctgtagtaggatttgacctaccgagagtctgaaacagcagcgtaagatgtgagcctgtgaagagaaggttcctgagatcgggctgtggtggaggtcaggccagggacctgtgttcctgtggaccatgccatgaattccatgattcctctgaa

SEQ ID NO: 212026 - DNA, 366 bp, Homo sapiens
tcccaaagtgccggcattacaggcgtgagccactgtgcccagccccatataatattctgttcctccatctcctgctgcgctgatgcgagccatctctttgtagcatctcctggggtgccggtgcctgcgtttcttcagggaatatacccaggagtgcgtagcccagggcagagggtggggtagcttcagatttagtgggcgctgccacacagcctcccaaggtggtcaaatctgtgtatcctcctagcggtggtgactgaggatcttagttgctccacctcctcaccaacatttggtaccgtcagactttttggttgaccttggaacatttttattcttttttcctgcaaaagtaacaccactggt

SEQ ID NO: 212027 - DNA, 364 bp, Homo sapiens
tgcctctcctctcccttttttctatgttgtcattgccttcttctaactttacatggggccctcgttttttggtgttacagggacaaccatgtatgaggtttctaagccgaagttcacacccttattggggtgaccaagaatagagatgcaggcatatgggagtgtttgtttgtttgtttgttttgaaacagggtctcactctgttgcccaggctggagtgcagtggtacaatcttggctcactgcaacctctgcctcccaggctcaagcagtcccccgactttagccccccaagtagctgggacaaaagctgcgcaccaccatgactggctaatttctgtattttttgtagaggttggattttg

SEQ ID NO: 212028 - DNA, 340 bp, Homo sapiens
atgacttagacttttgtgaagaggacaggtcaattgtctgaatgtttcattgtgattagtttcagtctaaatatgttgcctaggatacttacaggtaaggataaatccagggttgtctatgtctagtttatatctatcgtttgggtataattattaataacatgtaattttactctcagaaatgaaccttttagctgataaattgtatggctaaccaattcataggtgaattcatactttattgttgcatcaaattaggaggcacataatgcaaattgtctatcatttgtgataactttcattacttgattaaagtggtgattaccccatctctccatta

SEQ ID NO: 212029 - DNA, 418 bp, Homo sapiens
gcagcggaaaaggatgttctacattccgctgacaccatctgatttgttgggagccgaaaaggccaaagagatcgtgaccaactcagcattccactggaggctatatgatcaaacagcaaactgtttatcatgaatacaggatgtgagcaaactcacgactgcacctgccgccagaaggtttgctgagggcggtcactccctggtgccggctccttgaagttatcttctgggacatctagggcctactgttcaaggaatacagtcttgcaagcctactctagacggagcagctgacctcttcttccacccctccttctcgctatctcttttgcctaataaatatggagggctgtgtaaagttcagggcccttgtccactagaggcaaggtgccccctgaccccttcttccaaacacatt

SEQ ID NO: 212030 - DNA, 411 bp, Homo sapiens
gctctcaggctaaattttcagctcctcacagccgggactatttcttgttcatttctgtattccaaccatcttttattatgcctttcacagttggcattctatgaaaggctggttaatctttctaagcattaaaccagccttttggaaaaataatgtaatatatttacagagaaatgatatatgatggcgaacagtagtttatgctctctgttgccttgtatttctccacaaaagtaaataacaatgacaaaaacacaatatcaaatttagaaatgaaacaagatttgtttgaaagcatttatttgaataacttaaatgaaatagtcagagcagtataaatagcatactacaagaaaataaagtcataaagaaattttcaaaactctctgccagcttttcatagacaataga

SEQ ID NO: 212031 - DNA, 450 bp, Homo sapiens
ctttgatttattcatgttaataataatgatgactaagttatagccttaataagaaagcaggaccatctgcaagactataaatgatttttactgctggtttcataaaacactgaagtgaaaatactttattctctgattacaaatcaaagtagagaacaacattcatctaacataaccacaaaccatagtttaagccaatagattcaacgcctaaagtaaatccatctataaaaatatgggctagaaatcagacaagtattcagaaaactgaagatactatgtatcctcagatgtagtaaattctactgcgaccaactgtgttaaaagtgtgtttcaaatgaaaacaagacatctacaacttttgttgaaaaaatcagctaagttacagaaaccacttttctcaaagaaatgtaaacaaaatttcattcgttgatatttaagtagatcact

SEQ ID NO: 212032 - DNA, 361 bp, Homo sapiens
ttagacacattgtgaccagttggctctgtatagaagaagaattctagctggtctgagaaagcaatgaaaggcctgtctttgactatgaaatatgagatgcaacagaggaaaaagagactgaacagttaaaaaacagcaaagaataaagagcataaatgggtaagaggccagcagagcctaatggtaattagaaggaatggggtagcaacagtagcaggcagcagaaattagaagctatgacacaggtggcaacttgtagacattttagaccacagagaatagccagccataaagaggactgggctgcatgccaaccagtaggttttagcaattgcaagagagaaagagaagcttcagcctt

SEQ ID NO: 212033 - DNA, 247 bp, Homo sapiens
ctttaaattaggagggaaaaagaacataagcataagagcatccccagcagcgatgttcattcagtgcctctgaaggctggagggctgcttgttgctgggtgagactcggaggggaaccgactcagggtcaggaatgatgacatcccacggtgggtccacagtgaagaatcttccccgctccactgtgggacgccttaacagcccttacttccacttacgctttgcgttatctcctgaaaaataaaat

SEQ ID NO: 212034 - DNA, 182 bp, Homo sapiens
  misc_feature (9)..(9): n is a, c, g, or t
  misc_feature (15)..(15): n is a, c, g, or t
ttggaaccnttctanaccccttgtaccccacgatggggcgacagatgagactttgtcttaaaaaaaaaaaaaagaaaagaaaagaaatccggaacaagagctggaagcagcaacccacgtcccatgtgggctgggcggcggcggcgctggtcaggctgagcaaccccatccaggctgcgtta

SEQ ID NO: 212035 - DNA, 372 bp, Homo sapiens
gggccatttcaagatatggcaaagaaacatatttggggttaaaatattttgatttatctgtcatgtgatgttatgccagagtcaggttggaaagtaagccacatcacatagggttaaataaaactgctttgagattttataaggtgcaactccccagccccttagataggaatttgggcaagagggaaaaaaggtcagagtttagtcctcagtagctaactgtaactccacctcctgggctcaaagatcgctcccacctcagcttcccaagtagctgggaccacaggcgcacacctgcttatttttatttattttttttagagacaggcgtaactacgttgcgcaggcaggttaagaatgccttttattata

SEQ ID NO: 212036 - DNA, 532 bp, Homo sapiens
attcaataggttggcagctgaacggcagaaggtagctttggggttctgaactaataaatgttcatgatatgtgaaaaagcatgatacatactgtatgatctcaatcacataaaaatggatgttatgtatatacacacacaagacctagaagggcatgtcaaactgcttatgattgtggatgactctgttcctcatttcttgtgtttttcagtttccaatagcgcacgttaattttttttaaaatgaagcttatttttaaaatctggaaaaaaaaatcacagtagccaagttaagtccttacatttcaattataaacatggatacgaactcatgatttatttttctcttcctaaaaattaggtattttctagctctgtcactgaaaatgcctagaataacaacccaacagtaacaaacccttaacaactgtttgttgtttctaaaaactatttcctaaacacacacaacagaacagtttttcagagaaatgactgattctaatctggagaaggatttgtacaaaatgagcctg

SEQ ID NO: 212037 - DNA, 1531 bp, Homo sapiens
ttggaggcaagggtctgcccccggctcttacttaaggagcgggacgggggacgagagcgtgcgcggcgtcacacgcacgcttagccaccccccaagaagccgccgccgcgctcaagctccgcgcgctcaggaccaggtagcgtgtagctgtcgtgaagctccctttgctccggttgggactggctgcggatacctgtccgttatccccggcaccaatgagagggacgaacaggaccacctgcaccgcccaccaccctcgctaacaacgctttaaggcctaacgcaggaggcagctggtgcgaatttacaaatcgggtttttcacccccgcgtggctgcaatgtccgcccagttcgagccccacattctcccgctggctccgcctgggggtcgggccaactcttgctgctaaggaagcctcaccagtccccttcccgtttgctacctaaatgtcctcggcgggaaactgctgagaacaatttggggaagcctgaacttgttcctagttccgcgctttattacttgtgatcatgactggtcagaactccgcccggagcctccatttgttcatctgaaaaatggggttgagaagctcaagtaccagaatgtgaaaacgctttctaaaggcgaaggcatggtatcttgtgagatagtaattccttcaaactcacgcataggctattcctattcctaactttgcgatctgctttcactaggcaatccctttccctttgtatccttataattttcacctatagattttacccccagggttttttaatgccctctgaacattatttccatttcagttaagcttgtctggccaaatttggttgtcctccagagtctgacctctttttgcttggcgcttgtttcaccaggttgaagtggtcctttaggtctcagtttttcccgtatggggtgctttacttaaaccaaggtgcctcggggccagtgctagtttcctagatactggaggaaagcaagcaaggaaggagtagagaatccagtcacttgacttcattatcctcttcaaaccgaaattttgaaggacaaggaaaagtttcaaggctgcagcctttcacagtcctctgagggacaaaactcaaatatagttcttgccttgaaggtggtcacaaacaaaaagggtaaatgatcctaaggtttaaatatagacctaaaagagagatatatacaatggaaatttaatcttgtaattctttgcaggcagcagtaatttataggttaaagtcctggttgtagtttaattataaaatatgttcttttattagtatttatcactatggtgacttctttagccaaagagtatctaaactgaactctcagagctaacagaagtaactatgttgcagtgagagcaacagtcctgggtctctacctcttgttttctatgtgaccttggcaattcaaccaacatctttgaggctgtttttttggtaaggaatggaaagaacatatggcaacagggatttgtaaagtaccgtataaatatatatatttaaattaagtgc

SEQ ID NO: 212038 - DNA, 756 bp, Homo sapiens
aataagtataaacacaacaagttacaaatatagtactgagagatccttgtgcctatggccccgcctccctcaggcagtatcttacataactatagttcatgattacaactggaaagttgccattggcacaatatcagaaactagtctgcagaccttgctcagatttcaccaggttttttgtgcactcatttgctttcctgaaaatattttaaggtttttctacatgacttatctccctgacatactgtgagataagattttttttttctctgaatgagcttagagaacaatcaatgtgagagatgggaaggatgatttggtgcaactctgttttatccatggtgagtctggacctcagagcagaaggaccctcgtctctcctctggggagtcctggtgccacctcagtgcaggctgctaagttatccgggtctgactttcttcttctctgctaatatttgtcttaagcatgtaacacagccatgcttattaatgatgaggagacagccaatgaaaattaattttttcaaagatgaatagatatctagattttttcaagcacaactcaattaagaaaatatcacctcactgagccccaaatgagttaggtctcactgagaaagtgtctcctagtgccaggcaaagtgcctcatatttgtaatcccagcacttctggagactgagataggaggatctcatgagcccaggagttcaagaccagcctgggtaacatggcaaaaccctgtccctcctgaga

SEQ ID NO: 212039 - DNA, 575 bp, Homo sapiens
  misc_feature (563)..(563): n is a, c, g, or t
tacctatgtaacaccacctgcaaatgcacccctgaacctaaaagtctaaaaaataaacataaataacttgacctaattcttatcttgatgtgaatatgttatcatttgatatatagctatatttatctgtttctgcctgtatttaatttcagggtttgttgttcttacaatccttgtttatttatttttaaaatttaaaatacttaaataattataaaagtcaaaactacataaaaattcagtctcaaagaatatctcatgcctaggcgcggtggctcatgcctgtactcccagcactttgggaggccaaggtgggcggatcacaaggtcaggagtttgagaccagcctggcaaatatagtgatgaaaccccatctctactaaaaatacaaaaaaaattagccagacgtggtggtgggtgcctgtaatcccagctacccaggaggctgaggcaggtgaattgcttgaaccagggaggcggaggttgcagtgagctgagatcgtgccattgcactctagcctgggcgacagtgtgagactccgtcttaattttagaacttgagnccaagcttttgc

SEQ ID NO: 212040 - DNA, 368 bp, Homo sapiens
ggggcaatccaatattgtacaactgtacggaaattgcagacttgacttcttcaattgcaaggtcaatggtgaaaaaaactgactctgctggtttgaaatgacaggaccaactgtattaataccttcatgaaatgaaatagaaatggaacttagaaaccacagggacttcccagtgagttggtgaaaatcccttcttctccaaagtctagttactagcttccatttcaggtataaaagttttcatgaaaacaaacctgcttaaaatgaagctatttgtgactgcaaatactttctttaaggtccaggacacattaataccttggcctgaagttgtacttaatacagaggattagggtatttgatgtgag

SEQ ID NO: 212041 - DNA, 361 bp, Homo sapiens
gggttttttttttaatctacaaaatgggtatgtagcacatacctgagtctttgagagaattgaatgtaaaacgttttaatactgtgtcaggtagggaattttgtcaacactaggcactaaattttgttaacactaaacactaaaaactttgaaaaagattggtttgctttggatcattaccaagcactttcatcactgaaataacaaaataaactcagttgttatcatgacaaatgccctgggagtacttttcagtataataaactaattttatttcttcattaacatgtgtactcctgggtgaaccctactaggactgggaagagcaagccgtggaaaggctatagggcttgcacgtaca

SEQ ID NO: 212042 - DNA, 381 bp, Homo sapiens
ttgaacttcccggggcttaaattagtagggatatgttctgacagagggtagaggacattctgtctgaggagcacatgagtgagagtggaaggctaggaaaaagctggagacaagagaaatcaaatccatgaactcaccagaatcccttcaagccctgcagagaaacaatatggtagagaggaaatctcacaggcttagctggcagcaggttcccaactcctggtcagctactgctagttgtatgaccctaggcaaggcatgcaaccttttcaaacttccatttcatcctagcaaaattggtaaaataatactgaatttagtatggaagattagagatgatctgtgtaaaggaagtgacctgtcccccgggaagttctggta

SEQ ID NO: 212043 - DNA, 477 bp, Homo sapiens
tggactgtcatgtttcaagggatcctcaggtacagcaggtggactgagagggaacagaggagaacgaggaatgttggagagacgagggccctgaatacggtgttcagcatctagatcacaattaataactttgtgtctccgttttctaccctcatttgtgctccacggctgcaaaacgatgaaatattgattccttcctctagtgaatcaatgtggatgttgtatggcaaagatgaaggcagagagctcatgctttctttgtgccccaccctgaacactatactacgagccagtgtgttgcagtggttaagcgctcaggctccggaatcagtttcttcatctgtaaaatgcggataatgataatgcatggttcataggcatgatgtgaggagtaaatgggatattgagtataaggtgcttagcaccatgcctggtccaccatgaacactgaataaatgttggcattgagtgtgacta

SEQ ID NO: 212044 - DNA, 583 bp, Homo sapiens
caccactctttgccacaccggcctttcagctctgcctagccaacgtctttcctgatccctttacgtgagtagcaggaagagatctatactcctcttccaggtctcagcatataaatatcccctactccctgattgttagattcaatcaaagtttactttctgcccctaaaattctctcatagcactgttttcacttttgtcatttatcacaaattgacattacatatttacttaatgtctgtctgccctactagactacaagtgccacaaggacaagaactatgtcactttgattctgcactacaaacccactatgtagaacaatgtctgttatacgacagatgctctatatgtatgttgaatgaatcttgctccagtacaaacttctataaccgcacttaccacactgttctgtaattgtttacgtggcttccctaccaaataagaagttctcttgaaggctttgtagctctaggatacaccataggagttcagtaaatgtttaatgaattgaattattctactaaactgtaagcctctcaagagcaggcagcatgttttgctcatacttttgtcgtctacc

SEQ ID NO: 212045 - DNA, 128 bp, Homo sapiens
tcccctccccacccccgcccccgggaccgtgcaggcaccagggttccgtgcacctatttatatttttgaaaactgaagattataatattataataataataaagacattggaagagatctatctcttt

SEQ ID NO: 212046 - DNA, 229 bp, Homo sapiens
cgaaaaattaataggtgttggtatagaatggggttcctcctccccgggatacttttgtgcattttcctggaaacaagtccacagcttttgacacattctgaaaggagcccagatcacaagtcatttaagaagcacagattttcaccccctcagtttgcagaaaagtgaactgaaagtcagagaaaaaggcttcactgaactccccactggggaactgggtttcccgcta

SEQ ID NO: 212047 - DNA, 832 bp, Homo sapiens
  misc_feature (25)..(25): n is a, c, g, or t
  misc_feature (71)..(71): n is a, c, g, or t
  misc_feature (78)..(78): n is a, c, g, or t
  misc_feature (81)..(81): n is a, c, g, or t
  misc_feature (85)..(86): n is a, c, g, or t
  misc_feature (89)..(89): n is a, c, g, or t
  misc_feature (99)..(99): n is a, c, g, or t
  misc_feature (130)..(130): n is a, c, g, or t
  misc_feature (132)..(133): n is a, c, g, or t
  misc_feature (137)..(137): n is a, c, g, or t
  misc_feature (146)..(146): n is a, c, g, or t
  misc_feature (150)..(150): n is a, c, g, or t
  misc_feature (152)..(152): n is a, c, g, or t
  misc_feature (157)..(159): n is a, c, g, or t
  misc_feature (165)..(165): n is a, c, g, or t
  misc_feature (167)..(168): n is a, c, g, or t
  misc_feature (183)..(183): n is a, c, g, or t
  misc_feature (208)..(208): n is a, c, g, or t
  misc_feature (251)..(251): n is a, c, g, or t
  misc_feature (362)..(362): n is a, c, g, or t
  misc_feature (369)..(369): n is a, c, g, or t
  misc_feature (387)..(387): n is a, c, g, or t
  misc_feature (389)..(390): n is a, c, g, or t
  misc_feature (392)..(392): n is a, c, g, or t
  misc_feature (396)..(396): n is a, c, g, or t
  misc_feature (403)..(403): n is a, c, g, or t
  misc_feature (414)..(414): n is a, c, g, or t
  misc_feature (416)..(416): n is a, c, g, or t
  misc_feature (421)..(421): n is a, c, g, or t
  misc_feature (423)..(423): n is a, c, g, or t
  misc_feature (440)..(440): n is a, c, g, or t
  misc_feature (815)..(815): n is a, c, g, or t
cccccttccccccaccccccccccntttatccccaactttttccatatatcagaaaaattctctatttttntaaatanatnttannttntccatttttnttttttaaaatatcaacctacatgcactttntnntttnaaataacanttantnttttnnnctctantnnccactattttttttnttttttatatactttaaatactggntttttttcctccttcaatctcaggcttttctccatcttttaancagcctctttaactcccttttgtccataggtgttgcgtgcctctcatctgtggggaagtattatttaataaaatttattttacaggataactttattttaatgggcatggncttgtcnatacacaaaggaatgtananntncatnaaaaaanaccactttaananttttncntattttaattttttganatttttctagagccaaagaagctctttaaagaagttgtttcttccaaaaaacaaagccaggttaatgacattcaattctaaatgatacattggaattgtgccttttctaccacactggattaaataaacttgtcaaaatatggttttgtcattttctgagacacttggtaatttgctgttctttctttcatgtgcccgttagtacatttggccaactgaccacctgtaacagggaggtctcatgtttgttagtagatacgcaggtaaggaaacttgaattcatcctctcctcggctcaggtctttgcttttcttttaatatatgcatataaaatagtaggcatttgattctgcaaggcactagactacttgaatnaacattctgtcagaggg

SEQ ID NO: 212048 - DNA, 682 bp, Homo sapiens
ggtccatgactgcctctctgtaagctccagcaaaagatggtgaggttcaagcaattgcctttcttattctaatgagccttgcttctaacagaacatgagaagggttagtgtgagtactccagaaggaaagaaattaaaggagagaaacaataaattaatgtaatagagtgggcagaaaaaaatgcttagatatgagatattcctggtttaactacatgactttcacatgtgatatggtctgtcacaacttgagcctccttatctgtagaatgaagatatcagttcacactctgctgtgagactagaatttgtatgtgatgcacctggcatagtgcctcagacacaggccctaaaattggtacctagtccaatagtggttgtcattataccaaagagtaccaatgactttaaaagctgaggtttctagccttatcaggacccacatctagagagggtagaattgtattttccatacctattagaagtggagtcctccaatgtttacctcttgggcattttatagaattgaatggtttgagggggcactgagacccaccccctcttcaggttactcatacactgtcttgaaaataaagaaatccatctaaaaaaggatagatgagtcctgcttacaatggccactcttagaaaatattaagccacttccctggataataaagga

SEQ ID NO: 212049 - DNA, 105 bp, Homo sapiens
tatgttgtactttacttgtctatatccccattaagagatatgttgcttccaggtttcattattataaatactgtttcagtgaacagctttcaatatacatctttg

SEQ ID NO: 212050 - DNA, 462 bp, Homo sapiens
acaaagtagaaaatgcaatgaagaacagttgctaagaatttagtggaagcagaaactcagctttgaaaagtaaccacccctgcccgtcctcccacctccgattccaagcacccagagatattcgtccagagatattcagggatgccaagttacctaacatatatggcgtgtaggtttgagacaatttacttaaatcttggaagacaaggttctatgggttgaatacatcccctccaaaattcaggtgttgccaatgtgatagagaggtgtgtcatttaagaagtgatgaggccatgggaacgcctccctcaatgggattaaggcttcatgcagcttgcccttccatcttcagccatgtgggaacttggcaagaagtccttcaccagaccaaatgccatgcctatcttggacttcccagctttcaaattgtgagaaataaatttcttttctttatgaatgact

SEQ ID NO: 212051 - DNA, 478 bp, Homo sapiens
gaagttcaagaccagcctgggcaacataaggcgactccatctctacaaaaatcttttttaacaaaaatcaccagggcgtgtggcatgccacctgtgctcccagctacttgggaggctaaggtggaaggattgcttgagcccagtagttcaaagctgcggtgggctacgatcacgccactgcactcctgtctgagcagcagagtgagaccccgcctcataaataaacaaacaaaaaatcgtatcaatgaacttctatattctgtcacattaaaacccaacaatctatcatacactttgattatcaagcattggtcatttggaaaatactggttaactgagttatgcacagattctgtatgttgacacattttaccaaactctatcaaaaaataacaattattaatgccaccaataatctcagcagaaagatctttaagtactgagaagttatcagctcacagtggccaagtttcccaaa

SEQ ID NO: 212052 - DNA, 904 bp, Homo sapiens
acagaaatttagatttttgtgtctttcttgcccttttctgtattgtctttagtttttagaaggactttcttggctgccttctccctcccccaccttgctccatcctctcttgcaaagtaaaatctcatcttcctgcaggaggttaggttgtaaagtttacacataaagtgaggattccaaataatcaaaattatcatggaaaatatctcaaatgacccagaaattaaagtatataaacatggttttgtgtatatgccagaacaaagttggaataccatatgaaatagttggcctgtaattaggagacattttatatgaaaaaataagtattctcaaaaactagaatcatgtacagcattcagaatgctcacaatgtgaagaggcacaccggacttagacatgctaaagtctcagattcaagtcctctcatctcatgctcatgttcatcctggtaaataacttcactttggtgtaaaacctcattgagtggaattgtgagcaaacttttgtactgtttatttttctcttcctggtcaagtttgcatagttaaatgcaagtatgttgtgattgtattttatccttcttttctgctttctgtttttctaatttctgtgcccatttaaaaatcctcactgccgggggcagtggctcacacctataatcccagcactttgggaggctgaggcaggcgaatcacttgaggccaggagtttgaaaccagcctggccaacgtggtgaaagcctctctctactaaaaatacaaaaattagccgggtgtggccaggtgcagtggctcacgcctgtaatcccagcactttgggaggccaaggagggtggatcacaaggtcaggagatcaagaccatcctggctaacatggtgaaaccctgtctctactaaaaatc

SEQ ID NO: 212053 - DNA, 809 bp, Homo sapiens
gtttttccctccccttcctttcttttttattgtctataggcactgaagcattcctttcaattgctactacccttctctctgaattctgagtttttcttaggccatttacatagtactcttaatcacagaatttgatggcttatgattctgagttgggagtcgggttcaaggaaatgaggggaaatgtcacattatactagccttggctggaaatgtcccaggaactttaggcttgctactggtcaggctgcttagaaaatgttatcagccttgaagaccaaaccactagacatttgattggttcttatgcaataagtctgtaacacggcaaacatacttttagcaaactattgtatatggatatgtgatcagacaagactttagttatttttagatggttgtctctatagtatcaactataaagatttccttcttaaaaattccagttaagccattccagaggccattctcaatgtttctcgttcacttttctatccacagttccaaactgacagtcgtgctagatgatatttttatgtggtagattctgaatgtgaaataatttcgtgctgaatgtacttataagaacattacctacattcattcatctattttctcatactatttagcatattttccatcaatcaaggtagagttacacatataaaacatgaacatttgtttcttagcacatattattcagataatcttgacgttttataaatcatctttaagtatatacataaaacggaaatgtttccccaaacagcgtcacttaaagaaatgaaaacaaggcaacagagagcaaa

SEQ ID NO: 212054 - DNA, 520 bp, Homo sapiens
  misc_feature (40)..(40): n is a, c, g, or t
tcatagctgttcaaaggatcccatgtctctcctaacctgnaacaactgtaagctctgtacacaggaaccatgttggttttccacactactgtattttcaagtcctagtgcagtgatacttagcattcaataaagactttgagtaagtgagtgaatgaatgaatgaatggtgactgcttttagtatttttagaagtgcaggatgctatcaattaagcagcctttgtctagtgtgaggatgaggaaatgtttcttagaggacttgaaaatgagtaagaagggggtatggtattcagtatccaattttccttagagggcaagtaggatgaatatagaaaattttcctttgaatttagaaatgtgggagtcattcatgaccgtaacggggtcaattttaatagagtgaaggaatgcaattcagattccatttgcttgtgaaatgaattagcgagaaaacagagcaaggagcttttcccagaaaagtagatctcagacacttattgctggcttatttgtttgttc

SEQ ID NO: 212055 - DNA, 453 bp, Homo sapiens
ttaggtcgtttctcttgcctgtgttaaattgttactcccgaaaaatgatacttagcattcaataaagactttgagtaagtgagtgaatgaatgaatgaatggtgactgcttttagtatttttagaagtgcaggatgctatcaattaagcagcctttgtctagtgtgaggatgaggaaatgtttcttagaggacttgaaaatgagtaagaagggggtatggtattcagtatccaattttccttagagggcaagtaggatgaatatagaaaattttcctttgaatttagaaatgtgggagtcattcatgaccgtaacggggtcaattttaatagagtgaaggaatgcaattcagattccatttgcttgtgaaatgaattagcgagaaaacagagcaaggagcttttcccagaaaagtagatctcagacacttattgctggcttatttgtttgttc

SEQ ID NO: 212056 - DNA, 463 bp, Homo sapiens
cctctagaattgatgtctgaattctataagcattttggagcactttggtggaaactcttcaagtcatgtttagctgtgaatcgaacagattcagtatcatagatttggattaggattaacctgtcaacaatttatcatgcacaatatcctgtgatatggaattatagaattttaagatctattttatgtataatcttgccatgtttgaagtttaaccaccaaaatttattatttagatgtatttcataatcaaatggttttggaaccataaaagaagttttaaaagttgcttaatggcatttttcttctattgcctaaaactggtttccttttttagagatggaacaatattttaaaaaacttttctcttacttctactgtacttaactatttggctcccattgtgcctttgtatgttacacataatttcttattaaaactaaagcttccttataatttaata

SEQ ID NO: 212057 - DNA, 800 bp, Homo sapiens
ttctccaatcagaagtctagaaggcagggcacgcagtaggtctgcaggatgactcagaacccgcgtatgaatgctgtctattcatgggtccaggcttttgttaaagtctgggcctgcattttaaagagggagtcagggaactggctggactggtctgacaactaaggagtggtgaacacttcccccaggctagtactcaggtggatgaagtcatcaatattttctgggcagtcctaatctgtgattaacttttatctctgctgtgaaataacagcctccttttcagcctgctaacaataagttaacctggctgcccggctgggggatattttatgctgggctccagcagaggcacacttgagaagccatgtgggactcctgccctggagagagcccagagtggagggaggggtctgtatggtggtgggagtcctctcagcaatggtccttgtgattccggtgtactctgatgtcctgacttcaaactcagcttacccaaagcaaatgtccactttcttccgtactcctttcttgtttaaagcctcaccactgaccaggaagtcttgatagagccatctagtaattcttaagtcctacctcatccaaccttgttttgactcctgcagtgagcacagctgccctcaccctcccctctctatgccctcacctttgcaggagactctcaatttctcagtccacatcagctctcagaccaccaaagcaagggttatttttctaaaagacatttgttcccattgctcctctgactaaagttcctactatgggacatttgcccttgg

SEQ ID NO: 212058 - DNA, 733 bp, Homo sapiens
ttctccaatcagaagtctagaaggcagggcacgcagtaggtctgcaggatgactcagaacccgcgtatgaatgctgtctattcatgggtccaggcttttgttaaagtctgggcctgcattttaaagagggagtcagggaactggctggactggtctgacaactaaggagtggtgaacacttcccccaggctagtactcaggtggatgaagtcatcaatattttctgggcagtcctaatctgtgattaacttttatctctgctgtgaaataacagcctccttttcagcctgctaacaataagttaacctggctgcccggctgggggatattttatgctgggctccagcagaggcacacttgagaagccatgtgggactcctgccctggagagagcccagagtggagggaggggtctgtatggtggtgggagtcctctcagcaatggtccttgtgattccggtgtactctgatgtcctgacttcaaactcagcttacccaaagcaaatgtccactttcttccgtactcctttcttgtttaaagcctcaccactgaccaggaagtcttgatagagccatctagtaattcttaagtcctacctcatccaaccttgttttgactcctgcagtgagcacagctgccctcaccctcccctctctatgccctcacctttgcaggagacttcctgggttaacttcctctctttccatccaacgtggtggcggtgcttggtga

SEQ ID NO: 212059 - DNA, 275 bp, Homo sapiens
ttaaggtgaagatttttaaaaattggcattacataatttacatgagagcaatgctatcacctcctctgtgtggatgtgggagaggactgggccattctccttagagagaagtggggcggcttttaggagggcaaggaacttcctgtaacaatgcatctcatgatatttggaatgactattttttaaaaaaagaacaacgtacaatcaatgtcctcggccacattgtagaactctgggggatgctcgctccaacagactgctgtcaccttcaccat

SEQ ID NO: 212060 - DNA, 1564 bp, Homo sapiens
  misc_feature (151)..(151): n is a, c, g, or t
  misc_feature (970)..(970): n is a, c, g, or t
  misc_feature (1083)..(1083): n is a, c, g, or t
  misc_feature (1173)..(1173): n is a, c, g, or t
  misc_feature (1175)..(1175): n is a, c, g, or t
ggacgcggccacctcgaagccacgtcagggcagccccaggtcgggcgcgtgccagcagccagaggtataactataagaaatgaattttaatgtctggaatatcaaagagatgctcagtattccttcaggctctgggaacaagaagtcatcnaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacagttgcagacgtctgtggaaaagtctgaggaccatctcagttcaagaagccaatctattttggattctttggagactgtggccaagacatgtgagtgcctcatgtttgaggtatcagcagagggcactggtgaatgatgaacatgaactttctgaccccagcctggtttccagtggtgaggttcctcacagggtttcagatgagaggatgggtatatagggttagtcctgaagagatgtggagcacactgagctgggtagtgaggcccacctctatgtgacaatgctctggtcccatgatgccttttgtgaggcactaatcccccacctggtaaccatgttgcctcagggcaggtagctctgctaggtttctcatctcactgcctgaagtgagtcagcaacatccttgagtctcaaattgctgcctgtgctgtctatagacactgactgccccttaggagttagaaatactgtagtacctgctgctcttcttgctgcnttggtttcagtgagagctgtgttgtgaatcacagcatcattctcaattttttttttttttttgagacagagtctcgctctgtcacccaggctggagtgcagtggcgcaatctnggctcactgcaagctccgcctcccgggttcacgccattctcctgcctcagcctcctaagtagctgggactacaggcgtctgccaccacgncnggctaatttttaaaatttttagtagagacggggtttcactgtgttagccaggatggtctccatctcctgacctcgtgatctgcccgcctcagcctcccaaagtgctgggattacaggcatgagccaccacgcccagccccattctcaattttacttatagtttgtggtttataaaatcctgtgctccaccaattagtggtttacatttagatgaaaccatggcccttgccctataaacagaagagagtaaatatacagttctccttgggtgaatacttctctagaaccacctgtttcctagcaaaacgatgagctgatgactatgcatctgtacttgtttgcatttgtctgtgtgtttattttataaacaagttgaaatcaacttacac

SEQ ID NO: 212061 - DNA, 815 bp, Homo sapiens
  misc_feature (463)..(463): n is a, c, g, or t
agcgggcttttccttcatctccaaagtcctctaaactgacagggtctcattctgtcgcccaggctggagtgtagtgacgcgatctcggctcactgcaacctctacctcccaggttcaaacgatcctcccgcctcagcctccgagtagctgggaccacaggggcccggttcgatgtccccatctgcccacggcgcctctcgtgccagctgctccgcctgtcctgcccttgctcagaccacccaagtatcatctgtgctctggcccctggccaccagttccaccccacatgctgtcctcacaggtggcgccttgccattcctggggaccaggcctccttgttctggtcatacacagtggagtgtaggtcgagcgacaagtataactataagaaatgaattttaatgtctggaatatcaaagagatgctcagtattccttcaggctctgggaacaagaagtcatcnaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacaggtatgtaaacctttcaaatggatgaaaga

SEQ ID NO: 212062 - DNA, 1915 bp, Homo sapiens
  misc_feature (151)..(151): n is a, c, g, or t
  misc_feature (970)..(970): n is a, c, g, or t
  misc_feature (1083)..(1083): n is a, c, g, or t
  misc_feature (1173)..(1173): n is a, c, g, or t
  misc_feature (1175)..(1175): n is a, c, g, or t
ggacgcggccacctcgaagccacgtcagggcagccccaggtcgggcgcgtgccagcagccagaggtataactataagaaatgaattttaatgtctggaatatcaaagagatgctcagtattccttcaggctctgggaacaagaagtcatcnaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacagttgcagacgtctgtggaaaagtctgaggaccatctcagttcaagaagccaatctattttggattctttggagactgtggccaagacatgtgagtgcctcatgtttgaggtatcagcagagggcactggtgaatgatgaacatgaactttctgaccccagcctggtttccagtggtgaggttcctcacagggtttcagatgagaggatgggtatatagggttagtcctgaagagatgtggagcacactgagctgggtagtgaggcccacctctatgtgacaatgctctggtcccatgatgccttttgtgaggcactaatcccccacctggtaaccatgttgcctcagggcaggtagctctgctaggtttctcatctcactgcctgaagtgagtcagcaacatccttgagtctcaaattgctgcctgtgctgtctatagacactgactgccccttaggagttagaaatactgtagtacctgctgctcttcttgctgcnttggtttcagtgagagctgtgttgtgaatcacagcatcattctcaattttttttttttttttgagacagagtctcgctctgtcacccaggctggagtgcagtggcgcaatctnggctcactgcaagctccgcctcccgggttcacgccattctcctgcctcagcctcctaagtagctgggactacaggcgtctgccaccacgncnggctaatttttaaaatttttagtagagacggggtttcactgtgttagccaggatggtctccatctcctgacctcgtgatctgcccgcctcagcctcccaaagtgctgggattacaggcatgagccaccacgcccagccccattctcaattttacttatagtttgtggtttataaaatcctgtgctccaccaattagtggtttacatttagatgaaaccatggcccttgccctataaacagaagagagtaaatatacagttctccttgggtgaatacttctctagaaccacctgtttcctagcaaaacgatgagctgatgactatgcatctgtacttgtttgcatttgtctgtgtgtttattttataaacaagttgaaatcaacttacacaaatgccatggggtggactgctcataatttacaaaaattaatgcctttttgtggcctaaaaattaatccccaactgtctgcatagaagcactgtactgtctgctggatttcaacctgggcatcccacacacagggcatatgcatctgtttagaaacttgttctggggccgggcacagtggctcccacttgtaatcctagcactttgggaggccgaggcgggcagatcacaaggtcaggagttcaagtctggcctgtctaatatggtgaaaccccatctctactaaaaatacaaaaattagctgggtgtggtggtgggcgcctgtagtcccagctactcgggaggctgaggc

SEQ ID NO: 212063 - DNA, 389 bp, Homo sapiens
attatgatatagctaggcggcattttaagaaatgagtagtctggggtggtggctgaagcctgtaatcccagcactttgggatgctgaggtgagcagattgcatgagcccaggagtttcagaccagcctaggcaacatggaggaaccccatctctacaaaaaattttaaaattagctgggtgtggttagtccaaactgagacttgccatgagtgtaaaatacatactggctttcaagggtttcacaccaaaaaaaggaatgtaaaatatcttaaaacttttaaattgatgatatgttgaaagaataatatttaagatataccaaattaaataaactataatattaaaattaatctcagtcaagtgcagtgattcatgctcataatcccag

SEQ ID NO: 212064 - DNA, 578 bp, Homo sapiens
ggtccattcgtattactgattatcctatttgtaataagatagaaaatgtctaaaatgcagtgccaaatgatacagtggcaaaaatttatacagaaaaatcatttgaaatgcaaagaaaactgggcataaggaaaaaagcatacacatgtaactatcacaagtaataagctcttcagagtcagaaaaagctagtcaacaagacacaacagttttaaagaaattcaatatactcaaactcaaccttctgtgtgtcatggagacaaacacatatacacacacatttgtacaatgtataaactgaatttatgaaaacttagaaaaaatggctaaatccaaacactgaatagaaaaatcccctcactactctaaataaggaaaatattaaaaagccgttcaggtatggtggctcacacctgtaatcccagcactttgggaggctgagatgggcaaatcacctgaggtcaggagttcaagaccagcctggctaacatggtgaaaccccgttttctactgaaaatacaaaaaattagctaggcgtggtggcacacgcctgtaattccagctactcaggaggctga

SEQ ID NO: 212065 - DNA, 234 bp, Homo sapiens
acaatgcacaggggagcttctcatcacaaagaacaatcctgcacaatatgtccatagtgctgagaatgagaaactggccagaaatgaaggtgccctttatgtcaaagctgtcaatgtgaagtgctttcaagtataacctaagatcccagaatgtgaaattcaaattctttctccatcttgttcagattgcttgaaagtaggacagaagactggagaggcaaaatgcaggaggag

SEQ ID NO: 212066 - DNA, 773 bp, Homo sapiens
attcagaactgcagatagtacagcttccacaggagcaagggatgtctgagcacaagtggctgagttccgagtgactttatgaagcactttctaccttcctctccggcatgaaaacagggattctgcacctgcatcatggacagtctggcaaaagcctctgctctgcctccggggacaagaaactagagcaaataaccgttttgaaattagatcctggcaaaattaccaacaatcaatgatggaaactgaagggagattgatttaaatcttcaatgacagttgtacagaagttgaagaaacacgtcatctttccaaagaagagtgagtagcttggttggtggtaccctaaaattagggcatgattaaggtacgtcatttcttttagttcaatcaaagtgctttgctgtttccatttcagagaatttcttattctttttttcaatttctctctcttcctcttcttcctctcattagtagatgtcttttataattgatgtcatttactgtcctttcatcaaatgtatgccacatcacttaggcgaaccagcagacagggcaccaaaatacacattagaggagactggcttccatgagacgcttcgactgtctcatcggggcacttgtaataagcatcttggtgccactgaatgcaatgctgtattcaaataatagctttcatcttcactctttttaaatataaaagtaaaccttgaagccctttgaaggacctaaccaaacaacatacctatgaaaatagatcagtaaggctttga

SEQ ID NO: 212067 - DNA, 294 bp, Homo sapiens
aaactcaatagaaaccaggaagcaaagggacctggagagaccatgcctaatggctcagttccgtgtcttttactccagtttccccagccttccctaatttgtacagtgttcaagagagccctaaggaactgaaagatctggaaccctttcttttgtattggctgaaactcagttcagaaagcagttaatgggtactattaaaataccaaataggttgggcatggtaactcatgcctgtaatcccaacactttgggaggccaaggtgggtggatcacttgagcccaggagtttaa

SEQ ID NO: 212068 - DNA, 437 bp, Homo sapiens
tatcttattggtcttctgtggaaattccatcagcatcatcttcaaggtcagttcatgtcaacatttattgaggatatattatgaactagggtctgaactgtgtaggagctggtatatcaaagaaaaatacagattctgtcctcttatctagtagtgaaaaaattcatccatccatcatctattcatccattcatccacccatcatccatccatccgttcacccatccacccatccatttatcatccatcctttcattaaacatacagatacatctaatatgatggtaggaatatgacagagttatagagttgtttggtaccaaggagtagcggcttttagcctcatctgggagggattttgaaagcttcctggagaaaatcatcatctgtttagttttgatgcatgaatagaagtcatgtgagaagtagaggcaagg

SEQ ID NO: 212069 - DNA, 556 bp, Homo sapiens
aagcatgggaagtgcttggcactcactcacattggttaaagattattaccactatcacaggtagctgctcaaggccattccacagctctcacatcccactgcaggaagagaaggcgctagcgataaacacttggtatatttcctcatccatcccaccacctctgatgtgggaaactacagcagccagggcggctgctccactctagagtggctgtgctcagaccttcagtggttttcaagagccaaggaggagagaggcaaagggggccgaacagctcagcaacctcctgagggagcttcagcctttccaccgctgaaaaacaacttcacagcccagccctgacccctttctcctagcaccatgtctcccagatctccacacactggcgccacttgtaccatatcccagagcacctgagctacggcttacttcacactttaactatactcacttttatttttggcttaagtaccaactttagcctcacccaatgcagaaatagccatgggatactaggtttgacatgctgtttaaattcttttcccggccaggcat

SEQ ID NO: 212070 - DNA, 230 bp, Homo sapiens
agggctggggatggggagcatttgaaggggattgaggaggaactgctaatgactttgaggttcctttttgagatgacaaattgtgataatgggagcacactgtattaaaaaccatcgaactgtatactttaagtagatgaattgtctggtatgtgaattgtatctcaaagctgtatataaaaaataattaatgaggccagatgtggctgctcatgcctgtaatcccagca

SEQ ID NO: 212071 - DNA, 162 bp, Homo sapiens
gggagactggagcctgctgtgctgcttatcacttcctccagtccctcatatccctcagtgacctctaaagcccctttcccaaaccccggggctggctctgagaagaaatgctgaaaaccacccttctcaggtctttgtcggctctgatgggacgaagatgcg

SEQ ID NO: 212072 - DNA, 536 bp, Homo sapiens
ctctgtttattcaaggacttcaggtttactctgagtttgtgtttctagtttcatgttcagaagtatacagcatcagtgtcctagctattacgtcactgttggcacagataataagactcattgtaactgtcttaattctctttattaattttccaaaactaccttgaattgtatggtgtatttttacataattatggtacaagtgaaaggcttggggggaaagtacaactactacagtatcaaagcagaataaatatttgcagaaaaattctgccataacttaatattttgcatatgagcctctgtacaaaatctgagttattcccggggattggtccaaaagaacatgtctgtggcccagccctagaaggccagagatgatgatggatcagaaaaaggtcagcttgagtcttgatgccaagaataatgacagaagggactaaaaaggcagaataacagtgcaaccagagttccaagagcgaatgtgcatttgccgcatggctgtgagatcgtgccccatgtggctttctgcccac

SEQ ID NO: 212073 - DNA, 400 bp, Homo sapiens
gcccttggggtaatgtactttgtgatattgccacccgcccccgccggacccgcccttgtgaatctactttgtatgatacaccctccccacccttgagaagatactttgtaatattctctccccccaacttaagaagatacttagtaatattcttccccacccccatccttaagaagatactttgtaatattgtccccccctaccttaagaagatattttgtaatattcttccgcccttgagaatgtactttgtaaaatccgtccccagcccacaaaaaattgctcctggccgggcgcggtggctcacgcctgtaatcccagcactttgggaggccgaggcgggcagatcatgaagtcaggagatcaagaccatcctggctaacattgtgaaaccctgcct

SEQ ID NO: 212074 - DNA, 280 bp, Homo sapiens
ctgccgtcttaaacatttaaatcttaaaggatcctttaaaattgtggaaggatttatatactttaaacttacctacagttttgatttccacagtgcacacatattcatttgtataagtggagaaggttttttcaatcttttttatagtggtaaaatatacataacaaaaatttaccattttaaccattttaagtgcatatttcagtcacattaaatacattatgctattgtgcaacaacgaattaagggtaccggagctcgaaattcggtaaatcatggg

SEQ ID NO: 212075 - DNA, 545 bp, Homo sapiens
tatggcatctgtagtagccaagggttgacattagagaggatgaaataagcaagtggtaatggctctcaggaattatggtaacaaggagaagaggatggttcttcactgctaagcagcttgactaggtgagagacagccagcatcttactgcttcctggcacatggagtgttccactgagaatcacaggcagactcaggcaaccagccacttttcaaatgggctgtcttctgtagtgctgttccaccaccattctgtgggcccaactgttgccattctgggggatctgccattgctagcttaattccattcacttcaattcaattgctgttatgaaaggcctactagtgctattcccctgagaatctatagagacagggtagaactcttggatgaaaaggtgagggcttaggacatctggttagtggaacttacttatttttgggcctctttcatcaagtaacaccagctgatgcctaggagtgtgggagtcatatcggctttgttgtcgtctgttagaaactcttcgtgttcacaaaaaaaaaaa

SEQ ID NO: 212076 - DNA, 761 bp, Homo sapiens
  misc_feature (31)..(31): n is a, c, g, or t
  misc_feature (70)..(70): n is a, c, g, or t
  misc_feature (75)..(75): n is a, c, g, or t
  misc_feature (78)..(78): n is a, c, g, or t
  misc_feature (85)..(86): n is a, c, g, or t
  misc_feature (89)..(89): n is a, c, g, or t
  misc_feature (93)..(93): n is a, c, g, or t
  misc_feature (105)..(105): n is a, c, g, or t
  misc_feature (109)..(109): n is a, c, g, or t
  misc_feature (131)..(131): n is a, c, g, or t
  misc_feature (143)..(143): n is a, c, g, or t
  misc_feature (169)..(169): n is a, c, g, or t
  misc_feature (181)..(181): n is a, c, g, or t
  misc_feature (224)..(224): n is a, c, g, or t
  misc_feature (229)..(229): n is a, c, g, or t
  misc_feature (231)..(231): n is a, c, g, or t
  misc_feature (239)..(239): n is a, c, g, or t
  misc_feature (251)..(251): n is a, c, g, or t
  misc_feature (278)..(278): n is a, c, g, or t
  misc_feature (305)..(309): n is a, c, g, or t
  misc_feature (320)..(320): n is a, c, g, or t
  misc_feature (325)..(326): n is a, c, g, or t
  misc_feature (333)..(333): n is a, c, g, or t
  misc_feature (349)..(349): n is a, c, g, or t
  misc_feature (383)..(384): n is a, c, g, or t
  misc_feature (389)..(389): n is a, c, g, or t
  misc_feature (398)..(401): n is a, c, g, or t
  misc_feature (413)..(413): n is a, c, g, or t
  misc_feature (434)..(434): n is a, c, g, or t
ttgtgggctgtgggtttgtttttgtcatatnatttgacatccttctcagacagcttgcagcccgagtgcntggangtngatgtgnnttnaggnttcccttcgctngttnccgatgagaatttgggtcactnctactgtttcanggcaaaaagacttcaatagaggtggncattcctcatcncgcagtcactcacaggcacttcatcttcttaagacacacttcnctttncnccagtganaatttcctttcnagttctcctacttgtcaactgcccccnccccattcttcgtctcccagcttatcnnnnnttgggcgaacngatcnnttcacanggttgaggaatctttncattcttcaccttgcctcagccgcgcattaaganncctangtagccccnnnnccgcggcccaangggccctccaagttaacagangacaagtgaattcatcctatgcctttgcaaacatcctctggatcctcatgtcagctaatataacaacccaaataactcaatcctcaatctaaatatcctgaactattctctctcaacccctatattataaaacctacaaactcaatctctattgaatatatatttacttccccctttgtcttcttactgtcttcttcagatagttattcttgccttggccattataacagccttccatttggtctcctacctctaataattctgcacatccaatccatgatatgaactataccagatatctttaacaggcctgatcatattatgagc

SEQ ID NO: 212077 - DNA, 373 bp, Homo sapiens
ctcctgacctgaagtgatccacctgcctcagcctcccaaagtgctggtattacaggcatgagccactgcacctggccagaaatgttttatttatatttgtcagcaaccagcaaaggtgtaatattttaaaagataacatttataatagcatcaggaatataaagcatccaagaattaatctaacaaaagatgtacaagacctttagatggagaaaattataaaaagaaagatggtgcatagatccaaccctgaagttcatgtttgcggttgcttaaggcaaagaacctctgacttcagtaaggtgacgtctgagtcttaggaaaacctcagtcagcctgtcctgccataatgtgccccacttggggagagtag

SEQ ID NO: 212078 - DNA, 441 bp, Homo sapiens
gggcaacagatccagaccttgtctctaaattaaaacaaaacaaaaccaaacaaaaaaacagctgcataaggaaggttataacagaacactgttctctctttacacacacacacacacacacacacacacacacacatcacacgtacaggaattattttaacctatcagttacatggtggtttcacaggtttcaacttcatcaacccagaaccacaatcacagattttggctagactctgactctcatctactagtgataacaacaagttccctgtggaagtttatagccccacagattatcagggaccatttttgctttctgtaccatgtggttctttcctgctacagattcaaaatgcttttttgtccattcctaatacttttcatttatactgatttctttgatgagaataaccttaaattcatatgtcttactttcat

SEQ ID NO: 212079 - DNA, 181 bp, Homo sapiens
ggtttgtccgtgtagacccaacacagtgttcttagtcttgccgtatgcttccaggtaagcaagttgtatgtgacggtcaagttcccagttcccagagggaatggcaatggataataaggttgacctgagccatagtggacttgctctcctcaagatgctgtgtcgtaaaaatgagctatat

SEQ ID NO: 212080 - DNA, 406 bp, Homo sapiens
aacaatgcctgaatcttcagggtccatttctgccgcattcactagcaaccacaaatgtgacttaattttactttggaaataatgcttacccattgtgagatgctgtaatatgaaccatcattacatgttaacatggcacatggaattttgagtgtctaagttacatttttagagttgtttcttagtagccatgtgagtttccactccaaaaacacaagctaaaaacttgttttgagtgaaggacatctagggcaaatggtggctgaaagtgaatgagatcccaattactctttcttgtactgtataaggaaaagaaaataagtgcttttcttgttgggtgtttgctaatttataattaccgttttatgcttttcaacatttttaataaagttttttattgttggct

SEQ ID NO: 212081 - DNA, 452 bp, Homo sapiens
acagtggtagcttaaaaggactgttgagagcctttcacaagattaactctaaacctattaaatttttacaaaacaagcagatcctattgtttcttgcctggagaaaatcagaatcttctaggtgttaagtatttagggaagtctgaaggattcttctatgtactgagaatctgaatttgaaactagttagaacaggaacaatgctgtggacacaaagacatcaaagaatccaccataagaatgcattttctttctttctttctttctttttttttgagacaagctcttactctgtcccctaggctggagggcagtggcttgatttcagctcactgcacttctgctgcgactacagacacgtgccaccacacccagctaatttttttttttttcagatggagtctcgctctgttgcccaggctggagttcagtggcacaatctcggctcactg

SEQ ID NO: 212082 - DNA, 613 bp, Homo sapiens
tgtgtgtgtgcacacacatacgtatacccacatacatatgcacacacacaggcattcacacacgagtacacatgtacacatgcacatattcatgcagcacatgcacacatgtacatgtacacagacacaagtgtgcacacatagacaactgcaacaatgtcaggagtcaccagtttcttgcaatggagctaagacattactctttattagttgtatccttgttttctcacttgagtctttgggaaatgacaccttcctgcagccctgatttactgtgggagatgctttgttgagaaatgaataactaagcattttgtacagaggtatgaggagagatgctggctcatctcccagggctcacagttccagctgtcagcccaagaatgagtaggacaggtgaggcctcagcacagtgacaaaggagcagggcagaagtcacctagatctggaacatcatatcccttgcccttctgttctccggattataccttcctgttccaggaagatgtcagtcatcaaacagaaatcaactagtcacaccctctagtggtacgagggacacgccaatgaatcaggcagagactgcgccttcttatgaccttcattctagtac

SEQ ID NO: 212083 - DNA, 179 bp, Homo sapiens
ttgtgaataaaatctgatagcacatgccttattccttgatattttatcagacagagtgaattgtgtgggtataagccatgaagtggaagcatggcatgcatgtttgagaagcagcaagcagaccagcaaggcgggaacaaagttaggagaggagagttaggaagtgagtgcagaggtat

SEQ ID NO: 212084 - DNA, 407 bp, Homo sapiens
gtccagggaatagctttggaatatgagaccttgaaatagcaactctgtttccagcaacccagggaaattatctgaatgtattatttagtctggggcaagggaatctttagcggggattctcagggagtttggccccatcagtgatcgtatgggtgtcaaggctcttcacatgtcatgttcttttcatttgtagcaggtaggaatcatgcctgtctcattcatggctgttgccttggcatctgtcacagtgcttgaacaaacatgaactagaacaaacttttattccccgatttcattcttttgcttttgttcttttaaaatgttagaacattgtgaattaagtgggggagactagtgaacaggtggcagttttctataaatcgaagcaaataaatttgtatttaatt

SEQ ID NO: 212085 - DNA, 566 bp, Homo sapiens
  misc_feature (547)..(547): n is a, c, g, or t
aggatctgattcaccacctggtacatagtaggaattcatgatattgtagctgttcttataattattaatttgacctggaacttccatgtcctgattcttagatcttgcatgattatacacgtgttatctaattgatgaatttcaaatatgatctatttcaacagttaaatggctgaacagtcattaatttcaggtggtcctaaacccaaatcagtaaattctttgaggtggataaacctacatttcatttgtagtttaaaaagaaaaagtgaaaaaagtatttaaagtcctgggtcatggaaggcggagcttgcagtgagccaagtttacaccactgcactccagcctgggtaacagagcgagactctgtctcaaaaaaaataaaaaataaaatgggactgacaaattatttaataaagtctgataacactattagccaaggtggaaggggtggatactctcatgcacgctagtgagagtgctagttgatttgttgatttgacccatgcagagagtatggtgaaggaaagaagtccttagtacatgnggctggtgataggcccgat

SEQ ID NO: 212086 - DNA, 275 bp, Homo sapiens
aggatctgattcaccacctggtacatagtaggaattcatgatattgtagctgttcttataattattaatttgacctggaacttccatgtcctgattcttagatcttgcatgattatacacgtgttatctaattgatgaatttcaaatatgatctatttcaacagttaaatggctgaacagtcattaatttcaggtggtcctaaacccaaatcagtaaattctttgaggtgtgtatggtggtatggggtggtatcagagtggtatagcgtggtata

SEQ ID NO: 212087 - DNA, 350 bp, Homo sapiens
gaaacattcacttggggtaagacaaatggtattaaatgagaaaacacaccatgaattgcaaatggagctgagttaatttgttgctacagtagtgttgccctactgttaaatgaaggctgtgtaattatcttgctggcagagataatgtcaaaacctcatttctccttacatgcctcgtttttacatgagggctaattgagctgcaaggtgacaactgattatatatggctatcatctggtcctcttgctcaatttgcaaataacgttacccttttttacagtgatgatttttatcggacttcgagtaagatattaaagaaactttttgaactctttgagtaattcacaac

SEQ ID NO: 212088 - DNA, 523 bp, Homo sapiens
tgctggccctttgggacctggtggcagagggaccccgtgtcaacctgtctttggcttcctttgtggccccgtggtcactgaaaagccagaatgaatattcttcctttcggaataaaaattgagctgtggaagttttgtttgctttgatgaattacttccaggctgctgtttatttggagagcaaagctccccagctgcagggtgggtagaggctgcggtcactcccctcgtcaatgctggttcctgttcctgaggccgagagaactcctgacagcagagtgggcatatcttggtagttgcagcttttcaagacagtgtggcccagtggggagagagcagaaaacctgggttatgctggctctgccatttatcagctgtgtaaccttgggcaagtgatacaacctctgtgtgcctcagtttcctttcctcacctgtccacaggggatcataatcttggccctgcatgccttacaggagcgttaagagcatcaaatgaaacaataaaaatgaaaacatttataaa

SEQ ID NO: 212089 - DNA, 447 bp, Homo sapiens
gctcaggggtccaggcccggctcacctgggtctctgctttgagttgctcaccagctgcaggtgagctgtagtcacccccagctcagcaacagaaggatccagttccaagctcacatggctgttggcaggattcagttcctcatgggctgtgggcctaagggcctcagttccttgctagctgttgacataaggctgccttcagtcccatgccacatgggcctaactcagcagcttgcgccatcagagcacacatgccagcaggcaagggagagagtcagtgagacagattacaactgaatcacagaagtgacatcccatcacctgggccatgtgccactgggtagaagcaagtcactagggcagctcactctcaaggggaggggtttacaccatgaaggtgggaataccaggaggggaacactggaggccacctaagaagtccgccta

SEQ ID NO: 212090 - DNA, 685 bp, Homo sapiens
ctataaatcatgctgctataaagacacatgcacacgtatgtttattgcggcactattcacaatagcaaagacttggaaccaacccaaatgtccaacaatgatagactggattaagcaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaagcttagagtataataaaaaaaaaaattaaaaaaaaaaaaaatgatacatgtatacaatgtggtatgattaaattaggctaattaacatatccttcgcctcacatacttatcattacgttgtaatatattttcatattgggtaaaattaaatgtattactaaattgacttattctttttttacttttttaatgcagctattaaaatatttaagat

SEQ ID NO: 212091 - DNA, 459 bp, Homo sapiens
gtaatcccagctactcgggaggctgagagaggagaatcgcttgtacccaggaggtagaggttgcggtgagcagagatcacaccactgcactccagcctgggcaatagaacgagtctccatctcagaatgaaatgacatgacatgatgaaatgaaataatgaaattaataatgaaatgtgggtggcgcactccagcctgggtgatagagtgagtctctgtcatgaaatgaaatgggaaatgaaatatgaaatgaataatgaaatgctgggtgcactccagcctgggtgatagagcgagtctacgtcatgaaattgaaaaatgaaatgaaatagatgaaatgaaaaaatgaaataataatgaaatgccgggtgtggtggtgcactccagactgggcgatagagcgagtctctgtctcgaaatgaaatgaaacaaatgaaatgaaatgaaatgagaaatgaa

SEQ ID NO: 212092 - DNA, 534 bp, Homo sapiens
  misc_feature (150)..(150): n is a, c, g, or t
  misc_feature (158)..(158): n is a, c, g, or t
atttctaaaataattttttcttatttatatactgacttttcaaaatacaaaattaaaatatcatgtctgacttcagtgatcttttctcgggaggctttttagaaatgagatctttcagtcatcaggtagaggttgctggtaaagatggangtcttggntgtgttacccagggtggactcaaactcccgggctcaagtgataatgaaatgacatgacatgatgaaatgaaataatgaaattaataatgaaatgtgggtggcgcactccagcctgggtgatagagtgagtctctgtcatgaaatgaaatgggaaatgaaatatgaaatgaataatgaaatgctgggtgcactccagcctgggtgatagagcgagtctacgtcatgaaattgaaaaatgaaatgaaatagatgaaatgaaaaaatgaaataataatgaaatgccgggtgtggtggtgcactccagactgggcgatagagcgagtctctgtctcgaaatgaaatgaaacaaatgaaatgaaatgaaatgagaaatgaa

SEQ ID NO: 212093 - DNA, 334 bp, Homo sapiens
tcaaaaaaaaaaaaaaaaaaaaaaaaaaaagatatttaataaactttctgcatggcagagtctatacttccaaatcacaaatgaaaacctgaatttcagttcttcatagaatagttgggtgtccttgggcaagttatttaatttttctgagcttcagtttccttatctatgaaaggaaaattgagtgcctaccccagggtcaaatatataagtacttaataaatgctagttaccttcctcttatttcttacaaagtttttttggtggctaacattatttccctttaactgcaaatgttgtggtgtttatagttttaattttattgtgctatgta

SEQ ID NO: 212094 - DNA, 391 bp, Homo sapiens
tttcagtatctgcggattttggtatctgagggaggtcctagaaccaattctccatggatgactactgaaaaggggttactatcctatagataaagtgattaagagcatggagccagattggctaggtttgaatcccaattctgcaacttactagcagtataacttggaacaggttactaaacttctctgtgctacaatttccttatttgtaaatggaagataagaatagcatatgcttggtagggttgttgtgagaataatatgaattaatacaagtaatcacaataaatgctagttaatattattacttaaaagaacaagaaaatgaataagaaaaagacaaacacccttgtagaaaaataggggaaagcccaggaataagcaattcaca

SEQ ID NO: 212095 - DNA, 487 bp, Homo sapiens
tgctttttttcctaactcaagatggtacttagctcattagttttttcattggcttcaagcctcttttcctctaatacacacatgtgagattttaaattttctacaaactactactttagctttatcccacaagtttttgatatgcagtattttgatcatagttctaaatacattcaaatttcccataattctttgatgtactagttatttagtaatatgtttccaaacatatggaattttcttttttttttattgactactgaggtaatcacattgtggtttctgcaataatcagacccttgaaatttgctgaaacttgctttctgacctagttgatggtcaaaagttttaactttttcatgtgcttaaaaatatgtatctgttgagtgtgatgtactgtttgccttgtatatcagcttattctatcctttaaatttatatgttaaccaaagcacatgtaaaataaggaaacagtatattgaaaatg

SEQ ID NO: 212096 - DNA, 369 bp, Homo sapiens
aatctgagggatgattccttaattgtgcacttaagggaatgcctgtaattttctcatttgaaagaggctgaaaaaggtaaatttgtcaaaatattagtaataataattatgtttactgagtactgactctgtgccaagcactgtgctaagagctgggatttgcggcattatccatcattcatttggtgtatcagcccaggttttatctgatttgttcaactttttcttaacaaatgcccccccctcaaaaaaaatctagtgtgttctcaaattatacattaaatagaaattagtcattggatatttttaggcaaattaaaatcttcataatttacacacaaagtgcttggattttggattggtgaacag

SEQ ID NO: 212097 - DNA, 782 bp, Homo sapiens
gggctgtgaatttgtcctgatacgattctgcaagattgtttctctggctgtgctcagcagcctaaataagtaaaggagaagggaagatggattataagattgatccagagttgggagcaagctagataaatgcagtgggaggaatatgtgggatgccaggttgtttgagattttggtgacagaatggtttggttgattaaccctcagttcttacgaggttaagggcccatagatgtcatccagattggggtctttagaagtaggaattttaggtcgggcatggtggctcacacctgtaatcccagcactttgggaggccaaggagggtggatcacctaaagttaggagttcaagaccagcctggccaacacggtgaaaccctgtctctactaaaaatacaaaattagccaggtgtggtggcacatgtctgtaatcccagctacttgggaggctgaggcaggagaatcacttgaaccctgtggttggagatgacagtgagccaggattgtgccactgcactccagcctggacaacacagtgagactccatcttaaaaaaaaaaaaaggaattttatcttcaggtctattctgaagccacagggaagaattaaggataacctcaccgagatgaaagctaatatcacaaatgcctaaggaaggttcacttactgttccagcaagagagttaggtgttctccccattacaattatcattaaaacaaaaaaggatcttctgctaccttttggtggtgacaaggaagtgacaagacttcattccaatc

SEQ ID NO: 212098 - DNA, 404 bp, Homo sapiens
ctcgtttttgtcttttaattatgaaattttggagttttttatatacccttgattctaatcatttgtcaaatacatgttttacaaatatattctcctggtctgtggcttccgtattcattttcttgaattatctctctatgagcaaaaactttagttttaaataagtctaatttatcatttttaagatcagtttttagaattataataccttaaaatttgtttaaatgaattacacacaggcagttactatgaagagacagtttgagttaccagttaaagaaattgtaagccatgcatggtggtgcatgcctgtaattgtagctacttgagaggctagggcaagaagcttgcatgagtcaaggggtttgagaccagcctgggaaatatagcgagactccatctca

SEQ ID NO: 212099 - DNA, 375 bp, Homo sapiens
tctcttctttttctccaggaaagaggactattcaaacaaaggcactttgtggtccctttaacctgctaggagccaagagtgttgccagccaaacatgtcgagaagcagagagaaaaactgtcccatttccaattggtagtaatcccagctcaaagcagcattcattatccaaggtgctggctacccaggacatagagttgggaggaaagaaagggtgcctggtttgagaactttatttctagaagaataaagtggcccttgctagaaaatggtctcttgcagtaccttctagcagcaagtgaacactaggaagctttaataagaaatgtcactagattccaaataagaaaaccaaaaccggtcaggcacagtgac

SEQ ID NO: 212100 - DNA, 332 bp, Homo sapiens
agtagtttctcacagcatccagcataggttactcaagacaaaaagaggagtttggatgaaatggcatagggctgactactggactaagaattctggattttattctgcaagctggtggagacacatcaaagggtattgaacaggaggctgacaggattacatctctgtgttacagacattaggtctttgcataaaagtatatgctcccttatattatacacttacagagggctggctttgtttaacttgtcctacataactttcagtactgaaagtgagcattataccattgatgaggttgctattaaacctatgtaaaacatcaaaaaaaa

SEQ ID NO: 212101 - DNA, 396 bp, Homo sapiens
tttcagtgtgggttgtgaccttaaagatattattctctaggtccaaatgctatagatgaagaaactggggcaggacaaaactaagagcttcatttaagtttaaattgctatttcagctgggcgtggtggctcatgcctgtaataccaacagtttgggagcccaatgtgggtggatcacttgaggtcaggagttcaagagcagcctggccaacatggtgaaaccccaactctactaaaaatacaaatattagctgggtgtggtggcccatgcctgcaatccctagctacttggggggctgaggcaggagaaactcttgaacccaggaggcggaggttgcagtgagccaagatagcaccactgcactccaacctgggcaatagagtgagactgtccaa

SEQ ID NO: 212102 - DNA, 172 bp, Homo sapiens
aaatagcttgaattaaatttcataagtcccatataaaggatagcagtgttttgttccgaattatttatggacacctaaagataaccacatactacttaatgtgatataatagtaaatattataccagttaaagttctttggttaaaagcagtagaaatcaactctggctaac

SEQ ID NO: 212103 - DNA, 546 bp, Homo sapiens
cctcaaaagcggacagaacaaaacgaaaaatagacaaatgggattacatcaagctaaacgcctccacacagcaaagcaaacaatcaacagagtgaagagaaaacctacaggataggggaacaaatctgcaaactattcatccgacaagggatttttaataaccagaatacataaagaactcggtccagcgaggtggctcatgcctataatcccaacactttgagaggccgaggcgggaagatggcttgaggccaggagttcgagactggcctgtgcaatatggcgagaccccgtctctacaaaacatacaaaaattagccaggcgtggtggcacgcacctattgtcccagctacttgggggctgaggtgaatcacttgagcctaggaggtagaggctgcagtgagctgtgatcacaccactgcactccagccaggtgacagagcaagatcctgactcaaaaaacataaaaaatttaaaactttaaaaaaaaaaagtcaacttaatagcagggccgagcacgatggctcatgcctgtaatcccagca

SEQ ID NO: 212104 - DNA, 807 bp, Homo sapiens
aactagaaattcagttcagtgatgatggtggtgtctacagagtcagcattttccacgtctttgtccatgagaggttcacagaaggccccacttctgatcccagctgagatctctcttcctcctctagaccccagtaaaacccactgatcgcatccctagcacagggctcaccttgtctttattgccttcctttgacagacatggcttatctcatcaagctgggaacactgcagaggcagaaagcaccccctacacatacacgccccaggtagcaccagcacaggcttgcagacaggaggcaggaccagcttacagacagagaatgaagaggatgaaggcaggccagactctgggaaaagtagactaatggtgtctgaaaaaagtttcattcatgcatcaaacactaatagaggcttgtgctaggttctaaggagagagaggcagtactatgctctatgtcagggtgggggtgaggagcagacaggtaagctaacacctttagtgtcactggcaagggaggttctcaatagcatgggaacttcctatgatgctcatagaaaggggaggaaggaggggtgctttctgctcataatgagtcagggagagctccccagaggatgtatctgaactgggtcttggaggatgacaaaaggaaaaggacatcccaaacagggagaaaaccatgtgcaaaggccaggaggacagaagggaagagcgtgcccagagcatttgggcagaaccagcccactggccaagaggccgtgtgaggagttgggggatgcactacagaggcagcttgtgcgaatc

SEQ ID NO: 212105 - DNA, 791 bp, Homo sapiens
tgctttcatctttgataatggctcagacccttctgttatttactgtgtgtttctgactgattcttctcaacagtcaatattttaatgccttcggatgatttctactgttgtctgtttcaccacatttatcttcctgtgacccatttgtcattagtctaaccatcttcatttaaactattaaaaaggcagagctatttgcattgtatcactgaagctggtagtgaaaataatgctcccaggatagatttctttttccttttagtttttcgagaaatttcaagtagcctgtttagattttgactgaagtatttttactgcttaattgctggcagtacagaccagcatatgaactgaactctgttgttaaatatggatcatcgtctctaacccttcaaaggaaattcgtgaactgtacatcctacctcctctgtaggcagtggcaatttttatgcagtaacattcagcaataccctatttatccagctttgtccaaaagtgaagtcgttgaggaaaaatatctggaacattaaaacttttaaaacttctgtggataaaaaaagaaaaaaccactttctaaaatatattataaacatccttgccataaacagcagaccttaccaagcagaatgtgttcttataaaattgggtcattattagaaacacagttgggtactgcacaattaagcatgaaatcatccaaaatcatgtttccatctcaattgtggaacccagtgttcaaacttgttaaatcagtaacctgaattttgtaaataaaacaaatttcttatttg

SEQ ID NO: 212106 - DNA, 1109 bp, Homo sapiens
atatttcttatactcttgatgaggagaacagtattttctctaccttatatattgattgacactttgaaaacagaggtttgcctgatacaatttctagtgagactagactccctaaaatacaagcatggaaattttttgttgtcttctgcccaggactcacaaagccaccatagaatgtgtctgcataagcagtcaggcaactgtaaactttgtaaactttggggaagctgcagagtaggcttcagcgcagtcccaagggatccgggagggggtatctgacctatttctgtatagcctgaaaagttacagtaaagtctactttcagggggaatgatcacattctttgtaccaaactcaaggcagagatattcttgatctctgtgggaataatcacaatttaaccaaagtagcaaagagtaattttgttttgtgtctctgaagatggagttgcttgctgtagctggtctcctcaccagttccctgttagagagtagattctacctcactccatctcccccaacccccgattttgaaatggtgaaaaggaaatatagaaaaggttatcttctctagagttgcctggcaatatgacctagagaacatgggtagagacttgggaagtttttgttttctttctttaagcagtctgataaactcaggcagcagaggggatctttacttcatttgttggttcactttcttctgactatttagttaattatgtctagaataagaatgagttcgtaccaacattcagtttgaacccatgttttatccaagagatgaaaatagtattttcaaagctaagctttttgaaaatgaaaaactgtgaggtaattgtggcttaggttattgcaacaatgattgtcttataacttaaagtagatttcacttatatttttcaaatatgaaggatgcttgaaaggacccttgtgtgagagcttcattatgtctctctggtcttatcagagagattctgtgggacactcatttttgctgatgaggttaatagcttaaccggcctttttcccagcaaccactggtaaaccaagtggtcagattggtgatacttccatactaggatgcgtgagagttcgatcctatttccc

SEQ ID NO: 212107 - DNA, 776 bp, Homo sapiens
tctcagattcttgaccttcagaaactgccaaataataaacatttttgtttttaagctgctaaattttggaatgacttgttattcaacaatatataaattgtacaccctgataaactataaattgtgcggagaaaataattttcagagatagccttatgtactcccctaaaccttttttccccagaaatctattttcaaaaatatactctaccaagtgaagaaagaaaccaagaaagacaaagaatgtttagttgtgattggagatcagaaggagagtgttttaggcatgattcgccttgttatgctgcaataataagcaattccaaaatattagtggctagaaacacaaaggttgattttgtatctttgcaacatatccaacacaagtcagtcaagggttctgatcattgtagtcactcaggaatctaagctgattcagtctctagtattctatcattctaccgtaacaataagaagctttagcgttcaccatgtcagtcaaaaatgcgtggaaaattttaaactgactcttacatgcctctatgtaggagtgatatatgtcattttcatttcacttcatcatccaaaggaagtcacgtggtcatgcctaactctgaggggacaggggattataatcactaatatttttaagagaggtaagagaattaggaaaatattggagcattagtattacctgcaaagcctaggatccggaaaacagaacccacttggcggaaatcacgggtgcccaggggggctggcacaccttatctttc

SEQ ID NO: 212108 - DNA, 518 bp, Homo sapiens
atggagattggtattggtaggcttccttgttcattaaaaatgaacttctttatttttgccatttctgttgagctcaatttcccagtctcttttaaatcagctttagagatttgaggattgccagtggggtgtgttatttgacctcacttaatatttgtgtttggttcagatcataaagcaaaccaaattgactgcctctgctcagtacccaataggacttataaccaggcaaaatgtgggttgaaagatgtattcccaattgcaatgcagtggaagtgtttgtattaaacaaagtttcagagaactgcttaaggatctcagggtggtatgtgttctagatatttttttcttaacaaattaacactgtcaaattattcaggttgaaataattttttaacaaagtgcctttgctgtcctgtcacagtgctttattgctaatttttctcatgagatgattctccctgttgcttttgcctttgtctcacaatgtaccatctgaaactgctaagaaagttgga

SEQ ID NO: 212109 - DNA, 356 bp, Homo sapiens
ttcaacctctttgcaaacctccaacacctcttttaccataatcactgttagctaatgaccttgatacctatttgactgtcagaatggaagtctttaggaagaacttccataaactctcccacctcatctacttaactcctacatctgtgtccattcactctaccttctttcctgctatgaagaattagcttgaactgttcatactgttagctaagaccaacccctcattgatgcactataaaggcatccctttacacccactaaagcatgactctagcaattctcaacattctcttcgaccagaatcattctcttttggatcattcccgtcagcctaatgtcatttctctcacctt

SEQ ID NO: 212110 - DNA, 457 bp, Homo sapiens
agtcagtcttgttatcttcagtccaaccactgaatttgttccacatgccatgctctcttaccaccatagctttgtgtgcaacattctcactcctggaatgacttccttctttctctgcttggtacacgtcaacaaaggttagcccaagaggcaaaaatggtggacattttataaatacttaattggctaacttgtaggcaccatgcagaacactttaaatccattatttagtttccctgacaagcctgtggttagaggctattgtagttctcgttttataggaaaccgagaaaacacaggaggccatagattattacctccttttgtttcatttaacatgttttaaataacacataactttactaacattttaataacataattttatttaacacatacacatatatacatatataatatatagatataggtagatacatacatagatatagaatag

SEQ ID NO: 212111 - DNA, 268 bp, Homo sapiens
ttattataactctttaatatagcatggagaaaataagttttgtaatcactatctttgggtgatatgaaaactctaggtattgggagaagcaggactctgctgatactacttgtgcttctccacgctggcatttacctttcttgtaaacactagcaatctctgtagaggaagctaagccaaggctatgcacattgaaacctaaaagatggagactggtagcagagctcttctttgagcactgctccgtgtattgtaactttactcttct

SEQ ID NO: 212112 - DNA, 555 bp, Homo sapiens
aggcaggactgcaaggcagtgttgtgttaaatgcttgaaacctgaaatcagataaatgggggaatgaatcttggcttgacttcccactggggagcctcaactcctcatctgttaaatgggaataataataatactcacctcatcaaggtattggagaagccattcagatctcatctgtaaattgcttggcatggcaaccagcacatagtaatcattaaataactagtaatagctaaaatgcataatgaagtcaaggacttgtgaaaacagacttcctcctcactcctatatttccaatcattgaagtcactaattaacacgtcgtctctactagcctcagagagatgatatgccgagttcagttaacatcgatgatgagaaattttcagatgacctgattaatgtttttattgctcagagaaggaaaaggaagacccagagagggaaagtgaagtatctcgtccaaggtcatacaaagccaagcctagaacccagaaagatgtcctcatctctgatacagtgtcttttctgcccaagaacaccaactcccatctc

SEQ ID NO: 212113 - DNA, 419 bp, Homo sapiens
cctaaatgaggatttcctttttgaaaaacctactcagcattctgatctgtccctgcttaaacctatttagtctggtcttatagtccctgacttgagcccaaagagcaaggtttctcaaggtctctgtgcaggtctttgatgctctttcgtggaagagatttacagtggttacagccataaccggtgcctgtggctgaaccatgccttctgtagtgtgttcagcccttcccttgaattaatgcaagttccacctttgctttaatgggaggggacagaaggaccactttgaggaagcggaggcaagaagatagtctgcaaaagccatgacgtggcactgaaatgaagccctgtgtagggttttactcagacgttagagaactggctgcccctgagtgctgtgctaactagggaaagaaaaa

SEQ ID NO: 212114 - DNA, 341 bp, Homo sapiens
  misc_feature (4)..(4): n is a, c, g, or t
  misc_feature (27)..(27): n is a, c, g, or t
  misc_feature (54)..(54): n is a, c, g, or t
  misc_feature (77)..(77): n is a, c, g, or t
gctntgtcgcacaggctggagtacagnggtatgatctcggctcactgcaacatntgcctcccaggttcaagcaactntcatgcctcagcctcccgagtagctgggactacaggcgtgtgccaccacacccggttaatttttgcatttttagtagaggcgaggtttcaccatattggaagttatcttggatgaaaaagaacaccaagtatttctatatattatatacaatgtaaggaaacaggcattgggattattagcaagaactgcctggagttattctaaatgctgcctaagaattatttacattgcctgtcaaaatgtattatctaacacatgggcat

SEQ ID NO: 212115 - DNA, 1206 bp, Homo sapiens
cgtaacaagacactccaaaatttagtggttttcagcagcagtgactcgactgggcagttctttgctgttctgggctcactcatatggctggctgggcctgggtctggacctgggccgctatgtgatttttatcttgggctttgaaaattcagtgtagggacctataaatattcaaagatgatgagatgcatccttatatattttttgtattcactctgaagctgggaaagattaaaaggaactcctgcccttgggtccctaatgaagtctgggtcctaactcgctctattaagttctgtggctggtcaagtcactgatctaccttgggctttatttgatataaatcatataaatcagcaggtctcagcttttctgtccaaagccacctgagggataagataaattctcattagcaaataaacttttttaaggtataaatactattataaaaataacagatatttacagtacaacaatgcaagaggatcctaaatgaaaagcgaatgttttttctcaactctcattcccttattccagctccacagaggtaaccaattgttttttttttgttgttgttgtatggtttgtttttgttagacagtagtcttttcctgaacagtgctgctccttgtggagcaaggctaattcataggcagtgcatccagagtctgccccagttgattttgtgtgtaaccttctagcaactttttgaaaattaatttgttcttaaatatgcacatcatttttatttatttatgtttttgagacagggtctcactctgtcactcaacttggacaacagagcaagaccctgtcttaaaaaaagaaaaaaagaataatggagtttaaatatgtaaatgacaagtctaagatttcaaggtcatactttcatgctaaggagccatcacagctacatatatatatagtgtgtatacatatatagtgtatatacatatagtgtatatatatatagtgtatatatatagtgtatatatatagtgtgtatatatatagtgtgtgtatatatatatagtgtgtatatatatatagtgtgtgtatatatatatatatatttttgtttgtttgtttgtttgtttttggaagatggagtttcgctgttgttgcccaggctgcagtgcaatggtgcaatctctgctcaccacaacctcctcctcccaggttcaagcgattctgcctcagcctccc

SEQ ID NO: 212116 - DNA, 473 bp, Homo sapiens
caagcgattctcctgcctcagccgcctgagtaggtgggattacaggcacccaccaccacacccggctaattttttgtgtgtgtttttagtagagacagggtttcaccatgttggtcaggctggtctcgaactcctgacctcatgatccacccacctcggcctcccaaaatgctgattacaggcatgagccaccatgcccggtcctaagttttggatttttaatagagatggggttttgccatgccaggctggtctcaaactcctgacctccagtgatcttcccttctcgaactcccaaagtgctgggattacaggtgtgagccactgtgcccggccaggaagacaggtttcttttcagagtttcacctttagccagaattttcttatcagtcatatctatatgactactgacatacaagagaggagataggaaggtaggtagctagctagatagtcagataggtagatagata

SEQ ID NO: 212117 - DNA, 385 bp, Homo sapiens
gcttttttttttgtttgtttgtttgtttttggtctgggtcatttgttacttagttccttgaaatgtcttggatgaaaattgggttctgcacactggatctggctggttgattctgcctgcgaagactgaagttggctttgatgcctatagatgcactcacccttcgctcgggttccagaggccatgtggtgtatggggaaggcaatgtagatggtgggaaaatcacttgacttctcttgctcatctgtcaaatgaaactgttaccatccttccttcgtgcatccaaatatagatgtaaggagcacatgtgattatactgcacacaccaacagttcctgactatccaagtgctgtataattataaggttttatagtcattattctg

SEQ ID NO: 212118 - DNA, 182 bp, Homo sapiens
atcctctatggtggaaaatcaataaatgcctataaaaaggaaaattaagatataacaatttagggctgagcacaatggctcatgcttataattcgagcagtttgggaggctgaggcaggtggatcgcctgagtccaggacttcaagaccagcctgggcaacatagggagacctcatctctag

SEQ ID NO: 212119 - DNA, 961 bp, Homo sapiens
gacccaagtccaaacacaaaattcatttgttttcatttcatttatatatgccttctacacatagcctgaagataattttatacaatatttttgtgcatgaaacaaggttttttgtttgttttaagacagggtctcactctatcaaccaggctggagtgcagcctcaacttcctgggcttaagcaatcctcccacctcagcctccctagtagctgggagaagaagcatgcatcaccatgccctgctaagttttaaatttttttattgtagagatgggaatcccactatgttgcccaggctggtctcaaattcctgggctcaagtgatcctcctgccttagcctcccaaacagctggattacaggcataagccactgtgcccagccccatgaaacaaagttttgactgcaatctatcacatgagatcaagtgatggaatgaaatttttcacttctgacgttacgtcggtgctcaaaaagtttttgattttggagcatttcagattcgagatttttgcattaaggatgctcaacctgtacttgtgtgccaatgtctgatgggaatggtggccccctgtttcagggagtgaaggcaatgatggatcctgagttctggatatttgtaggaattgcagtagatgagtcttatgtgctgagagatttggagccctgtatttcagagaatgaaggaaccagtggtccctgtgacttgctaactgatgagaacagaacagaggccttatgtttcagaaactaatgggaattatggtcactgttcctggggggcttaagcaagtcccagcctaatccacaagtcatttattattcactcatctcctcattcattcacttagcaaacattttcctgagcccctgctctgagccatgcctgggtggagtgatattgaggacacagaaatgactcagacccagactgtgccctcagtaaattcccaaagacaga

SEQ ID NO: 212120 - DNA, 1010 bp, Homo sapiens
cacagataaacatggatactatattggttttctagggctgttgtaataaagtattataaactgagcagcttaaaacaacagaaattatccgggcacagtgtatcatgcctgtaatcccagtactttgggagactgagggcgggcagatcacttgaggtcaggcgtttgagaccagcctagccaacatggtaagatcctgtctctactaaaaatacgaaaattagccaggcatggtggcaggtgactgtagtcccagctacttgggagaagaagcatgcatcaccatgccctgctaagttttaaatttttttattgtagagatgggaatcccactatgttgcccaggctggtctcaaattcctgggctcaagtgatcctcctgccttagcctcccaaacagctggattacaggcataagccactgtgcccagccccatgaaacaaagttttgactgcaatctatcacatgagatcaagtgatggaatgaaatttttcacttctgacgttacgtcggtgctcaaaaagtttttgattttggagcatttcagattcgagatttttgcattaaggatgctcaacctgtacttgtgtgccaatgtctgatgggaatggtggccccctgtttcagggagtgaaggcaatgatggatcctgagttctggatatttgtaggaattgcagtagatgagtcttatgtgctgagagatttggagccctgtatttcagagaatgaaggaaccagtggtccctgtgacttgctaactgatgagaacagaacagaggccttatgtttcagaaactaatgggaattatggtcactgttcctggggggcttaagcaagtcccagcctaatccacaagtcatttattattcactcatctcctcattcattcacttagcaaacattttcctgagcccctgctctgagccatgcctgggtggagtgatattgaggacacagaaatgactcagacccagactgtgccctcagtaaattcccaaagacaga

SEQ ID NO: 212121 - DNA, 530 bp, Homo sapiens
ctcactgagtacactggataaagacatacaaacaacaaacattcatcgagtgcccaccatgtaccagacctcacacgtctgaactttgctaatcctcacaacaaccctatgtgtaagtactatcatcacccccattttccagaagaaaaaaactgaggcacagacaggttaaggaacttgcccaaaggacacgcacacctggtaaagggccggaatgatatccgaacccagggagctgtgttccggagtcagtgctcagaccctcaaaaggacagatccatttgtccagtctgctgcacggtctttataaacgatcatttttaatggctgcatcgtagaatcaaaatcagaaaaaaatcagaaagttcataaaagcttatgaaacaccttaaagactagttatgatgtattcagatttggggtaagaaaaaaaaaaaacctaccaaactctagactttcatcacaactaccatgcaaatagtaacgtctatccaatgctcataaacttttttagaaccatgtcaaccatc

SEQ ID NO: 212122 - DNA, 727 bp, Homo sapiens
ttttaccttgtagagttctttttaacagaatcctaaaaataagaattatttagtatgtcaagagttaaaaaaaatcactactcatttaatgtctaatctaaaatacaacaggctaacatctagctcagggatcagcaaaccttttttgtggctttgtgggccacgtacagtctctgtctcattcttttgtttttgcatgtgtatttatgtttataaactctttaaaaatgtaagaaacagccagatttgagccatagtggtaggtcgccaactcctggacactgttttggtaaactaaattatggcagtataatgtgtcatctatcaaatctaggaattaaaggaaaaaagcctagtaatagaatgactactataggcacaataatagatcactactgaatagccagaaataggacagtgatgcatttcggtaaatgtgagacaaataccttgtgataaataaggactgaatattgtgttgggctgaattagttttaaaagggactgatttctgattcaaaggacgttatagtgaagaatcataagatttttggggaggaaacacctatagagagaaagttagaaaaagaactaataatttctggcctgttcagtggctcacacctgtaatctcagcactttgggaggttgaggcaggcggatcacttgagatcaggagttcacgaccagcctggccaacatggtgaaaccttgtctctatttaaaa

SEQ ID NO: 212123 - DNA, 298 bp, Homo sapiens
ttataaattaggtttgcttaaggtgagaggggactctgatggtaaagttatacagggaacaattaatttttattgaggtgaggatgcaacaagtaagatttggggaaacagaaataaggaaataaaaacatcccaagtgtgtctggtgcaggttaagtggcttagtgtgtggtaaggagtatagaaaatagtttgcaactagtttgtgaaaatcctgctaagacaactagataggccggccacggtggctcacacctataatcccagcccatgtactaataaaagaaagtctttgagt

SEQ ID NO: 212124 - DNA, 565 bp, Homo sapiens
aggaatcagttttctccaggttccgttttgatttagtcagatgcaaacattgataatttctattagcccacctgcagccttggcagctctgtacatttgtgtctcccggaagatgtaggagatctgtctgccttctagagggaaggaacattgctgagctttctactgacctggtagaagtccagtgaattagcacactgtgctggactgtgccatctcgttacccattggacttttcttaagagaaggagagggtgcttggcagtcattgaacaaaagggccgggaggccagggagcagtgctgaactgctcacttcaggcagagatggagctcttgcttgtgttggaggaattgtggatttcatctcagccacacgaggccttttcctcagaaaagagagggcagttgaattactttggattcattgtgcagctacatgtttctccctcataagaagaatttctatgtaatataaccagagctcaagtctgctttaaataaaataaatcactgatattttagaaactgttccatacaaatgttctcatccatcttaccaagcc

SEQ ID NO: 212125 - DNA, 447 bp, Homo sapiens
cagtccatagaggctggatgtgtgtttgttttttcaaatgtccacatatcaacaaaatatcgtaagacatacaaaacaacaacaaacaaacaaacaagaaacaggaaaacatggcccaataaaaggaaaaaataaattaataaatctccagtaactgacccaaaagaaataaagatttatgaattacctgaaaaagaattaagaataaccatcataaaaatgcccaatgagctataaaacacacacacacacacagacaactaaatgaaatcaggaaaacaatatacaaacaaaatgagagcatcagcaaaaagaaactataaaaaagaactaaacagaaaatctagggctaaagaacaataactgaattgaaaaattcaccagaagggatcaacagtatactgtatcaagcaaaagaaagaatcagcaaacattcaagccgtcagt

SEQ ID NO: 212126 - DNA, 598 bp, Homo sapiens
caaagtgcgtggaatctgatagcacactgtagataatattaatatgaagactcatgcagaggcactcacataatatgtataattaactctgctataacaagatatatgcatttgtaaaaatcatcatgctaggcaaagcaccacaggtatcatgagagatggggtatggcagtggttctcaaccactcacaatcctccatgactttctctctctcctcaggctatatttggcaatgtctataatcactttggggtgctacactggggagtagaggaatcagggctactagcatctagtggatagatgccggccagggtggttgctaaacatcctacaatgcacaggacagccccaccccgctcctccagcaaagaattatccagccgaaaatatcagcattgctgaggttgagagaccctaggtttgagggcacaaaactcaaaaacttgtcaatgacacatcaaaaaacaaaacaggccgggtgcggtggctcacgcctgtaatcccagcgcttcgggaggccgaggtgggcagatcacgaagtcaggagatcgagaccgtcctggctaacacggtgaaaacctgtctctactgaaa

SEQ ID NO: 212127 - DNA, 495 bp, Homo sapiens
gagggtggaaacagatttctagaactgtagttactaactgctgagggcaataccagaaatataaagaagagaaaaatatgcaatgagtttatttctatttgtggtgcatagtaaattagacattaggtaaaagaggctgaatactaaggaaaacacagtgaagcccattctccaattgaaatagtgtaagccctctgataatttttcttcttaaaaccagctttattgaggcgtaattgccatataatgaattgcacatggttaaagtatacaattggagaagctttgacatatgtatacacttgtaaaaagtccatcaccataatgacgtgtccacgtagggttatcagttgtaagcaacgcaccgctctggtggggggagattaatagtccggcaggatatgcatgtgtgtgtgctggtggtgtgggaaatctctctaccttcctctcaattttgctgtgaacacaaaattgttctaaaaagaaagtctattt

SEQ ID NO: 212128 - DNA, 701 bp, Homo sapiens
attacctaaggcctgtagctaaattggtattttgttttacttttaagcaaaataataaactttccttttttgataggataaaggagaggtgaagatatataagagcctaaagaaatacataatttccttgagtcatatttttaattgatatcttaagatgccctccaaaaggtgaaatgtaagtggtgacagcatatgtaactttttctttcctgcttcagcttaatgtctgttgctcattaaaggatgagatagtttgtctcagttaacattctcatagaacatttcactttttctgtcttttgtcatttgttaacctatgtatatatttgtataactattttatatcttctgtgcaacacccaaccataagattattatattatttagggcagggactgtgcctgtcttattcacatagaatccacagtatatgaaatcctagtagtcgattaatgaatatttaataactgaataaatgaataaagtattcagcagtctcatctctactgtactcatccatcttcttatttatccatattgactgttaccccctcaccactgggcatacagggttaaaggactctccctaaccttctattcatcccagttacttaaaactattgataagcataagtctgtctattatccacaatccatgaagcagagaccttctcccatccaataaaaaagatttatct

SEQ ID NO: 212129 - DNA, 728 bp, Homo sapiens
ataggttagctctaatcttttttctctccttggatcgttcacctcaagattgcagaccctgggaggagagtgtgaatggccttgtgccgttctgggtcatgtgcctgcccttggctagaggaagacagagcacccaatttacagccccatgtagactgccttgtggagggatgggctgattctccaaaaggaaagcagctgctgttaggaaaaaggcaaagcgtgatgggtggcccctgcaccccatcaccctggagtctcccgttccagtctcccattccccggcctgtctttctgggctcttcagtaccccacattctccagccacactggacgaccagacatttcctaacactgagcacactcaggtctcagtgctatcctgtaccctgccttgcccttgatccccaaaaattctcaaacgtgttagcaaattccaccttggtaaattctttcctgactgccactttcctcgaatctttcatgtgcacagctcataaagtttctactgcatgttctaggtattcgtgtacctgcctgtctctgtctctatcacctagtggagtgttcttggagggtggacatgaggtcttccttaccttgggtccccagagtttcacacataaaggactcaatgagttaaatcctgtggcatttcccatcattgtcctttctcctcccaccattctaatactagtcctcttctaatcaagacctataacctctgt

SEQ ID NO: 212130 - DNA, 847 bp, Homo sapiens
tccgcgtctgcgcagccgcagtcagtgcggcgccagctctgcagagcccagacagggtccggttggggaggtcctcaggttctgaatcttgtgcctggagaaccagagaggaccctggagcaggaggagaaagagaagcttgtctcagaagctccacctcctcctggggcaatgcagagtctcaggcctgagcagacacgggggctgctggagcctgagaggaccaagactctgctgcctcgggagagccgggcctgggagaagcctcctcatcccgcctgcaccaaagactgggaggctgtggaggttggggcctccagccatgacagtgatgagaaagacctgtcttctcaagagactgggctttcccaggagtggagctcggtggaggaagatgacgaatcagagggctcccagggctttgtggagtggtcaaaagctccacaacaaacaaccatagtcttggtagtgtgcgtgctttttttgttcctggttttaacggggatgcctatgatgtttcacatttaactataatggtggctgttgttttaaaagtttaatttaatgaaatagatgccctatgtcatgttaaggaattgtgctagttaaaaatcaggaataggtgttgaatattttcaaatgcctttcaaacatcctttgagatgatttttaaaaaatttttggtgtgagttttcacatactttatttccatgaaatgaagacatcattgattgtaaaacattattttgtataccacggagaaagaaaagtgctaattaatcattaagatgccaccaactggaagatatctcctgactttgagaagatgaaaaaatgtgcaactgaa

SEQ ID NO: 212131 - DNA, 164 bp, Homo sapiens
acacccaccccaaaactcttcattttttagaacagtttcaggtttgcagaaacattctgaagataatacagtaagtttccatatactactcctctatccggttttccctattattaacatcttatattagtatggtacattttctatacttaatgaatattgat

SEQ ID NO: 212132 - DNA, 536 bp, Homo sapiens
ctacacccaattcagaccagatcccatatattcatctttcctcaaaatactattcaatgtaatctcacaattttgtccaattaggctcaaaactaaatttctgtatcactctccaattttccaccaaagagttcagctggcagtgaaccataacaaccacagtccaaggaaaaaaacagtaactgttcaattcactgtcttgttagttactcacaattcactatcatttaaaaacagtggatcttagcctggtttccaccccaccgcacccaggagacacaatactctcatttaacagcagcggttcacaaggttctgattctcagcataactggaaaaggacaagagttaggaaaaaaaaacagggatgggaggaagaggggtgagaatgttccttttgagagagacatccatgaaacacttaagatcgttcttttagacaagtcttaataatctgtttgaaatttatcaatgttcaaaaaaatatgatgcaaataatttttaagaaaaaaacagaaaccttaccctgcagttca

SEQ ID NO: 212133 - DNA, 510 bp, Homo sapiens
atttagaaacctggtatatgctacatggtgctgtgttatactgggtttgagaaagaatgggaagtgttacaaggattcagtggttggaaattaaggaagatagaaagttagtgttggatctgttttggctctttggtcatgcctttgtttttctcaaaatgaatgcagtgcccgtcccagaaaataccatatgagaagcgatttcataatgctgtgagagtctgttacagggacttgatcaagtctgagggccatgagagaaagtccctctgaggaagttgctttcaagctgacacctgaaggatgaagcagaattatcccagctgggatttgggaactggtgtttgaggctgaggactagcatgcatgataggaaaataacccagagtggcagaagtgggagtggtatgagatggcatcagagacgcagattcagggtcaaatcattcagagcctcctagaccatgtgaacacatgtattatgctgtggagatactgtttaataggcag

SEQ ID NO: 212134 - DNA, 477 bp, Homo sapiens
tgatgatttttgcataggtgcattttatttcatcaaaatatatttataaagatatattaattgaaatgcataaaatacaaatgaaggcttgatggggggctttaatatttccattttttacctcatactttgaatcagatagtagtatttccttttttttccctggtgctttatttattttttcttagagacagggtctcgctctgtcacccaggctggagtacagtggcacagtcatagcttactgtgacacctcaaactctggggctcaagtgatcctcacatctcagcctccgaagtagctagaccacaggtgcacaccaccatgcgtggctaattaaaaaaatgatttttggtagggacaggatcttgctatgttgccaaggctggttttgaactcccagcctcaagcagtgttcctgcctcagtcccccaaagtgttgggattatagacatgaaccactatatccagccaga

SEQ ID NO: 212135 - DNA, 623 bp, Homo sapiens
atatacatacatacatatgtgtgtgtgtatatatatatataatgattacctgataatagctttattatttagattttggaaataacagttatagtaaatatcatgtaatacaaaaaaccttattttaaaaaagaaaagtggcatagcccaatatatgttttcttaattttactttaccaagcattttgtatgtaacactttttacttctctaagtgactctgtcactagcctggtgttacagaaagaatgttaaaaatcagacaaaagttttatttttatgaagtttctcagatgatagacaataaagctgggattcccctacaggtctcttgctctcaaatccagagaatttaacaaaaatccgtgttataaattgacttccacacatatactgctaaacacatgtaatgtatcacattataaaggagatatcaaagagaaaatgcctctaatatccattaattttaaacatgtggatatattttcatattttaattaatatttttgaccaatgaaaatttacttatataatttttatatattacttgaacacataacatttttaagtctaatcaaagagttttatatattttagtgaaagtagatgtttaacagcttttcc

SEQ ID NO: 212136 - DNA, 386 bp, Homo sapiens
gagacggagtcttgctctgtcacccaggctggaatgcagtggcatgatctcggctcactgcaatctctgcctcctgggttcaagcgattctcctgcctcagcctcccaagtaactgggattacaggtgcctgccaccatgcccggctaatttttgtatttttagtagagacaggttttaccatgttggccaggctggtcttgaactcctgacctcaagtgatccgcctgccttggcctcccaaagtgctgggattagaggcgtgagccaccacacccagcctataactggctcttacccttactgtcgttaggctcttcctctgactctcggctcaattaaaaagatgaggtaaactttatacacaatcccttcatgtatattaag

SEQ ID NO: 212137 - DNA, 407 bp, Homo sapiens
gggtttggcttacatcaaagccatttgactctaggacacatttttagattcccaggagataatgattgtcacggaagacacacccactctgagtattcctactgttgggtaaaggaatgtttacagaatgttgtgcattctgtttactcctcctaaattcttccactcctggaagttaagcgtccccactaatcagcttcatctccagctggcctgcctggactctgaccagaaaatatctccccactctggatggccagggtggcacctttgtctattcccataattataatagctcacactgatgcagcattcactatgtaccaggcactatcctgagagctttccagttaactacggtcctcaccaaaaaatcccaagtaccacaatccccatttttacagatt

SEQ ID NO: 212138 - DNA, 768 bp, Homo sapiens
cacccaggcttagtgcggtggcacaatcatggcttactgcagcctcaacctcccaggctcaagtgatccacccacctcagctttctgagtagctgggactacacatgcaccactatgccccactaattttttattttttgtagagacagtcttgctatgttgcccaggctggtctcaaactcctggactctaaccctcctcccactgcagcctcccaaagtgctgggattacaggcatgagacagagcgcccggcctatctttctactttctgtagatgaattagtgctccaaactgtcagccaagaggcatctgaatagattcattgaattcctgtaagatttttaagggcaataaaaccaactgtggacagcttctccctcctcataccctcagaccggtatcagtgaccagttctgaccagtgatccctgggtatgaatttcaggagagaagtaggaatagctgaatagtcaccctctccttctccgccccaggccacatggctccatgtgctcatcatttgtagggttctgcttctcttgcattcctgagaaatacaattgatcagatactacagaggcttcagaaaatagcatgagaagctgacatgaataaattgcgttctcaagggaaacaccttttgacacactattattataacaaatggaaccacaaagggtcaggaacctgaatttaaagattatatataagtacattcttccaccttttactgaaggctttttctagtcttgggcacagaggtcta

SEQ ID NO: 212139 - DNA, 593 bp, Homo sapiens
aaatatggacttgtctctcattctttctccccaaagacttggatctggagagttggtgtccaggagagtgtcatgctagagcctggccagaagacaatctctagttgccatttcccctcagtgtgacccttgcaagtgcctagggtttttggttacctaatttccttcctagtccttaacacacacatgaaacacacagaaatactgaagaaagtactgagagctacttggataaaatagcaaaaggaagttctacaagacagagaattggatcagaccagctggtgttgcttaaatcaccaaatgtcagaggattctaagtgagcacttgtaatggaaccttttagagatgttgctctgagcatgaaggatgggactagaatgagaatttttattgtatttcttgatgaacctgtcagtcccccccttaaaatgtaagtgcctctttaaggcctgccagggtgaccctaagacctcaggccaagtctgcctcctggagcagcacctagagactgttccttcctgccagtccctggcatttgggccagcaggtcctgtcttgctcatgaactgtctgtcagtccagcctcttg

SEQ ID NO: 212140 - DNA, 889 bp, Homo sapiens
tctgcagggcagcgctcgccattgaatgacttctaggtgctccggggcacagagctacagcgccgctacaagcggtggtgcccgggccttggcaggaggatgtggcagatgctgaagagtgtgctggtcgctgtgggcccttaatggactgccgggcgttccactacaatgtgagcagccatggttgccaactgctgccatggactcaacactcaccccacacgaggctgcggcattctgggcgctgtgacctcttccaggagaaaggtacatgcccacgctccggaatggcctggaagagaacttctgccgtaaccctgatggcgaccccggaggtccttggtgccacacaacagaccctgccgtgcgcttccagagctgcggcatcaaatcctgccggccgcgtgtgtctggtgcaatggcgaggaataccgcggcgcggtagaccgcaccgagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagaattctgtgacctcccccgctgcggtaggcggcggggaccaggcctgggagggtacctgggaaccttggggaggggcgtggcttggccggggaggtcagaggggctgggcgtgacctgagagcatatcccgtggagtaccgtacacctgggaaaggcgggtttggtcccagccccagagggatctcagctgtcgctcggggccggacctatctcggtccatctaagggtccgaggcacagccccgccaagaggccacaagtgtcagctgcttc

SEQ ID NO: 212141 - DNA, 734 bp, Homo sapiens
tgtattggtggtgctctcacagaaattatgcttttatcttctctgcagtgttatatgttggtgtgcaaaaatgttaaatttatttttcctaagtaccccatctgcttttcaactctgtcctctgcctgaaaagcctccctccagcccctacttccctcccatcttagttcacaaagtcaggttgatttgcccccagctgtcaaagcagactacctgtttccacatgtaactggttatgttctgtaaagttacaaaaatagaaaggttgaatctgtggcggccgggtacggtagctcacgtcctgtaatcccagcacttcaggaggctgaggcaggcagatcacttgagcctaggagtttgaaaccagcctgggcaatatggcaagacctcatctctataaaaaaaatacaaaaattagccaggcgtggtggctcatgcctataatcccagctactggagaggctgagacaggagaatcgcttgagctcaggaagttgaggctgcagtgagctgtgatcgtgccactgcactccagcctgggtgacaagagcaagaccctgcctctaaaaaacaagcaaacaaacaaaatgtggaatcaccaggatttagtgaccaaatgctaggatataggacattgggagggaaggattcgagataatggccaaggtttgggtttggtggctgggtagataatgctgtcattcacaaggatagggaagagggaatgaggaata

SEQ ID NO: 212142 - DNA, 637 bp, Homo sapiens
tccttggctacagcacccaattaaagcctaaagccttcttccttggcaataatcctggtctcagtgatgggctttctctggggcaagcagcaggacccacaccaagcccctggtgttgtggtaacactgaatacaaaagacaaacagaaggtcttaaaagcagccagaaaagagagattacctatgcaaggctgccagttaaattgatagctggctactccatagcagcaatacaggtcagaatacaatggaataatacctgcaaagtgctgagagaaaacaatagtcagcctagagttcaagatccagcaaaatgatctttcactaataagggtgaaacaaagacatttacaggcaacaaaaatgacaaataaatatcaagtgtgtaaagtaataataataattattgtttgagacagtccccctctgtcacccagtttggagtgcaatggcacaatcatggctcactgcagcctcagcctcctgggcacaagtgatcctcccacctcagcctcctgagtagctgggactataggcacataccaccatgcccagctaatttttaaatttttttgtagagatggggtctccctatgttgcccaggctggtctggaactcctgggctcaagcaatcct

SEQ ID NO: 212143 - DNA, 365 bp, Homo sapiens
ttatagtgctgaatttgattttaaaagttttttctaatttttgcgtctgtattcctgggctatcttggtctgtattgttcccttcttaaatctgtaaccataacaggtctgttgtctgatgcacacagcaagtcaataacagagacactgggttgctgcagagaaggagtttaattatagggcctccaaacgaagagatgagaggaaacctcaaatctgtcttcccaaggagttgagaccatggcttttaaggattttggagtgggctgaagtattaagatcattgatttgtcaaagaatgctaggtgaaattatgggataggaagatgtacaagcagtattctcatgctgattctgttcccctg

SEQ ID NO: 212144 - DNA, 670 bp, Homo sapiens
atgggagaataatgttcctgtggagggaagtcaaatgggggaaaaatatttcaatcggagggaagagttagtgccaacgtactgagctggagtgtggaggggctgaggacagagcagggaaatggagggtgcagttaacctagggccttgaaggcctggagaagaaccttggcaatgtctgctagaaagcctgcgtaaaggcagaagacaggcgagggagggtggcagagctgccggaggctgtagacgcccaggtgtgcagggaaggccaggatccctccctgaaacagcttgctctcctggtcctctgcgggttcccctgccttccgccgcagtctcccttgggctttccgggacgttgtcctggctgtggtcctccgcagcctgtggaccatcctaaggctccaggtttgtatacatcacctgcctccttggcacccccagctgactgttctttcgcttttccaatacgggactcaatccctacccaggtgattgtggtggtcgtggaagaccgctgccttcaccctcccgctaaccagcttgctgccccccactcgggtcatgccagcgcctccctgagccctcgggcacaaataggtgaacgaccacacccgcctcccgctgtggactgagattcgcggtgcgaggggttcccgggttgaggacc

SEQ ID NO: 212145 - DNA, 404 bp, Homo sapiens
tgctttgctgaataccgttacaagtgccagatttattcctcgtcactctgctgttgtgaacatggtgagctggagctggaaaggttctggcaagagtcgagtggcctggctgcgcccaagtcctggatctgttactgccttgctgagagaccttggatgtgtcccttcaatctggctgagcctgtttctgcctctgtaaagtagtcttatcttggccttgtcagccccctagaagagctgggggttgactgggaatgcctcaaaccctttgtgagatatgactatgcaaatgagtaaaatgaacacactgctgctccaatgggaaggaattgttcgtaattaagtaggctctctcccatttggacagctcattatcaagctatttggtgcggtattcagcaaag

SEQ ID NO: 212146 - DNA, 586 bp, Homo sapiens
acagacctcctatcccccagccctgcgggtctcctcagctggacctctgactcgttcccaccttggacctcatgttccagccgtactgaaagcccactgtcctctgaggacacgccatttctgtccttctgcacaaactgtcttttctgcctggagcacaagtccctccctcgccctcctggggagagcctccttgtcttctaagatctctaaagcatcttctcaccctgctaactcctccgagttcctgaccggcatcctctggccacctccacctgcctcctcgaagccaccttggtttgggctgtctgagcacactgggttcgtgttgtcgctgaggatgctgtacagtcagggcagggatggtgactttttcctccccagctgtgtccccagagcccagcaggacaaggaggcctcagcaaacatgcagtcaatccgtggaactgagtgtgggtaggcacaggctgagcgatgagttccacgctgaagggggcagcagcgtgaatctctgcagatgcctgttcctgtgaacatcacccaggacaagacggggagtacgcccagcctcctggaagccttcctt

SEQ ID NO: 212147 - DNA, 997 bp, Homo sapiens
caagttgtcttgaagaatccttgctgctaactctggatcctgcttttcctatagtcagagggctccaaggtagaactctctaagtccctctcaatggcactctttgcctagaccaaactaatgaccaaacagtaatcaatctatcactgttgaagtcctggttttctcaaccaaattttaagtctttcccaggtatgtcagtcgagttgccatgaatcctcacctgtaggagtttctgggattcattttaaggaaactggaagaaaattaatgttttaatgtaaatgtttttaaaaccaagatcaccatagagttcacacaaaattttaggcagtgtttcaagaagcactcttatgtgttgttctttcagtccatgctccaggtcaccggtttttaggtaaacatgacatgacatgtacttgtaatatcagtgaaaggggcttttagtcgtctcagtatcttttttgcattcaggtattatagcgtttccaacaaattgagaaattacttatttggtgtaaaatgacaagagagagctttagaatttaataaaatgtcaaaaatacaatttgatacccttaaaaattattcatagatctggctgctctgtactactggatgggtggaatagggaagcagatcacttttgcatacaaaaactctttcaaacccaaaatattattggtggtacattttaaagtccaattgtggacttaaattagtcaaattgagagttactgagtccattcagatctccagtagggttttgtatctaatgtatttggccaccagttttacatgtaggtcatgactatacctggattttatcattaagttaactttaaagtatatacagtttgcaaaaaatgattcaaattaattggtttgtatatgtttgtgagatctagcttctgaggaatctcatacatagtaggaaccatcatagagtaaagcttgtagcagaaaaattggaagggttttgagatatcctagagaa

SEQ ID NO: 212148 - DNA, 687 bp, Homo sapiens
tttgtttaaaacttcactccttttaaaatgatatagagttgtgataatagatggaaaagtgtgcctaaagggcacagatggacttcctagaacttgatttaagagcccttttgggaaggaatgttacggtcctgagtaagggatgagtgaggctctgtgggttctgccaccatctcccatcctttcctttagtttcacctaaatgtgattgctttctctgctgtactccttcctctgtgcttccttctgtctatccttgctgctgccaccactgcttgctgcgggtacctataaaatggctatgtggtatctcaacagcaagttgagcagtggaccattagtgagaacattccattcatcctgggcacagccctagtaggtttattactatagtaggaggtctgtcttgtagcccttgagtatcttatctgaattggaagctagagaagaataaaacgtagatgactgaaacataaccagaagcaggatggtcttatttcagttgaagctctttagagccagtcaggagaggcattttggaagagatgaggtttttctatctgaggagggttagaatgggattaatagacctttaaaaactggaattgggagtgagaatcagttagtcaacaaatattctgctgtttactttgtgccagaaatgactctaggcactgggcatacgga

SEQ ID NO: 212149 - DNA, 533 bp, Homo sapiens
ccatgatataaccaggttatgtcgtgtcgttgggcataaaagtagatgcttaataaattctttaaacttttctcttttaataaatttttggttacaagaaaacacttcttccttatttttatcattttattcactttctccccacccactgtgacaatggttgcttgagtgtgactgatattagactagctttacataggcttattcatatacattgcattttaattctcacaattacgttgttagataggtgttattatctccaattttcaaaggggaaaatgaaagcccaaagagattgaacaaattgcgttggggtcacatagacagtgtcagagtagacattcaagacaggatgtagggccgtagactgagaacaccttccctcctccatgatgtctccttttcctaagacaatgtaacagtgatgctttatacaaactcttccacacattaaaaatgctgagattggccgggcacggtggctcacacctgtaatcccagcattttaggaggctgaggagagtggatca

SEQ ID NO: 212150 - DNA, 489 bp, Homo sapiens
tcaagcaaaagaaagaatttctcaacttgaagacaggtcttttgaaacaatccagtcaaaaaagaataaaaagggatgacaaagcctctgtgacatataggaagcaacaagcaaccaagtatttgagttttgagacttccagaagaagagatggtcaaaggcatcgaaaacctattgagtgaagtaatagctgaaaactccctcagtcttacaagagatatggatatacagatacaggaagttcaaagatccccaaatagatttaacccaaaaaggtcttctccaagtcatattatagtcaaactgtcaaaagtcaaagacagaattccaaaaacaagagagaagtgtcaagtcacatgtaagagaatccccgtctgtcttagttcgtttgtgtttctgtaaaagaatacccaaggctggtttatttataaaggtaagggttttatttggcttgtggttctgtagactgtccagaacctcagactgcat

SEQ ID NO: 212151 - DNA, 503 bp, Homo sapiens
gtttttgtagaatctgtgaacagatattttggagcacattgatgcctatgatgtaaaagaaaatatctaaagataaaaagtagaaagaaggattctgagaaactgctctgtgatgggtgcattcacctcacagagttaaacctttcttttgctccagcagtttggaaacactgcttttgtagaatctgtgaaggtatattttggagcatattgagggctatggtgaaaaaggaaatatcttcaaataataactagacagattctttctgagaaactgctttgtgacgtgtgctttcatctcacagggttaaaactttcttttgtttcaacagtttggaaacactgtttttgtagaatctgttaaggaatattttgaagtgctttgaggcctatggtgaaaaagaaaatatcttcaaataaaaactataaacaagctttctgataagctggtttgtgatgtgtgcattcaactcacagaattaaaacttccttttgattcaaca

SEQ ID NO: 212152 - DNA, 146 bp, Homo sapiens
gtgctggtacttctatgccttctcaacaagttttcctatctccaggcactacccagtccagtcagtcttacacaccacttcctcccagattaatctttataaaatgtcagtttggggagtcactcatcatctcaaaaatcttctag

SEQ ID NO: 212153 - DNA, 313 bp, Homo sapiens
cggagaacccctctcccatctgatgtctggggctgagggtcccacggtgggcactgttctgttttgggccacttgctggagcactccacagaccaggtagacatgatgtgccctgctggttggctcgcagggtctgcaacgccgccaaaacttgcctggaatctgcaactttttagtctacagaaaatcacttggcatatataacatataagctcctatttcttcaactggctacctctgccatccctcgggatgaactaaacctcagtctcacccctaatgctgccaccatctgtgttctcctagtaatcaa

SEQ ID NO: 212154 - DNA, 423 bp, Homo sapiens
cagttaaacagcttcagttattttttaatgcatgcaatgaaaccaaaatggatcaggtataaaacaagtgaacctgaaactgcatcatacaaatttttatgctttaatatctgatggcccagactttattaatttcatttccttgaccataacatgaagactaataaaaaactcttttaacctattttaaagcatttctttcttccttaatgtgacggattgctgtcatctccatgaatcaggcatgattttaataagataaaatacttacaaaagaaaatgtttgaaataatactcatttggactacatgtaaaatacgtggcttagagactgtaatgtaatgtaaatgaaacataaaaattttgttcaactgcaaatttttttccattcaatgcaagtattttcattttgataatacaaaa

SEQ ID NO: 212155 - DNA, 404 bp, Homo sapiens
caggtgacagagcaaaactctgtctcaaaaaaacaaaacaaaactgagaaatagtaagattggtaattcacaagctgctgctttgctaggagtggtaaggttataaattagataaactgataaccctgctcaagaaaaaagggaacataagtacacaggttagaagtaattttttaaaacagcaagtgttggatgggtgcagtggcttgtaaatcccagcatgatgggattacaggcgtgagccaccacacctggccaagatcctgtctttaaaaataaaaataggctgggagcagtggctcatgcctgtcatcccaacactttgggaggccagggtgggaggaacacttgagcccaggagtttgagaccaccgttgacaacatagtgagaccctgtctctaca

SEQ ID NO: 212156 - DNA, 378 bp, Homo sapiens
aacatatatgggagatttctgtgaataccaattgtacaggtggatttttaaataatagatttagggccaggcgcagtagctcacagaagtaataccatcactttaggaggccgaagcgggtggatcacctgaggtcaggagttcagaccagcctgaccaacaaggtgaaatactgtctctactaaaaatacgaaaatgagccaggtgtggtggcgggcacctgtagtcccagctactcaggtgggtgagacaggagaattgcttgaacccacaaggcggagggtgcagtaagccgagatcgcgccactgcactccagcctcggtgatgaagcgagacaccatgtaaaaaacaaacaaacaaacaaataaaatatattt

SEQ ID NO: 212157 - DNA, 514 bp, Homo sapiens
gaaatcaaataaatgaataaagagtctgcaataggatggtgtcaaaagaggtgaggtaaagctccctctcagttctaatatctcatgatctaaactgaaaacattacctattttgaattagaaactagagttcagtcgttctggttcaaaagtgtttcagaatattaactcaccaaatttagactatggaaccacagaaaattatcaaagataaaactccaatatacagatgtcttgttaggcccatcattcaacagtgagaccacaaaacgattacactcaaactccacgtaaccactgggctgacacactcctcctttctgtaaggcaaatgcaacgcatgcttcaaggtagctttgagcccacctgggaagcttgcaggtaggtagtcattttggcaatttaggattatctactcattcactcaggtgttactaaatcttggttttggtttggttttgttttgactcagccagtccacataacaaatagcagcaagcaaccccacaaataa

SEQ ID NO: 212158 - DNA, 296 bp, Homo sapiens
cttagcagatcctctccccatatgttaatattcaacatttggtcactcttcctcttaccggttactttttcctctcactttctctgtttataagctttttctacctacttttgtgtgagaaaaattagcgtgtgttggagggtatttctgcttatgggagtataggtcatgggtcttgggatatgtcccttgtacttatacatatgcccatggggccccatccttgctggcactggtgtgtttccctgcagccccctctgctggggtctgctgctgtttctgagggtgtgtttgtt

SEQ ID NO: 212159 - DNA, 890 bp, Homo sapiens
tgagtgggctcttcaaagcgaagccctttccacactcattgcatttataaggtttctctccagtatgagttcgttgatgtaccatgagacagtgcttcattgaaaagccttttccacattcactacatgtatataatttctctcctgtatgagtttgctgatgtgtgataagactgttcttcaaggtgaagcctttcccacatttattgcatataaagggtttctcaccagtatgagttcgatgatgtgcagtaagacgcctcttctcaatgaagccttttccacattcactacatatataaggtttttctcctgtatgagttttctgatgtgtagtgagactgaactttgtagagaaggccttcccacatacactgcatccatggggtttctctcctgtatgagttcgttgatgataaatgagccgacacttcttgatgaaggctttcccacattggctacatgtgtaaggtttccctcccatatgagttttctgatgtatattgagctgtgatttcttgaggaaggttttgtcacattcagtgcattcataatgtttcagttctgtatgagttctctgatggtccattagtctggattttctggagaaagctttcccacacatactgcatacatgaggtttttctccagtgtgaactctctgatgatcaataaactgagacaacttgaggaaggctttcccacattcactgcatacatgggcattctctatgttgtgagttctctgttgcttaatgaactgggacttattaataggttttgcaattgcaggaaacttcatttcagtataaaattgtttatggttagcatgaaaaagggatttcccatctctattaaactcagcagagttctttaggccagagctcctt

SEQ ID NO: 212160 - DNA, 403 bp, Homo sapiens
tttagaatcatctttcagaccacttggggttaaactctcttttggaaaatcccctgtgaggaccctcatgtttcctccccagtcactgagggtggggcgaaggcagcattctctcactgtggcaaggaactttggctccatgttctgtctgtgaatgaccttgaccaacttactggttcctgggaagtttctaagctataggaacaaagaccatctcttagagtttccattaggatcaaatgagacaacacctgtaaagggcctaccataggcctaataataggaagccctcaagaaatgggccgggtctgctggctcatgcctgttctcccagaactttgggaggatcacttaagcccaggagtttgagaccaccctgggcaatatagttatttttaataaa

SEQ ID NO: 212161 - DNA, 508 bp, Homo sapiens
gaagacggagacaagagaataacatggccacaagcccaggagatgcccatggcagccaccaggggctgggagaagaagcaaagtccaagtctccccttaggtctctggaggaagcgtggccctactgacaccttgatctccaatgagactgattttggacttccagcctccagactgtgagggaatcactttctgttgttttaagccaccaagtttgtggtcatttgttacagcagctgcaggaaactaacacccctggtgtgtgccctaccatcatctgacaccttgattcccaagttctgccatcaaggttccctccatgaaaaccctgagcccttaagctacctcaccttggagaaggtttcctattaagctccctctcaattttcaaataccagctcattatcagcttgttttcatccaccccctgacttacaagctccatacttacaagttgataatactgaaatggaatgccgttcttgattacacaaaaccatttaatcga

SEQ ID NO: 212162 - DNA, 386 bp, Homo sapiens
ttaggtcatatgcgaattacttacagagctatctcttggatgtgtgttcaagattgggtcccttcaaatgctaagaaaccatccttagagtacccaagaaagctaacatcacacgcgcatacatcagtctgttttttcttagttaattaaagtaaattacttcaaagaaaatttgcacagactcacttctttttgctttttctgtctctccctgcatatccatttctatactgtttccaggctgatcttgtaaacagtgtacctgtcactcatctttgaaggctgtcatacctccagggcatgtgctgatctctgtctacctgttcagtctcattttgttctccatacgcttcatttttcagaaatcgttaattattagtagttct

SEQ ID NO: 212163 - DNA, 344 bp, Homo sapiens
  misc_feature (282)..(282): n is a, c, g, or t
  misc_feature (321)..(322): n is a, c, g, or t
  misc_feature (324)..(324): n is a, c, g, or t
tttttcattttattatccataaataccaaaattatagtggtcatcattgctattttgaataccacccaggttacaacttggaccatagaatatattaatgaaaaggtccaggggaaaggattttaagaggaggatccttcaaagtggagccttcgatttactgaaataatagaaagaaaagatcaaattgtgtaataagtgcttgaagttaacttgtaggttgtgagaggagattccatcaataaactttttaaaaatttttttaataaaataagtaaatanccatgcttaagcataatgcaaagggtcttgataataatnnanctcagataaattgaagatga

SEQ ID NO: 212164 - DNA, 375 bp, Homo sapiens
aaatccctacaaacaagatcagagaccaactgagatctatctgtatcaatgtaggagggcgaaaagaggccctctctttcccctattccccatataccttctccaacaagactgttttacagtcaaattccgcctttgtatttcactcattcattcatttaagtgattttatttcgtgccaactatgtactgagcaatgtctacacacaaagagccctacccttgttgagcttatattctagtacagacattaaaatatatgtaaatttacagtacgctagaagacgaaaagaaaaaaatgaaatagtaaagcaggagaaagacaacctgaggctgggctcagtggctcatgcctgtaatccaaacactttggag

SEQ ID NO: 212165 - DNA, 285 bp, Homo sapiens
aagagtgaaagcttttcttacactgctcagagcctccccgtgccccaaagcagcgtccatctgcactgtcagcagccgcacaacccacagcctttgtggcatttggacgcagtcatcctttgtgtcaaggacatagagcaagaaaagaggagaagcgaatcccttctccctcctggggcctgagcagtgtcagtcacgaaagcggatgttgagggttacattgggtgtgctgggccaagtgaccaaggatctgtgtatcctttaataaattgtgtatgtttgtga

SEQ ID NO: 212166 - DNA, 443 bp, Homo sapiens
aactcttcgaggaaatcaaagataaaatactttacaagtgattttacaaggttcatattaccctgctatcaaattcagacaaaaattacaagaaaagaaaaccacagaaacaataatccctcattaatacagatgtaaaaatcctttaaaatatttttagcaaatcaaattcaaaagcacacaggtttatttataatgatggagtgagtttatcttgggaataacaaaagcttaccaatcaaaaatcagtctatgtaatttaccatattaatagaataaaaaagaaaaaccagatcattccaatagataaaagaaattcatttgacaaaattcaacacctattcaggataaaaactctcagcaaactaggaataacgagtaactacttcaacctgattaagggcttctaaaaataacctataatatcacttataatagcagca

SEQ ID NO: 212167 - DNA, 573 bp, Homo sapiens
actctgttcaatgagagagtctgtccgcagccacacctccacagcagtgggcacaccaagcaccaggtcttggttgctaagtactgttctccactagcagggaactggactcctcagagaaatggctgaatccaaggatgaggcaagggcagaacagtacaaagtggacctgaacattttgtagtgtgaaaaaattatgggaatatatcaaaaggacacgaagccagcttgacagagttctcctgttggccagatctggggcaatttgagcatcaacataaataatgataggaacttataaccccttgaataataaatctatacagatataaaaatatattttaaatactagagcaaaacaaccccttccttagagtagaataccaaaaaatacatagaaggaagtcattagaaacatcaccatttgtcaatcataatagtaataattaaataagccaagaagcatcgatggatgctaaaagctaatgggtgaaggttcataggaaactttcttacctagtctcaaaggacctcccattccaaaaaaagaatccttatttattaaaaaggaaa

SEQ ID NO: 212168 - DNA, 1028 bp, Homo sapiens
gtttatgttactgtagcttttaactgtaggttgtattgatatctttgaaaaatgaaatttttgacccctgagcaagaatatattgaagagtgtgtttcatattcacatatttttgaatttgccagtttgacttttgctttttaatttctagttttattcaggttttattagaaaacaacccagtgcataattttagtgtttttaaattgatttgttgttgttttgagacaagatcttactgtcacccaggctgcagtgcagtggcagaattttagcttattgtagcctcaacctcctgggctcaagtgattgttctttcacctcagttttttgagtaggtaggactgtagacatgcactaccatgtaaggctaattgtttgcttttttgtagtgttaggatctcactatgttgcccaggctggtctcaaacttttgacaccaatggatctcccaaagtgttaggattataggcaagagccatggcacccaatcagtatttttaaatttaataaaacttgttatgtgtcctaacagaatataccaggtgcaaataagaatattgtgtattatcttggttttgactggagagttttgtgtgtgtctgtgaagcctagttggtctataatatggtttggatgtctatgttgtccaaatctcatgctgcaatataaatcctcaatgttggctatgggacctggtgggacacgtttgggtcattgggggcaaatttctcatgaatggcttggtacatcctctcggtaaccaaaaagtttacactgtatcaattcaaataagagctggttcattaaaagaacgtggcttcttcacctcatacttgctctgtctcttaccatataatatgtccagttactctttaccttccaccttcattttaagctttctgaaatcctcaccagaagcagatgctggcacacacttcttatacactctgccaagctgtgagccaaataaacaatttttctttataaattatgcactctcaagtatttctctatatgcaaaagaa

SEQ ID NO: 212169 - DNA, 448 bp, Homo sapiens
taccttggaggcactgtgtttgaatctgcttagttttctaagcagatgaggatgggaatgaggagacgttagacccactagttctttggttctgtgattggttcttcttgcctgccttacaactcctgctgcttggaatcgttcatacgaaaatagatacacccagaacaaattatcttaaccagattctaaagcagaagtgcttagccaactcatagaattatttaattatttaatattggcactgcaaggagcttagagattgtcatttgacaaataaggaaacaggtaccaagaagtaaatttaatcaaaattacatgtccagttgtggttagactaggagtagaactcaactcagtacaatttccattgtggcataaatcaacataactaactgctgctgttactgtgctggctaagtgtccatactaaagtgttgaaattcgc

SEQ ID NO: 212170 - DNA, 567 bp, Homo sapiens
ctaaagtgtttatacttacagtgatggaaagtttttgacttgggccttccttattcctgcgtattatttaattttacagtgtttggtagaagcaaggtcaaaagtttactgaaaagaaaatgaagcccattaggagactattaggtatatcttaatatttcctttctcagttcctttagatccttcctcattgtattatctgggtcacactggttgagggattctaccttcctaatgtaacgtcagttgtgtttagaactgccttgacatacgtacctgcttgattggcgtcctcttctattagtcaccagagtacagagatactcagttccaatgataaaaatagtatacattccctttagttagaatcttcttagtgcaaataaccttggacctatgggtcctgtccatgataaaaggcagaacatttttcacttttttctttgagtttctcttcctgtgacttccccctccttgttatatgttttacatttgacaaagggggaaagaacactcaagattcctagtcatatgccagataaatatataatagacattattttaaat

SEQ ID NO: 212171 - DNA, 184 bp, Homo sapiens
tgcatgcaatctcctttctttatggtctttcactattactgagagtagccttagaccaccacacactctcagtcctagtgaaagaccataaagaaaggagattgcatgcagcatgaggactttgggttggctacaaagtagactgtctgttggcagaagaaattaccagacccagaaatgaggc

SEQ ID NO: 212172 - DNA, 362 bp, Homo sapiens
aattctgataacaggagcttgtctttatactgtggtgactgtatgccaggcactggcactttgagtactttacatgttttattggttaagataggctaggatatactgcagtaatacatgaacccccaaatctccatggcttaacatggtttattttcttctcgtgtgacatgtctactgaagggatctgttctgcttagcaacagcaactcagagacttagacgcatggaagctcccccttctctacaggggaagagagagactagagaagcgtatgcatacttttcacagctttcctaggtgttgtagttcattggtttgaactgtgatcttggccccacctacctagctgcaggagacc

SEQ ID NO: 212173 - DNA, 862 bp, Homo sapiens
agtctggactgtgtttctgtatctataaattgaggtttcagatatttattcagcaatattaataatctctgcctggattgcattccagagagagctttcctggccactcaaaacaagtcccctaactctctctcccctttccctgccttattttttccacaatacctgccaatatctgaaaacattgtctgtaggtgtacatgtgtgtgttgcatttattgcctgctagagcataaaccccataaaagcagaggtttttttctgtcttattcactgcaaaacctctggcacctggaatggtgtgtgctacatagaaagtgctaaatatgtatttatgaacgaaggaatgattgattgattgattctggggactcaacaatatgtagaaatgtgctttgcaaaccacaaagggcaaagcaaatgaaaggtgttcagctattattataaatctgctgcacactttagcatagttttaactcctcccacagcattttccaaggaaacgtcggtgaaatcttttttttctatttgggttttcttcaaaaagaagaattctgacaacctaatttaagagacttcctaggtgtggaactcagtgatggatcctcatctcttagcaacctcacataggagctgctcaccaggtaaatggggtgacaatttcaagtgggtgtgctcagtgtcagggatgagacatgtgataggaggaaggatgagaccttccccagccggtggaggggaacaaacctaaagcaggagtcgggaccctggtattgtagtcctgggcaagccattcccctttgagcctcctttcctccatacagtgaaggggcttggcaagatcccttccagctctagcatt

SEQ ID NO: 212174 - DNA, 317 bp, Homo sapiens
ctaggcattagcagacatcatccttgcagaatttaaaaatgaaattttgaataaatgagcagatgatgatcaaagaagccaggggggccagaagaacttttcagtttacatctttctacagccatccccagagtgcctgggtagagcaagcagagggccattaacaaaccagacaaatgcccaccgctcgtccaaggagcaaggctcgaaaatcagaccaggaacccgattcttcctgtcacaaccaggcacctgggatggtgagagaatgaactcagctgtgaatggtccagacctagaacccagacagatccttg

SEQ ID NO: 212175 - DNA, 398 bp, Homo sapiens
atttataggctttttaaactgagaagtttagtagcgcatttagcttcaggtaaagctggatctaggggttcaaacaatgtcatcagaattcaactctcaggctgaggtgggaggatcacttcaggccaggagttcaagaattgaactctctcccatctctgctttctgttgtgttgtcttccttctccagcaggcattctttttcatatgctgttttttttgacaacccttaagtactggatagagattctctacccaatactgaatcctagctgtgtcagtagcattgggctgggcctccatccttctgacccttagtaccctcatctgaaaatgggaaatatcttacccaccctgggatttattgggtagtgagtgattctctctattcaatactt

SEQ ID NO: 212176 - DNA, 182 bp, Homo sapiens
caggctgtgcacagtggctcacacctttaatcctagaactttgggaggctaaggtaggaggatcagttaaggccaggagttcaagatgagcctgggaaacatggcaaaaccctgtatctacaaaaaatacaaaatttatcagatgtggccaggcgtgctgggtcacgcctataatcccaata

SEQ ID NO: 212177 - DNA, 147 bp, Homo sapiens
gcagagctgagcagtcatgatgtgtgacttcaccgaggaccagaccacagagttcaaggaggccttccagctgtttgaccgaacaggtgatggcaagatcctgtacaaccaatgtggggatgtgatgaggcccctaggtcagaatcc

SEQ ID NO: 212178 - DNA, 357 bp, Homo sapiens
aatggaaggaaagtaaagatgaaattttgtctccttggctagctgttctataaaagtctgtgggatctgcaagccctgtgatcagtgaaacccttgtgcctttgacactgggacatgtcatggtaggaggggtgagtaaattttcctttacttggatttagcttgagtatctttcctgagggctccaattgcctttggcttgtgaaaattttcgtgagttctacaaattaatatgtgggaatgccaaagtttgtgtgtgtgggagtgagggtggtgtcaaatggaatgaaaaagtgaagatgtaatagttcgttttcacactgctataaagaactacccaagactgggtaatttatg

SEQ ID NO: 212179 - DNA, 617 bp, Homo sapiens
cagggctcatgggtacccatggatcacaggccagggcaccggatggcgctccagcaggaaggagggtgcctcacctcggcacaacactggatagggctttggtgatagctacaatcacgaaagctcaggaagctggtccagacgaaacgagcgtccacggcgtacctcggctatgcgtggggtcaggtttggcctgcttcactccctgctgtggtcgggctgggctgaccagcagtgaccggcgcttgtgcctgctggcacgcagaccagcccgcctggcaatggtgacatggcgtggtcgacactaagcccactgtatgagtgtcccggggctgctagaaccgacgaccacaacctgggtgtcctgaacaacagaaatgcattctctcacggttctggaggccagagcccaaaaccaaggtgtcggcagggccacttccctacagccgcctctcccagctctcggcggtgccagcaaccctgggccctccctggcttgtggctgcaccgctccagcctctgccttcgcgtaacatggcctcctccgagtgtctgtgtcttctcttctcccaaggacaccagtcattagatgagggccctaattcagtgcggccgca

SEQ ID NO: 212180 - DNA, 543 bp, Homo sapiens
ctctctcagttgagtcacacaggatgcgtttgattcctccagcaatgaattgtaacaacacacgtgaaatgttgtgtagcatgtccaaaattccagactctcagaagggaaacacgtgtttagcataagccacagtacataaacagtttaggcacagtgagctcctcttaccagttaggtggtaggaactctcttgaaatctaagttcccagactccagcaaaagggcagacttctaagctggtctttcaaagcataacagtaaggtctgttctgataactcttttgtacaaaagagcaaaattggacagaactaaagggaactatattcagattcataatcatggttggagacttttaactcttcttctctcaattattgaaaaaacagatagatcagaacactcatagggatttggaagctctgaagaataccgtcaatcaccttgtcatctcttaacgctactcccaagaaagctagagtacacattcttcccaagtgtaccatcaatcaccctgtcatctcttaaacaccactcccaac

SEQ ID NO: 212181 - DNA, 356 bp, Homo sapiens
caggtagtattattttcatcacccccatattaaaagtaaataggtagaaaaacatgttagcatccaagacaggttttctaactgcaaatctttagttgatcacactgatccttcaacctagtaacaactgtatgtatctgggaagtcttattctctctcttcattttctatcctgtgccctttaagagaagtaatttctatgaacccatattgaaagggtgcaaaagttgcaaacattgtaggaagaataatagtaccccctatgatcactgctatgaccagacagggacaaatactctaactctccccaccaccacatgctgcttctattgaatcctctaaacactccctttaag

SEQ ID NO: 212182 - DNA, 348 bp, Homo sapiens
ggtttccctatgtgcagacatcgagcagagctactcgtaaggggtcccaacgccttatgaaatttaaacaatcaagatgaagccactaacctgtgaaagttctattcatctagtgtagacagccaggttacaacatgcgccccaggcccctggcacggtgctctgtggagggtgctcgaggctcagccaccttgccggcccctgagcctcccctcctctggggaccttccgctaagaccagcacgtcttctcatgccccacacagagccaagctccttcctagcctgcctggattctcctacctggaatcccctgtccacatcaattaaagcaacaaacaagccacga

SEQ ID NO: 212183 - DNA, 850 bp, Homo sapiens
gttaatatgtgttttgctgtattaattttattgaccatctgacctatatttagatatggaatatgatttttttaaacattagggatatttggtcagattcttaaaatttatgaagtatatcatagataccaggatgtgctgtttaagtaataatgatagtagattacacacagtgagtaattgtgtacccaccttaggagacagaacataaccactgtccctgacattgtttggatgcccctccctgatgtggccccttctcacgtctgtagtgaccgccgcttttacgtttagcattccttgttttgtaaaataattacatcatttgtatatgagtcctataactaatatctgcagttttgcttgtttttgccctttatataaaatcatactggtgattctgtggcctgcttttctcattcaacatggtttttgagattcactcgtgttgcctgtagctgtagtttattttcactgcacagtttatctttttattctgctttcgaaggacatgtgtgctgtttccctccttccctccttccctccctccttcctttccttccactgtaaacatccctgtgaacattttggtacttgtcttctggtgtttatctacaagtggacttgccaggtcacagtgatcccttctcccgaaggttctattatcccgtctctcgatctggggattggatgtactcgactcgtagatcccagtcggaaatgacggtagcccgaaactctaacgacagccaccggaaagaagaaaatacaccacatagagggacaccagacacagaggagggctcaaaacagaacgcgagaggagaactctgatttattgcggggcggc

SEQ ID NO: 212184 - DNA, 332 bp, Homo sapiens
tggccaagtttcttggctgcaggcatttacagactatcaaaattctcaaaacagttcaaaccagttctgtgtatgagcagaatatagaatctgtcataatgttggccccctgaaattatgtttttatacactatgcttttcaaattggggccaatcaactcgtcattcactgaaatattttcagcagagattacactgacacatggggatgcatatgtcacattttataggggaggttttaaaatatgatcattccactggcatcgattccttgttaaccaaagacgaggttatttagatgcattgagtgtggctcttttggatcaactcag

SEQ ID NO: 212185 - DNA, 379 bp, Homo sapiens
taagaggaattgttaatttgctgtcttttgccacatagttattaaaatgttggaggtacgaacagaggatatctatgtttgcaagtgtaaagtaactttaaaaatactctgtcagccgggcgtggtggctaacgcctgtaatcccagcactttgggaggccaaggcgggcggatcatgaggtcaggagatcgagaccatcctggccaacatggtgaaacccctgtctctactaaaaatacaaaaattagctgcgtgtggtggtacacgcctgtagtcccagctactcaggaggctgaggcaggagaattgcttgaaccctggaggcagaggttgcagtgagccgagatcgcgccactacactccagcctggcaacagag

SEQ ID NO: 212186 - DNA, 524 bp, Homo sapiens
gaagaaagcatttgaatctttctgagtgagtagactgagtgaaaaagatccaacctcttcaatgcaggtgagaatcattcagtcattggggcccagagagaacaaaaaagtggagaaatggatgaatcctctctctcttcttgagctgagacatttgtcttctcctgctatctgacatgagagttcctggttcttggtcccctggactccagaattacatcagtgccctatcttgtcctcccacctccccagttttcaggccttcagaatcagactgggggttataccattggctcccttagttctcaggccttcagactgaattacacaaccagttttcttagttttccagcttgcagatggcatatggaaggatatctagacctccataatcacatgaaccaattctcataatcttcttttaggttctgtttctgtggagaacccagaataatatactggcttatcttgtttattgtctgtctttcctgattgattagaatgagagctccacaagggcaggg

SEQ ID NO: 212187 - DNA, 119 bp, Homo sapiens
aagggaagtgggggtggtggttatgaaagagagagaaagggaggccgaactctaccaccttcctgggttttggcaccaaaataaaaggttagccaagagaaacgacgagtagacccaaa

SEQ ID NO: 212188 - DNA, 954 bp, Homo sapiens
  misc_feature (935)..(935): n is a, c, g, or t
tattgacaaatgaaagaatttccctcaaattggaatactttactaaaactgggaaggagtaatcacataaagaacaacccaatagttctatactcatacaccaactgaagctatactagtagatagcaatatacaagtatatcaatatactacttttttatctttctgaaggtaaatcagtgtttctctctgcacttatctgcttccattcattcagttttttgtttgtttttgtgacagagtcttgctctgttgttcagactggcatgcagtggcacaatctcggctcactgcaaactccccctcctgggttcaagtgattcttgtgtctcagcctccccagtagctgggattacaggcatttgccaccacacccggctgatttttgtattttcagtagagactgggtttcaccatgttgcctaggctggtctcaaactcctgacctcaagtgatctgcccaccccttagcctcccaaagtgctgggattacgggcatgagccactttgcccggcctcattctggttttgttgtgtgctttgttctgtcttggaatatttgagggttaagaaattaggtcaaaagtctgccagcgtacaccaagctgtgtgtatagtgaaaggagggctggcaaaatgtctaccacggcatctgctttagaaaggtgaagctatcactgcaggtgtacacatcactaatgccatcctttcttatcactgggtgctggaaactcaggtaaaccagggaggagaaagtatcttcatttctcccaagagtgttatttctccatcatcatgttcaaagccttctctcaattctttgagttcttctctttatcttgtttcctactgccaacacaacttgcttctgctgtggcacatccttgctctgtgcctcagtttctgcatctcagggagcctcagtcctgtctgcntctttctttcattttgact

SEQ ID NO: 212189 - DNA, 257 bp, Homo sapiens
gaatgtcaccttctccaggaagccctccgtgatcctctccctagcccatctgaagcgctttctcacaagtattaccagaggtgatctgtaagcacattacagtttaaggagcacagctccgcaccccagttctcaactccagcagcaaattacacacatctgtggggttttcctaagtcctgatgcccaggcataagaatgataaaatggactttggggacttggagaaaaaggggggtaagggataaaaaatgaga

SEQ ID NO: 212190 - DNA, 365 bp, Homo sapiens
taggcatttacccaaggaaaactgaaatttacattcacaaagtcttgtgaagaatgctcatagcactttttttcataatagccaaaaattaaaaacagaccaaatgtctatttacagatctttaaaaactggtatattcatacaatggcatactactgagcaataaaagtgaatgaactactgatgcatgttacatgatacgacacggatgcatctcaaaaatatgttgagtttaagaagccagttgcaaaagactgcacattacatgattccactcatatgaaattctttttttttttttttttgagatggaatctcactcttatcacccaggctggagtgcagtggcaagatctgggctcact

SEQ ID NO: 212191 - DNA, 186 bp, Homo sapiens
acttcctgggctcaggtgtttctcccacctcagcctcctaactagctgagaatacaggtgcacaccatcatacctggctaatttgtgtgtgtgtgtgtgtgtgtttatggaggcttcattacaaaggcataattgaatacgttattggccactggtgatcaactcaacctttagaccttctcccgt

SEQ ID NO: 212192 - DNA, 337 bp, Homo sapiens
cattttttccaaattgtgaagggtaacgtctttagatggcacttcctgtctctcacatcaaaacgcgcgttttgatgtgagagagcaatctcaaaacgtaatttaaagatcttttttttagaaaatttcttttctatgttcaaattttatgttctttttttttttcttccttggcagtatttttcccctttatttttcttcttttgagttttgagatttaccaggaaaaaaaaaaaagtttaaacttctgggtctctcacatcagatttaccaggaaaaaaaaaaaagtttaaacttctgggtctgtcacatggatcttttagccctttatgaacag

SEQ ID NO: 212193 - DNA, 512 bp, Homo sapiens
cgttttgatgtgagagagggtcccagcttaaatgccatttactacccatagtctttaggttcctttccatccttcctttctttctgttttctttattgaaatatagccaaaaagttagtggacccataacacacaaggaactagcaagtgatagattcctcttatttctcagtggcttgtctgatgcaatctgattttggataactcatctaccattcatccgttcatttcaccctcaacataacacaccaaaaaaaaaaaatcctaataattttctttgtcaagaaactgcgttttgatgtgagagagcaatctcaaaacgtaatttaaagatcttttttttagaaaatttcttttctatgttcaaattttatgttctttttttttttcttccttggcagtatttttcccctttatttttcttcttttgagttttgagatttaccaggaaaaaaaaaaaaagtttaaacttctgggtctgtcacatggatcttttagccctttatgaacag

SEQ ID NO: 212194 - DNA, 498 bp, Homo sapiens
agctattttataattaatctgggtatatttgtaatctttgtaacttgtctgaacaagtaatccccattgaaaactttatgttgttctggctgcatggaaggccaaacctctccatcaatagtttgctggattggtaccactttcagttttagctgaattatttatttactgttgtaaattgagatgagtttttcatctcaatttctcttggggttctgaaccaaattgcccactgtatgtaaaagtacacaaatttctaaaatatgttttcatgagtcaaagaaatcatgaacttatagttagtatattaatttcagttagctataaattgaaaggtaaatccagatttaagtttatggaataacaatattgataaaaatcacttcatttttgtataatgtgttcttagtgcatagctttaaaattcagtgctgtattttatttcacaaatgttagaaagtatgtttctgatgtaggccttttactagggcttatatt

SEQ ID NO: 212195 - DNA, 386 bp, Homo sapiens
ccggctctcccatcagttaaggtcagaggatgttgaggatcactaaggaagtgcatgaagacaggaaagacatgtgggactgaaccctgggacactccagtgcttcatgatggaggaaattaggaggaatcagtaagggagaagtaggaaaatctggctagggagacaggaagagaaccaagagcaggaaaagtttcttgaaagcaaaggaggtcagctactcaaatgctgctgacatgttcaaccagggacctgagggcagagagatggtcattggatgtggccacatggaggtggccttggcattagtggatgcagtggggtggtggggatggagcctgaaaggagtgagttcaagagctgatgggagcagatgaggaagcaga

SEQ ID NO: 212196 - DNA, 552 bp, Homo sapiens
attttttctgcatacaaaataaatcatgtgtttgattcatttatttattcaacaaatatgtagtgagcacttactagaatactaaatgccattgtgctaaatgctagcaataaagcagtgaacaaaacggacaaaaacctgtcatgaactataccttctggtgggagagacagaactggccaacttaaatgaataacatacatcgtgtgttagatggtgctacagagaaaaatgaagcagagcaggaggtggtaagatgtggtggtcaaggtttgcaattttagacagtgtggaagaaaagacttgaaagaatcaagtgagtaaactcaggatatctgggagaagagcattctagacagacagaactggaggtacaaatgcccagagatgggaacatacctagaatattcaggcaatagcaaggaaaccagagtggttggatacaatgtggacaatgcattctatgtggttggagcagagtgatggaaggcaatagaatagaatagtaaccaataagatcatttagataatgatgggcatgaggagggaaga

SEQ ID NO: 212197 - DNA, 521 bp, Homo sapiens
cttggagtggcagaggcagaagaaaatctgtgtataagtggacctgcacagttcacactcatgttgttcaagggtcagctgtatgcatttttttcttagaggtaatctgttatttgggaatcaggaaaaaagttttaaaattcattttttaaaaataagttcaggttataacatttaagaagtttaatcttgttttttcagacttgcagaaaatactttagaaatgctgactctaaaatttatctttcatatgttgctggtaggaatgtaaaatgatataaccactctggaaattagtttggcaatttctcgaaaagttaaacgtacatttgacacacaatccagcgattgcactcctgagcctttatcctagagaaataaaaacgttcacaaaaaaacctgtacatgaatgctcgtagaagccttgtttataatagctaaaaaccagaaacaactcacatgtccttcagtgggtgaatggttaaataaaatgtgatagtcttgcggtagaacaccaccat

SEQ ID NO: 212198 - DNA, 331 bp, Homo sapiens
tcacacttgctggagctggagcagctatcctgaccgcaggtgcactcgagaatggaggccacacatggtgaagcaaccagatggaggctgggtctccaaggactctctaaggcagagtagccataccagtgactctggtaccagttctgaactgcccacctctgggtttttgatttttaaaaaaaagaagtaaacttctgttatatttaaaagccactgtatttggagtctgctaaatcaaatcctgttaaaaggcactgttaggtatccttaaggaaaactaaatttggtagggaagacaagacatatgagcttggaaaggtcatcaaat

SEQ ID NO: 212199 - DNA, 1206 bp, Homo sapiens
  misc_feature (778)..(778): n is a, c, g, or t
attctacagtcgtgggaaagcagattcagcgatcaacaacgttcgccagaggatgtggacgaaaccactgtggaaaggccaacttccaacgcctctgacctggtggtcagccctgcagatttactgagtgaaaacagctgcccatatgagtattacttataacaaacaaaaacctggaaacaacctaaatcttcaaccacagagcatgcaaatatattacatcagctcatttaaattggtaatcactaagacaacattaaacatggcaccatgttttctcaataatgtaaagcaggaggaaaaacagaaaacaattttgtttcattatactatatgcagctacatactataattacaatgtaaaaacagatgtacatgttagtagaaagtagaaggaaaccagaaaaaacaaaaatgaagacaacaggtgcactaggatggtaagattgtgtatgaaattttgttcacttaaaattgtctggctaggtgcagtggctcacgcctgtgatcccagcattttgggaggccaaggcaggcagatcatttcaggtcatgagttcgagaccagcctggccaaaatggtgaaaccccgtctctactaaaaatacaaaaattagccaggcatggtggtgggtgcctgtatttccagctacttaggaggctaaggcaggagaattgcttgaacccaggaggtggaggttgcagtgagccgagattgagccactgcactccagcctgggcaacaagagcaaaactccatctcaaaaaaaaaaaacancatccacccgatttgagctcactggccatttgccctatagtggccgattaaattaactgcccgcgtttacaacgggtgactggaaaaccttgggtcccacttatcgccttggagaaatcccctttgcagatggggataaccaacaggcccaccgtacgcctttcaacattggcaccctctagtgaaaggaattgtagcgttaattcgttaatccgccaaaatttgaaacaccatttcaaccaaggcccaatagcaaactctttacttaagatatcccgaaaggttaggttgtcactttaaaggccccttacggggctcacatcaggcgacaactcctttaggcgtgcccctcgcgccctcctatttttggtagcgctaacattattgcgcccatgaggcctatctatctcggcgatctgtccgccccg

SEQ ID NO: 212200 - DNA, 2222 bp, Homo sapiens
aggctgggacgacagcggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcatttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatcttttatttaaaagcccataattttgatgtatgtaaatatttcattttattgtaggatacattttgacagtatgatttaatgaatcagacctttacttaaagctatgataaattaggtgttcaacaagatttgatcctttgggcattaaatttggcaggaaagaccagtgatgtgtctaaccgctaattaccagaaaagaatatattaaactctgtgttactgctttgggaccctgaggttgctagcgtacactggcttggcatgtaaccgtaacaggtgttttttccttcttgtctgttcctgctctgtcagctcaggatgttttagcctgctcatttttgatcctgaaataagttgtgagtgcccttcttcacaacccttctgggtgtttcttttgagtcttcaagtgtctgtgggaattttggggtagtatccctgtagggtaaccaaacagtgaaaaactgcaggtgttgggaggtaattagatcaatagccagtgaatacgagggctaaaatgagggtgggatggttacctggtaaaactggtcattttgccctctatttcagttttctgctctttgtgtttatgtacattacatatgttctttttcattaaaaagtattaaatccaagttgaagctgttatcagtgtacatcatactatacttagtggcctatgaaaaagatgtgtccccacagaatacataataattttcttgccatgagagtttatatgatgtcctttttatagacctgtacttgaagaggaattcatacctctggatgcacttaaaagaaatcttgaatgttactcaatctggcattaaaacattttgtgactaagaagataaaataatctattgaatctgcctatttaaaccaaaacttatattttctagtagttacagtagacaaatttagccatttattccaattttgattaattgtttgcttaggaagaatactacacaggctcaggataggggcttattagaatataagtccatgattgattgttgatatttgtcctcagtggaaaagggggaaataatggcatgaatcttacatttttgctgttcttggtgtcctttcaatatctactagccaaatatgattattgagcatatgaaatatgactagtatgactgaggagctgaattttttattgtatttcttttaactactttatatataaatctaaaaactatatttgatttagttattaaaaagcttttaattatgtttggaagaaaattacaaacatgtattctatgaagtctaaatattaatctagtacttctgatgaaaatgtagtgttcaagttgagatatgctatcaaaaatatataccgtatttcaaatgcctagtactaaaaatagaatccaaaatattttaataatttttat

SEQ ID NO: 212201 - DNA, 2291 bp, Homo sapiens
aggctgggacgacagcggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcagtgagttgtgaagaaatgttgatcccagagaaaagtttgcattttgcccacctcaaagatattttgatttttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatcttttatttaaaagcccataattttgatgtatgtaaatatttcattttattgtaggatacattttgacagtatgatttaatgaatcagacctttacttaaagctatgataaattaggtgttcaacaagatttgatcctttgggcattaaatttggcaggaaagaccagtgatgtgtctaaccgctaattaccagaaaagaatatattaaactctgtgttactgctttgggaccctgaggttgctagcgtacactggcttggcatgtaaccgtaacaggtgttttttccttcttgtctgttcctgctctgtcagctcaggatgttttagcctgctcatttttgatcctgaaataagttgtgagtgcccttcttcacaacccttctgggtgtttcttttgagtcttcaagtgtctgtgggaattttggggtagtatccctgtagggtaaccaaacagtgaaaaactgcaggtgttgggaggtaattagatcaatagccagtgaatacgagggctaaaatgagggtgggatggttacctggtaaaactggtcattttgccctctatttcagttttctgctctttgtgtttatgtacattacatatgttctttttcattaaaaagtattaaatccaagttgaagctgttatcagtgtacatcatactatacttagtggcctatgaaaaagatgtgtccccacagaatacataataattttcttgccatgagagtttatatgatgtcctttttatagacctgtacttgaagaggaattcatacctctggatgcacttaaaagaaatcttgaatgttactcaatctggcattaaaacattttgtgactaagaagataaaataatctattgaatctgcctatttaaaccaaaacttatattttctagtagttacagtagacaaatttagccatttattccaattttgattaattgtttgcttaggaagaatactacacaggctcaggataggggcttattagaatataagtccatgattgattgttgatatttgtcctcagtggaaaagggggaaataatggcatgaatcttacatttttgctgttcttggtgtcctttcaatatctactagccaaatatgattattgagcatatgaaatatgactagtatgactgaggagctgaattttttattgtatttcttttaactactttatatataaatctaaaaactatatttgatttagttattaaaaagcttttaattatgtttggaagaaaattacaaacatgtattctatgaagtctaaatattaatctagtacttctgatgaaaatgtagtgttcaagttgagatatgctatcaaaaatatataccgtatttcaaatgcctagtactaaaaatagaatccaaaatattttaataatttttat

SEQ ID NO: 212202 - DNA, 2357 bp, Homo sapiens
aggctgggacgacagcggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcagtgagttgtgaagaaatgttgatcccagagaaaagtttgcattttgcccacctcaaagatattttgatttttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaatttctaaagaagtaccataagaaaaaaaagataatgggggtgtggggaatggggcctcactctgtggcccaggctggagtgcagtggcgcaaccgtggctcactgcaacctctgcctcccagattcaagtgattctcctgcctcagcctcccaagtagctgtgattacagggttgcagcttcacaggattcaaagcaaatgaacttactcagctacccagacatttggatgctgaacaaatttatcttttatttaaaagcccataattttgatgtatgtaaatatttcattttattgtaggatacattttgacagtatgatttaatgaatcagacctttacttaaagctatgataaattaggtgttcaacaagatttgatcctttgggcattaaatttggcaggaaagaccagtgatgtgtctaaccgctaattaccagaaaagaatatattaaactctgtgttactgctttgggaccctgaggttgctagcgtacactggcttggcatgtaaccgtaacaggtgttttttccttcttgtctgttcctgctctgtcagctcaggatgttttagcctgctcatttttgatcctgaaataagttgtgagtgcccttcttcacaacccttctgggtgtttcttttgagtcttcaagtgtctgtgggaattttggggtagtatccctgtagggtaaccaaacagtgaaaaactgcaggtgttgggaggtaattagatcaatagccagtgaatacgagggctaaaatgagggtgggatggttacctggtaaaactggtcattttgccctctatttcagttttctgctctttgtgtttatgtacattacatatgttctttttcattaaaaagtattaaatccaagttgaagctgttatcagtgtacatcatactatacttagtggcctatgaaaaagatgtgtccccacagaatacataataattttcttgccatgagagtttatatgatgtcctttttatagacctgtacttgaagaggaattcatacctctggatgcacttaaaagaaatcttgaatgttactcaatctggcattaaaacattttgtgactaagaagataaaataatctattgaatctgcctatttaaaccaaaacttatattttctagtagttacagtagacaaatttagccatttattccaattttgattaattgtttgcttaggaagaatactacacaggctcaggataggggcttattagaatataagtccatgattgattgttgatatttgtcctcagtggaaaagggggaaataatggcatgaatcttacatttttgctgttcttggtgtcctttcaatatctactagccaaatatgattattgagcatatgaaatatgactagtatgactgaggagctgaattttttattgtatttcttttaactactttatatataaatctaaaaactatatttgatttagttattaaaaagcttttaattatgtttggaagaaaattacaaacatgtattctatgaagtctaaatattaatctagtacttctgatgaaaatgtagtgttcaagttgagatatgctatcaaaaatatataccgtatttcaaatgcctagtactaaaaatagaatccaaaatattttaataatttttat

SEQ ID NO: 212203 - DNA, 509 bp, Homo sapiens
gtgagttgtgaagaaatgttgatcccagagaaaagtttgcattttgcccacctcaaagatattttgattgtgagaacttggttacattagtctttcgtggctatatcaatatcattatttcgtgtgctgtgtggtaatgaaagctattagaaaaatcatttgtatcttaatgatttagtttgcataaaaacacgcatatagagttaagagtactttgtgtttttccactttgaagtataatatgtggataagttattagaacatttgtccgtgcctctccccaaacaatgcgcaaacggaagtgcactctaacaactaagattttaaaacacaatggtcaaatgttgagcaatgttttattgactactctgaatttatcaagtggtagataaaggacattacaatgccctagaagtgctcacgatatcaagtaaagcatgttaaattcaagtacagaaaatgcaatattcttactactgagataaaaaatggaatttaataaattacag

SEQ ID NO: 212204 - DNA, 1151 bp, Homo sapiens
  misc_feature (1070)..(1070): n is a, c, g, or t
  misc_feature (1074)..(1074): n is a, c, g, or t
  misc_feature (1080)..(1080): n is a, c, g, or t
  misc_feature (1143)..(1143): n is a, c, g, or t
aggctgggacgacagcggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcagtgagttgtgaagaaatgttgatcccagagaaaagtttgcattttgcccacctcaaagatattttgatttttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggggtgtggggaatggggcctcactctgtggcccaggctggagtgcagtggcgcaaccgtggctcactgcaacctctgcctcccagattcaagtgattctcctgcctcagcctcccaagtagctgtgattacagggttgcagcttcacaggattcaaagcaaatgaacttactcagctacccagacatttggatgctgaacaaatttatcttttatttaaaagcccataattttgatgtatgtaaatatttcatttatgtnggtnatttgncgttgattatgatcgacttactaagcatgaaatagggtcacagattgtcttgggctcattggnggagacat

SEQ ID NO: 212205 - DNA, 973 bp, Homo sapiens
aggctgggacgacagcggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcatttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggaaagagtttttaaaatctggaagactcattttctctcagaagcctccattgctcttttgcatgactccttttggtggtggtttctccataaatttagggtatagtgatttttaaaaatttattttttaagttgatttttggcataattaatttttcaatagagataagtctagtacaaaaatgtttttctggatgcaactacagagattagtttttgagcattccacacattagaaatcctatatgatgtctagagttctttcagaggagttaaaacttgattatagattcacaaagattcctggatctttgaattagacttcatatattatatctatcataatttatccatttgttaagtcgaggccaaggtcgcatttcaaccgaaggacagaattggaggggcgaatccgttggcaggaccggacaagaggggtatgctggtccacgggtatagaccctacggcacttgagagcgacgaaggcgctatccaggggggcccgaacatacgggggaaaggggcgccagacaggaagaaggagcccgacaagaagaggaggaggaacg

SEQ ID NO: 212206 - DNA, 2348 bp, Homo sapiens
aggctgggacgacagcggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcagtgagttgtgaagaaatgttgatcccagagaaaagtttgcattttgcccacctcaaagatattttgattgaatttcaagaaagctgagaatggagtggtcaataaaggcttctttttcggacttggtttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatcttttatttaaaagcccataattttgatgtatgtaaatatttcattttattgtaggatacattttgacagtatgatttaatgaatcagacctttacttaaagctatgataaattaggtgttcaacaagatttgatcctttgggcattaaatttggcaggaaagaccagtgatgtgtctaaccgctaattaccagaaaagaatatattaaactctgtgttactgctttgggaccctgaggttgctagcgtacactggcttggcatgtaaccgtaacaggtgttttttccttcttgtctgttcctgctctgtcagctcaggatgttttagcctgctcatttttgatcctgaaataagttgtgagtgcccttcttcacaacccttctgggtgtttcttttgagtcttcaagtgtctgtgggaattttggggtagtatccctgtagggtaaccaaacagtgaaaaactgcaggtgttgggaggtaattagatcaatagccagtgaatacgagggctaaaatgagggtgggatggttacctggtaaaactggtcattttgccctctatttcagttttctgctctttgtgtttatgtacattacatatgttctttttcattaaaaagtattaaatccaagttgaagctgttatcagtgtacatcatactatacttagtggcctatgaaaaagatgtgtccccacagaatacataataattttcttgccatgagagtttatatgatgtcctttttatagacctgtacttgaagaggaattcatacctctggatgcacttaaaagaaatcttgaatgttactcaatctggcattaaaacattttgtgactaagaagataaaataatctattgaatctgcctatttaaaccaaaacttatattttctagtagttacagtagacaaatttagccatttattccaattttgattaattgtttgcttaggaagaatactacacaggctcaggataggggcttattagaatataagtccatgattgattgttgatatttgtcctcagtggaaaagggggaaataatggcatgaatcttacatttttgctgttcttggtgtcctttcaatatctactagccaaatatgattattgagcatatgaaatatgactagtatgactgaggagctgaattttttattgtatttcttttaactactttatatataaatctaaaaactatatttgatttagttattaaaaagcttttaattatgtttggaagaaaattacaaacatgtattctatgaagtctaaatattaatctagtacttctgatgaaaatgtagtgttcaagttgagatatgctatcaaaaatatataccgtatttcaaatgcctagtactaaaaatagaatccaaaatattttaataatttttat

SEQ ID NO: 212207 - DNA, 2419 bp, Homo sapiens
aggctgggacgacagcggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcatttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattggaaatatcaatttgaacaactatccttgcaagaaaaatacctttacaagagctaaggaatccaggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggggtgtggggaatggggcctcactctgtggcccaggctggagtgcagtggcgcaaccgtggctcactgcaacctctgcctcccagattcaagtgattctcctgcctcagcctcccaagtagctgtgattacagggttgcagcttcacaggattcaaagcaaatgaacttactcagctacccagacatttggatgctgaacaaatttatcttttatttaaaagcccataattttgatgtatgtaaatatttcattttattgtaggatacattttgacagtatgatttaatgaatcagacctttacttaaagctatgataaattaggtgttcaacaagatttgatcctttgggcattaaatttggcaggaaagaccagtgatgtgtctaaccgctaattaccagaaaagaatatattaaactctgtgttactgctttgggaccctgaggttgctagcgtacactggcttggcatgtaaccgtaacaggtgttttttccttcttgtctgttcctgctctgtcagctcaggatgttttagcctgctcatttttgatcctgaaataagttgtgagtgcccttcttcacaacccttctgggtgtttcttttgagtcttcaagtgtctgtgggaattttggggtagtatccctgtagggtaaccaaacagtgaaaaactgcaggtgttgggaggtaattagatcaatagccagtgaatacgagggctaaaatgagggtgggatggttacctggtaaaactggtcattttgccctctatttcagttttctgctctttgtgtttatgtacattacatatgttctttttcattaaaaagtattaaatccaagttgaagctgttatcagtgtacatcatactatacttagtggcctatgaaaaagatgtgtccccacagaatacataataattttcttgccatgagagtttatatgatgtcctttttatagacctgtacttgaagaggaattcatacctctggatgcacttaaaagaaatcttgaatgttactcaatctggcattaaaacattttgtgactaagaagataaaataatctattgaatctgcctatttaaaccaaaacttatattttctagtagttacagtagacaaatttagccatttattccaattttgattaattgtttgcttaggaagaatactacacaggctcaggataggggcttattagaatataagtccatgattgattgttgatatttgtcctcagtggaaaagggggaaataatggcatgaatcttacatttttgctgttcttggtgtcctttcaatatctactagccaaatatgattattgagcatatgaaatatgactagtatgactgaggagctgaattttttattgtatttcttttaactactttatatataaatctaaaaactatatttgatttagttattaaaaagcttttaattatgtttggaagaaaattacaaacatgtattctatgaagtctaaatattaatctagtacttctgatgaaaatgtagtgttcaagttgagatatgctatcaaaaatatataccgtatttcaaatgcctagtactaaaaatagaatccaaaatattttaataatttttat

SEQ ID NO: 212208 - DNA, 1290 bp, Homo sapiens
gccattttaggcagaatggtcggcaaacacctagaagaggtgagggagtgaatgaatgatacatgtatcttgagggaaaatagtccaggtagagtagagcagatgcttaagtcgtaaggcgttttggagggcagatgggataagtggatggatagtaggttcaggaaatagcaagcaggccagtatggctggaacaaatttagatttaaaaagctagtggtggttccactgtggctactacatactttcaagtggaactgagaggatttgctgtcagactagattgagttatgagaaaaaagtcaaggttgatggccaaagcaactggaattgtcacatatagaaaatgggagaggactgggcgtggtggctcatgcctgtaatcccagcagtttgggaggccggagtgggtggatcacaaggtcaggagtttgagaccaggctggccaacatggtgaaaccctgtctctactaaaaataaaaaaattagctgggcgtggtggtgcgtgcctgtaatcacagctactcaagaggctgaggcaggaaaattgcttgaacctgggaggtggaggttgcagtgagccaagatcatgccactgcactccagcatgggtgacagagcaagattctgtcttgggggtaaaaaaagaggggggaaattgtgggatgaaaaattgacaaataaattggaaaagcttattggatacacaattgaggatacaaaggacagagtttggtgcctcaaatgctactagtgggtttagggatctccttacttttcaataaaaagaagcataaaagttaaataaattgtttgttttctctatcaagtatactatccacatttgtagatcatatacttttgaccactaagctacttagaaaccaagttaaagcaatcattgtgttaatgctttactcttctgctagacttgctagtaggtgttcaataaacccaggtgtaactaataatggggcgcctgcttatcaacttcacaagacagcctagttaactggtgagcacctgttagatattgtaactatgacggcaggctaccagtatgtattccttccagtccgctccgtgtaagagaaacaatgaagaaaatcactgttccatcaattctgtattcattcttaactataaaacaaaaaattttcaacaaccaatttagaaaacacgttccttttttctcttaattctccaaatagttcatgtaggagaaatgaagttttggaactcttagtaaaatacctaatttgactaaacttctcacatttcctctgtgc

SEQ ID NO: 212209 - DNA, 1034 bp, Homo sapiens
gttcaaaacaaagctattgccttttatgttttcagtacaggtgcagaattcgactacttcccaccacccttgctgtcaccattctgtccaggccactatcacatattacctggattattgcagtaacttgccagtttctttgttctgatcttaagccttttgacataggtgccaggatattattgccaaaactttgtgagtcaaatcagatcactgctctcttcaagtccctccagtggtttcccagaccattaaaaataaaaaacctaagttcttactacaacctgtgggactctacatgttccgactctacattacctctctgatctcatctttgccttcttttcttattcactccagcaacacaaaccatgtttttattccttgaacataacaggtatttaacctttcaaggtaatactttcttccagtgcctgaaagctttcctgcccagttatctgcatagataccattttacttcctttattctacaactcttacagtttaaaattagttgatagcagacattaaatggtagaagcaagaaaagaatgatgtatgttgtaatagtagtagagggaaatatgggagcataactgggggcctgttccaagactaaggataaagaaagctctccttgatggtgtcataccagtaatactttgctgagaagataagatatcaaagagacaaattaatttctgataacttttccaaatggactctagttcaaaccagaaattccctagtgtatgtctttactaaattgggagaagtagagcttatatgcccctatttggcgaacttgccataacctaaattgtgatctggggtacattttgaaaccgtaaacacttttcttctaggattatgtttatcccttccaagaatcattatagaaaatgagagatgtaaatgatggggttatgttgtgtttgtgaatgatattgaggcagaataaaaataaaacccccgggatggggtaccccatggttacctttccttgggtgaggcgggtttttgccttcttctct

SEQ ID NO: 212210 - DNA, 316 bp, Homo sapiens
ccttcctgatcagattgttaagaagaccaaataagaaaggcacattaaaaaagtacactttgaagaaatacgcaaatagatgagactgttttaatgaccttagcacactctaaagactatgtttatcaactgccatttctgtgagtaatcacattagaaagtcacatcacttgtaatttggacttttgcaaagtggtccaccatgtgtaatataacattattttaattttcacatctctactgttactgattgtacaaataattttgtatattagaagaaaagtcattaaacacaatacgattttttatctgagaa

SEQ ID NO: 212211 - DNA, 495 bp, Homo sapiens
acccaaactcgatgagggaattggcccagggaggttgagtgattttcttgaatcgcacatttagttggtggcagagccaggataataatgaaggaccttgaacttcgctcagtccgtgagtttttttctattactccatcggtaattatttcctttactaaaatgtacattcttatgatatctttaaaatcatgctcacccttgtatttaacaaatgatttactaacagttgatttacatacaatttttaaggaacatatttatagcatagaaagtggtgcagagggttttaccaaatttctctggggtgtccaggtcccctggtccttccagaggtgcgtattcataagtaaatgttggcattctgtcatccattttttccagatgttcttcccaagtagtgtgttatgttttgtgtttttaatatttctcatacacgtttttaaaaatctgggcacataaatcctaataaaactctcaactatctcctctgtg

SEQ ID NO: 212212 - DNA, 352 bp, Homo sapiens
gtgatccgccggcctcggcctcccagagtgctgggattacaggcgtgagccaccgcgcccggcccattgctgacatttctaaacagcgaaacaaatgcagaacaaccacctcagactggttaccgtgtgagagggttcagtgtcttttgtgcttaagccactgttgacatggggttgttacttgtagccaaatgcacacgccaagacctttgtggtctccatcggtgtcgacttgtcagtgagggggtgcactcactgagtccccagcctgacggttccacctatgcctcctggatcagcctccttttttttttttttttttttgcccagggaaaacccaatttttttaaat

SEQ ID NO: 212213 - DNA, 675 bp, Homo sapiens
ttgactaccaacaggtggggcatggggtagacagaaacatggaaaagtgtggactggaggcaggagacccatgcctgttcctggcctgcctctgattcaattgctgtgtgacattaggcaggttccctacgctctctgtgtcatttttgccatctaaaaacctggtggctcacacctgtaatcctagcactttgggaggctgaagtgggaggaccacttgagctcaggagttcaagaccagcctgggcaacatagcaagaccctgtctctactaaaaataaaaaaaattaaccaggtgtggtggtgcatgcctgtagttccagctacttgggacgctaaggtgggaagactgcttgagcccaggaggtggagactacaatgagctatgtttgccccactgtactccagcctgggtgacagtgtgtgaccctgtctttcttttttttttttttaagaaatcaagtgtcttctttatttaattcttttaaaatttttattagaatcatttaatagaaaaagcataaaataaattaggtcataattccctcctgatgcccagataacaattttgaaattaaataagcaaataaataaatgtctcactcatcattagaaaatttatatgacaaaccttcccaaagaaaatcactattcaggttttctataacctttcag

SEQ ID NO: 212214 - DNA, 1651 bp, Homo sapiens
  misc_feature (1102)..(1102): n is a, c, g, or t
  misc_feature (1651)..(1651): n is a, c, g, or t
ctgtcagcacggggcctggcatgtaattggtctgcacccactggtgcactgaactgccataacctcaggttttctttcttgctgatacccctgggtcatgttctttggcaaataacatgattcattatgaagtagagttcagcaaaggacaaggatgaaagttgtcatttagagaactgccattcagactttcttgtctaggtaaagagcaaggtcttctctcttttcaactcattttctaaatttaaactgacgatgagaatatggatgatgtgtagcttccttctcccccactgatttttggttcaggctctgggtttttggcaagaacttacagatctcacttattattggccacccttctgctttaagacctgtcagggcttgtctgaaataaaactggaagcacttctgattccatcctcactgctttcctccttcaccgtcagacagcattactgtatagcactgagtgaggggccctgacactggaaggtggcaggtggggcctggccgccagtgaggtatcatcatttgtgtgtgctcatgtgtgcgttgggcttgttgtatctgaggcatgaacattccatatacacggcttaaagagttttcttcccataccgaaagcatatattcggagaggacccaacttattcagcatagccttgttcccatagtagccatcctattcccccacagcctctactttaggaaagctccccgtccccatatgaaatccaaaccaaaaaagatatatcactttcagctcaattattccataattacaagatattaggctagtgggctctttattggttgggtcttatattaatgttatatgctagccttgtaattttgagctcctctatggatgttaattttagtgaaactctatattgaagaaaagatgggactaagggggagacaggaggaggaaagaaagcagagacaggcaaagaatcatagcctgaaattcaacagcaagcatggcttatgaagatcaagttatatttttgcttcatgaatcattgtcagacaaattaagaacatattgtttcttatttatctattgtcaaggattcactatcagacactaagaatnaatcttgattttcataagctctgttgacaccatggagccacagagcataaaacttgcatctaataaagaaagtgcaacatggaacagcagggagtggaataccagcacaactcacagctgcttcctgttcctcgtccctgttttcaggaatgtttcttagcaggaagttttttaatagaccgagaatttgttatatgtattctaagaaaagttgtagttgtagatgcattactctcccaaatcttagagatcagggatgattatgttccatttttgtttggtgagttcccatctttgtatgtacctccttgctcccggctgtcctcctctcctcttccctagtgagtggttaatgagtgttaatgcctaaaccatacttgttttatggacacttctataatggattcgttgcataattttcatgcagtgtatagtgttactagttggaaattcttggaggactcttagctgtctgatgaaattcctagtagaaatttttgttttgaattcctaaagttgaaatatgaaaattatattttaatttgattn

SEQ ID NO: 212215 - DNA, 637 bp, Homo sapiens
cctggccagtgctttcatttttattagtccatttggttgtcataaactcttaaagggagacactatcatccccattttataaaagggaaaatttaggctcagagaggcctagtggcttgcccaaggtcacactgctgtgaagcagaaaggccaggccgagagtgaaggtattctgactttgagtgcaggcctcttcacatgtggcttgcccacctcaggcacccaggaccatacttttgtcataaataatcacaaacatttcagttgatggatagaacttcggtggaagataaatttcctagggggtggagttaagttggtaaagaaatgagatggccagtaggaaacctcagtccatgaaaagatttttgtttatcaaatgcatccatgagtttcccaccaaacataggttgacctgaaggtcaggtaaaaagaggagggaaagagaatactatacgcggtatattatattaatattattccacttgcttttaagcccacttttaaaaaatcagatttattgaggcataatttacataaaataaaattcatccactataagtgaacagttggatgggtttggcaaatatgttcaatggggaaaacgtcatcacagttataataagacttctgtccc

SEQ ID NO: 212216 - DNA, 252 bp, Homo sapiens
acttggcaaacaaaacctttgtttttagtcttcaagccatttagaccaaagactcaaacaaatctattctagtgtatcatttttaccccaagttcactatctcctatcctaatatcaagattagtgccatcaaaatacctaacaaaatcaatacctttgccatccacatttaggttccaatgtcttaactgaaaagcacaaaattaggatacatgatgtatgaaggcctattttgctaaaataagccgagtg

SEQ ID NO: 212217 - DNA, 396 bp, Homo sapiens
tacatttgttgaatgactttgtgaattctggtggaaggaatttgcaagaaacagagttgcaaaagaaaccattataacgatataggcagcagcagtgggaatagggagcttgtttaaagcatatttggaatgtaccaacctaggccgggcgcggtggctcatgcctgtaatccagcactttgagaggccaaggtgggcagatcacgaggtcaggagatcgagaccttcctggctaacacggagaaaccccgtctctactaaaaatacaaaatatcatccaggtgtggtggcacgtgcctgtagtcccagctactcgggaggcttaggcaggagaatctcttgaacccgggagaaggaagtttcagtgagccaagattgcgccactgcaccctagcc

SEQ ID NO: 212218 - DNA, 468 bp, Homo sapiens
taaccgccacacccttcaaaacaagaccatcatcctggatttggccgcttgcaggccagcaactgggctacagttcaacaactgtgcactgagtgccaaccctgggccaggccctgaatccggcccaacaaatgagacccagtcccaagcctcaaggaaccaattgtccataaaacagcaaataaccacaaggtcgtgtggtgtgtacaatgatgagacagagaaggtacaaagagacaaggcacagttcacaatacactgatttgtacttctttgtgtcaattattttcctaggacttccctccctcacatggctacaaaataaacagaaggccagtcaggggaagtaaactgtcacctggtggctaagagctctccacaggccagctccttcaaaactctgactggtccaggcacctccttcatacaatgagcttcaccagttccaccacccaatggtgtgttcca

SEQ ID NO: 212219 - DNA, 158 bp, Homo sapiens
tgtgcatttagagacgagcatggcttctccaacgatccttctttgctcttatctaaataacttcatctatttaactgttcattatagggttttggttcccctcttagccttgtgtacatgtgatacaaacaactgaatgcaacatttcctgcctgagg

SEQ ID NO: 212220 - DNA, 297 bp, Homo sapiens
aagccttaattaatacaatgtaaaatataaccagcctggcttggtggttcatgcctgcaatctttgggaggctgaggtgggaggattgcttgagctggggagtttgagaccagcctgggcaacatggtgaaacctcgtctctacaaaaaatacaaaaattagctgggcacagtggcacatgcctgaagtctcagctactcgggaggctgaagtgggaggatcacccaggaggcagacattgtagtgagctgtgatcatgccactgcactccagcctgggggacagagcgagacactg

SEQ ID NO: 212221 - DNA, 613 bp, Homo sapiens
atatcttctcctgtgtttgttagctgctgtggagcaccactattcaactggaaaacttggaaatcagctcatctaaggaccagcacactttttgcgaagagacagatagtaaatagtttagattttataggccatttagtttcagttataactactgaactctgctgttgaggcaggaaaacagtcatagacaatatgtaaatgaatgaatgtggttgtgttccattaacactttattagcaaaaacaagcaataaaccagatttgtcccacgagcatagtttgttgactcctgttctactctgattgtttctgtattcttgtttcataccttagctttctcatcctgattactgtattagtcttctattagtgtctgatttccatttaatactcatactgcttccacagtgatcttaatataaggcatatctagtcatgtccgtttgctacttaaaattcttcaacaactttgctctttataaatctcaaactgtaaccccatttgctttttgccatcttgctacatccccaaatgacacttatggctgtcccttgtttccctgaacataacaggtttgttcagcctctgtggtttgcatttaatgttaaat

SEQ ID NO: 212222 - DNA, 458 bp, Homo sapiens
  misc_feature (444)..(444): n is a, c, g, or t
cacacacacacacccaaaacagccaaccagtatggaactggctaaataaatgacacttcatccatatgacacaatgctgcgctgccattacaaagaatgatacatacctacattaatgatagagcagaatggcacacacacacagacatgcccacacacacatatacacacatactgtacttttactacttgtttaatttctgtctttttgtccgtcactaaacctccccccaccctgcaaaattttattataaaaatgttcaaacatccagacaagttgaaaagacaacatatttaacacccatatacctgcctcttagatgttgccaaatagcaagatgccctccccccgacctggcactttcaaaaaacagcccttctccataggcactgccaagaagcaagctggcctctgctctacccttttcaaccccaaggtgaggngatgactgaagaca

SEQ ID NO: 212223 - DNA, 153 bp, Homo sapiens
aacagcagccacaaagggccattgcagggaaaggaaggacatcagtgtgctatggcatgagagagcttggggacgtaacacaggatgaagctggaaaggaatagaagggtaagatcagtcgggcgcggtggctcacacctgtaatctgagcac

SEQ ID NO: 212224 - DNA, 478 bp, Homo sapiens
gaagacttcaacggggtcatgctaatgtgtggtagagatttctcttattttattgaataattgaattccaaagaacaaatttcaatatactaccattagcttctattatatagttagagatttaatgtcacagaaatattcccaaatacgcctaggttttatgaccatcaaccccatggtatgatggacattatagtccattagtaagattatgcctgtaactacatagcagtaacgtgtgtgttctttaaaaaatcttactttgactcctccccaaaacagcactttggtcaaggacttgagggcaggaagtttatttgggagctgatcctaggatgcagaaatgaggagcatagacaatgagatagggaaggaagatgtattagaagaacgcaggaatgagtttcttaccactgtgtattgagtggggggctcacccctgttagggacactctaagaaacgattgtagtatgtgcc

SEQ ID NO: 212225 - DNA, 479 bp, Homo sapiens
agacgttcagctcgtacccctcctcagcagacgcagctccccagcacaatcctgctcgaccgaattcaccttcctgaccaggcacgtcaacaatctttctgtccctctgatgccagaacgttatgtttctgagggtgaaacttgagtgattaattgacagtattcctcaggaatccttgctgattgctgaatgcataaatgagtgaaagacctggataatccccaacaggcgcctgagtctcacatccgccctgggtgattccccatggccaggggcccacctcggttcccagggatccatgggcatgatcattgtgatgagccactactctccaatctggcctctgcacctgtgtgacattttcctcccattgctttacatgttactctttcttattcagtaggatgtgcagattggtcagggtgtgtattagtttcctagagctgcgtctgctgaggaggggtaccgagctgactga

SEQ ID NO: 212226 - DNA, 939 bp, Homo sapiens
accctttcagactcgccattggcccccaccagatcaggaatctgttttcccttgttgaccttgagccactcacagagtgggaaaggtttgcctatggaacgaaaacagtcctccttccatgatttcccctttgctcccatgttcatccatgtgggctgctgtaacaaaatcccataaactgggtggtttacaaacaacaaaaatttatttctcatagttctcaaagctaaaagtccaagatcaatgcgctgggagatttggtgtctggtgagaacctgcttcttggttcagtgtcttcttaccgcgtcctcacgtggaggaaggggcgagaaagctttctggagcctcttatgtcaaggcactaatcccattcatgaggactccacactcgtgactggatcgcctcccaaagcccctacctccaaatcccatcaccttgagggttaggatttcaactatgaactttggggagacaccgacattcagactgtagcagctccccagcacaatcctgctcgaccgaattcaccttcctgaccaggcacgtcaacaatctttctgtccctctgatgccagaacgttatgtttctgagggtgaaacttgagtgattaattgacagtattcctcaggaatccttgctgattgctgaatgcataaatgagtgaaagacctggataatccccaacaggcgcctgagtctcacatccgccctgggtgattccccatggccaggggcccacctcggttcccagggatccatgggcatgatcattgtgatgagccactactctccaatctggcctctgcacctgtgtgacattttcctcccattgctttacatgttactctttcttattcagtaggatgtgcagattggtcagggtgtgtattagtttcctagagctgcgtctgctgaggaggggtaccgagctgactga

SEQ ID NO: 212227 - DNA, 292 bp, Homo sapiens
ggatgtgcagattggtcagggtgtgtattagtttcctagagctgctataacaaagtaccacaaactaggttgcccaaaacaacagaaatgtattctctcatagttgtggaagccagaagtctgaaatcaaagagttgtgagggctgtgttctccctgcagatgcccagaaaaatcctccctttctctctcccggcctctgctggaggctggccatccttggcgctctttggcttgtcattgcatcatccaagtctctgcctccatcctcctgtgtcctctcctgtgtgtttg

SEQ ID NO: 212228 - DNA, 463 bp, Homo sapiens
ttacctgttttttgtaattaattttagtgggacactgctacaccccttcagtctgcatattgttcatggctacttttgtgctgtaactgcagggctgagttattgcaacaaggatcttatggctcacaaagccttaaataatactatctggccctttacagaaaagttcacagacccctgctctaggactaaaacacaacattcttcttgcttttgaattacattttatcagttaaatactcaaacttacaaactggtaaaatgtggaaagataaaggattacatcaggctaagcatttatattttgaattccaaacactaccacatcaactataattttattttttgtatgtatgcatttagttttattatagcaaagcaacttgcacatttttaaatatttaaaactaagcgtcatcttttctttctagggaaacaacaagaaaatttaaaaacaagcagg

SEQ ID NO: 212229 - DNA, 429 bp, Homo sapiens
aaaagtattccaataaataatggctaaaattttctcaaatttggcaaaatacataagcctatagattcaaagagctgagagaaccccaaataagataaacacaaagaaatccacaccaagacatgtcatagtcaaacttctgtaaattaatgacaaagaaagaaaatcttgaaagctgcaagagataaatgccaccttacttatagggaaaaaaaagtaatttgaatgacagcagatttcccatcagaaactgtagtggtaagaagaaagtggtataacatttttcaagtgttaaaaaaaaaaatccagccaggcacagtggctcacacctgtaaccccagcactttgggaggccgaggtgcgtgcatcacctgaggtcaggagtttgacactagcctggctaacatggtgaaattctgtctctactaa

SEQ ID NO: 212230 - DNA, 558 bp, Homo sapiens
tgctcccagcaggtccacttacgggtatctctgctgtagacaatcttatctaaggacacaaacatatacacacaaggtacaaaattgaaagctgctgggattgtggttgtgagccaccacgcctggccgtatattttaaaaatctcttaaggtccagttactgttatattttggtcctgtactgaaggaggatgtaagtcattttcctaaaatgatttttatagagatagatgttggcagtttactcaaaagagaatataggaaaatcttttttaacaggtttggtgggactagccttattcactgaataaagtactttacagaatggagtatatctatatgtgtgttttaagatttgttcatacaaagcagatgttctgtgtactttgtatttgtaaacaactaattgggggtgggaaggagattgctttgtaaaaagagggtttccttgttctaaagctttgctgctggagatggtaagatggtaaataaatattgtactgttatgctgcgtttatctcttctgctttatctgtatttgcatataaaattcttgag

SEQ ID NO: 212231 - DNA, 623 bp, Homo sapiens
atggaacttcttagaggagcaccagataatactctagtcccagagatacttttttttttttaacctcaaggtataacagcaattatatttatttttataaacaatatcagtcacctagccagtagaatgaacccctctttgtctgactgttggttcagtgaaatgggaaatgcaagtggctggtagcaatctcgacttccagttcagtggaaccatgattgtgtctcttggtaaaagtacctccttaggaactaagacctgtaaatcagaagtgccaaaagttgtagaatgagaagcaaaaattctgcaagtggactattagatataattgtaagaggagctactttcatttccattaattcctaggaccttaggttgtggttatgagacagtatcagttttggtttatgtgatatcctatgctgttaagttagggtcccaacttccctaactatatctaattggtatagtagataaatcatcaaagactatttcactagaggattctgggaagatgatggagtaggaagcaccaagaatctgctcctcatctagacaacaatttcattgccagaatcagtctgatgtaacaattttgaaactgtggaccaaataatcttcac

SEQ ID NO: 212232 - DNA, 303 bp, Homo sapiens
ttcatatttctataatgatgaggatgtaaacatgtttctgcagtttgggtttacatggaatcagcaaataaatcaccttaagtaatacttctacctgcgatggtgtctttgaaaataaaattaacgtgctttggtttgacagaaaggtgcttcatgcttagcaggtaatttttcaggtggtattaagaggaattttattggtaggagaggatgtggttgtactctgacaagctggtcagaattgttcatatttgatgcattgatatcaatgtgaactcttttgatctacatttatttagacat

SEQ ID NO: 212233 - DNA, 663 bp, Homo sapiens
aaaaaagattttaaggaaggaaatgacttttattagggtttggttttatcaatttcataatccgattaatcccaccatttttaaaagatgaaattgctttcattagaaggctacataaaatataatttgattattttaggctctattattagactcacatttctttctacagtctcattattatttccaaaaattacacagtaacctaaatcatctaaaaacacataaagctactgtattctttattagatccatccccagagttatatgtacatgtacatactttgagatgtgttttgttcttaattgtattttaggttatttttgactgacttaaattctatcactattttaatatttgttaggtccgaataaaccatttagaatatttttcagtgtacaaaatgtgctgtaatttaataaggccccttgcttttaaaatttggcttaacctggtgaggccaccggcttgaagttccgaggacactccccttggtcccctgttggacccgtgggttttactccaaggaccccatgttaaccttcttaacacgagaggctttaagcctcaactggttctttggttggaccaaaatttcttggaaatgggggcccaagacaaaagggttttttatcaccgtgggtcccctgtgggcccctctt

SEQ ID NO: 212234 - DNA, 319 bp, Homo sapiens
gtctgcgattcctgtcacctttgttctcaggttttctcctctcttgtcacctccatttcttttttttccctggggctgttacttaaacttttttatcttcctaccaagtttaatcagattttcccttttgtcataaagccgtcttagaatgactccaggcagtaagaagtgagtcagaaatttatgtccagactgtgagattgttatgctcttggattcccctgccaccgcacccagcctacaaagaacatgtagagaacatttctgcaagaaggaaatctgcttacctttggttatccaactgcttctcaaacttaat

SEQ ID NO: 212235 - DNA, 223 bp, Homo sapiens
ccggtgagcgtcggcaccgggctggggccgtgctgattcccggcagcgtgtgggaatgtgcgggtgcctcgtggcctgctgacatcgcacacaggtcacagcctgtccagttcaggacatcagggccaagagtgaagtgagaatacggaggcacctctgtgtgctcaccctgctgaccgtcacccagcctccggggggggtcacagctggcccccaggaagct

SEQ ID NO: 212236 - DNA, 602 bp, Homo sapiens
ttagtagagacaagatcacactgtgttgcacaggccggtctcaaactaggatcctctttttatccctaggtgaaattttgtattgatgtgctttcgccgctatctttttaaatggaatgttctttgtactcaatgggcctgctaagtatgtggactcatgatttgtaattctgggaagtgttctttattagctctttgaaaatgtcctgtattcatttttcttcatactttctttggaacttctttagtagatgctgatccttccagattcttccactaacccactaaatgttccaaccattacactctttctttctgccttcctcctacttcaacctcccaagtaactaagactacaggtgtatgctactgcacctacctaatttttaaaatttttgtagagataaagccttgctgtgctgcttaggctgatctcaaactcctggcctcaagcagtcctcctgccttggcctcccaaagtgctgagattacaggaaggagccactatccctagtcctcctaatactttttgtccactgatatcttcttaaccgtttagttcttatgtgtccttcttcacccttttactgtcattttaatgg

SEQ ID NO: 212237 - DNA, 137 bp, Homo sapiens
ggaattcataaataaaattcagtatacacataaaatggaaatttatgcaggtatctgagaaataaaccaaatctacatactgcaatgaaaatgaaactcaaataattcttaccttcaaaataagtaacaaagcaaga

SEQ ID NO: 212238 - DNA, 1058 bp, Homo sapiens
ttcttttaaaatcaaagcagatttttttttatttcactgattaccacattattaacaatactatggggaaggaaaaaaaactctaggaaaatctgatccatcaggagccactgacatttcagctcacggcaaacctatacaatcagcttacaagaccattcatcctctaaaaggattatcatgttgagagatgcataggccttattttatcgcctgtcatagtaatatgagtatgaagccatttggagaaataggtggacatttgtgagccatcatatcatttttatctgatcttgacagctcaatttcaccacctgtctcatgctagacagatttcagagctgacatcacagaaaatgtgctgaaatgtaaaatgtaatccataaaaggccaatggtgatgatggtatgcagaaaaacatatttgcataatggagcaaaggtcatcctgggctaccgatatgaggcttccattctcaggcagatgggcagcactgtgatttgttcaggactccagttgctagtgcagtttcaagggacaagtaaggaaggaagaacaattttctgtataaactcatcacagagaattttaacatctctctagcctgaaggctggctctcttttgcatacctttatattcaaccttgcattttatatgcacatgaatacaatacctgggctgcaaagcacaaaggaacagctactaactattttccatagtctgcactggctgcctattcgtttctgacaataatttatattactaaatttaatctaaaagtctaaaaagatgtgaactttcactgcctcaaggatccccttaatcccttcttaaccaactagtacccattgctaacatttcctttagtttgtttttcttcattttatatatacatatatatttaattataggagtgaaacatgcttattacaacagcctaaaaatacaaatgagtaaagataaataatctcaccatcacatcctcctcagataaccaatttggtattattcttccatatgcattttttaacgaaattgtatacaaatacatgcaaat

SEQ ID NO: 212239 - DNA, 785 bp, Homo sapiens
atgagtgtactgcagacattgcttagatccagctgggcgcaaagccaggccagctcagacttttcaattacacgaacgaaccgccttttgttttacacttatgtcaatttgaattggatttccatcttgtaaccaaaagtctgactaatataatcaaataccaacttaagtattggtatctacgagttataggtgttttcatttccttggccaagaaactttgagctctgaaatatcacggaacggcgggttaggccagggcacttagggcaaagttttagctggactatagagaaggatgaagtggcctctctcacttctttcttcatctctttggtttagcttagccacactgagtccactcctaatagtggaggaagaggcaaaggaagcctcttatgctattgaatggggcctggttggaacttgcccctgaatctgtagatggaccaaatgcctacaacaggggttttcatatctagtccatgagggcaaagtgaatttcatacgagtggcacaatgggggcagttgtagctcctgtgaactgatggagctaccgctttggatcctgcatcttaaatgctgatgctgcctcagggttctgtcttcagcccagcagtcttctatctctgagctgtccctgagtgagttcagtcaccccataggttcacctgtcacctccatcagctgtctgtgcatcttttttcttcgcctgcagacctgaaggatgcggcacattcccattggtcatggtgatacctgcctatgctgatttttcatagga

SEQ ID NO: 212240 - DNA, 508 bp, Homo sapiens
aatcattggcatggaattcctataagtggaaatagtgaaaaccaacacaaatactatataaaaagtaggatttctcagaatgtatttgtaattaaatttcagtactgatatgaagatacataaatatatgtacatactctacatatactatatattatatgatattacaaaatacaggtcattatgcttagaatgcaatgactcattttattaggttgagccaataacaaatatattatgtttagaaaaatatgttagttcaacctatactattgatgacttttcaaaaattctactgcagtacaaacatggcttatgccctaaaaataatctataggttttgatttagaagtagaattccttccaacatttaaatgttgggtattaaaaatactatcctgggaggctgaggcaggagaatgacatgaacccgggaggcagagcttgcagtgagcggagatcgcgccgctgcactccagcctgggtgacacagcgagactccatctca

SEQ ID NO: 212241 - DNA, 470 bp, Homo sapiens
gctgctgtcactggagctgtgtgtcacactgggcagatgcaagtcttcctgccacgccttgaggctcagccacacaggagaaatcacagcgctagctgtggcctgctggctacccccagagatgcagctgtgctctatgaatgcagcccccaaccagaggaaagcaccctgaagacctgggtgctttacgcaataaaaaagacaaaccttctgatggcagaatatgttttttaaaagactaatgaattctcatgttttatttggttcaacactaaaactggtgttgctgtgttttgttttttgtttttttttgtcacaaagaaaaatatcctagtttgtgtgatattttcccctcgaagtgtcattgcatacccattggatttttctttaaatttcagggagcccaaattaaattttacataccctctgggtctagtatgaaaaagtagatttgatttaacttgatgaaa

SEQ ID NO: 212242 - DNA, 397 bp, Homo sapiens
acatagctatggcactttcactatacatgtaaacacccttacacacatacaaatgtacatgcgcgtgtgcgcacacacatatggaattagctttttctctttgtgggaggagggaaatgaaaagacccaaaacattcagattcccaaatggacacgtaagaaccccgtcatggaaataggtctgggtttttttctcttttgagggaagcagggcgtttctggttactgtcgccattgccattgtgcccctgcttaccatccccctgcaccgcccccccggcccccgcccgccactgctagggtttacaggtcatccctggattaaataagtgatattgtgtttttttttctttgacacaaagtaaaattataattaatattgaataaagtaaaaatg

SEQ ID NO: 212243 - DNA, 513 bp, Homo sapiens
tcagcgtccagccaaccaactgcagtgatgaactaacagtccacccagggctggccggggccgcttggaggaccagatctctcccgctgaagggcgaggggaggagggagacagctggatgtttgcttcatctccgtctgccagagacccctttcctttcttggcctgcctaatttctaccatcttgaaaaactccgcggaggggccacctgctgcgtgacgccttcctcaatacctgcctccctccagggccggctcccgctggggacaccggcacgacagagacaggctgcagcttagcaaacatgagctgatggaaaagaaaattacttgtttgtgacttccttggtctcacttctccctgagccccaaatcctctgcaccacccatgctgtctttcaaagaacagctcctctttttctgcatctgttgaaatcaagaaacagaaataaagaacagcttcctcggcccacttagggagcatggggaggggagcagtgtgctgctgcgtga

SEQ ID NO: 212244 - DNA, 375 bp, Homo sapiens
cttccccctttcaaaacttgcaattaaccctggtgattcagagcaaactgcgtagagtatgcaagatacagggaaacactgaatcctggggctgacagtttacatcctggctgtttaccaagtccatcttgaaaatcttactgtgattcatgaatataaatattcagtatctttcactgtatctatgcccactattgagcaggtctatattttcagtcctgtttatatgctatttacaatgatcgtcaaacacacttaagcaattcctttttattcctcatgcaatgggaagtaagcaaacattccatgaggttcattttatgaagcaataaaagaaagttagtcatcaaataaaataaaatggtaaaatcaaga

SEQ ID NO: 212245 - DNA, 101 bp, Homo sapiens
aatatcattgtatttaaaaaatactattcaatgtatttaatatattgctggcaattctagccaatgcaagaaggcaaggaaatgaaataaaaggcacacag

SEQ ID NO: 212246 - DNA, 782 bp, Homo sapiens
ggctgtgttttataaaataagaatggtttataataaaataaaaacagtgtagctcacagcagctttttgtcattcaaaatgtatagaaaaaaagacaccaacttatacaaaacttcatttgggttcttttaaagttttgttgttgctgttgttgttaaatggtaggccttttgagatagatttattggaaagtcatatgggtgtagttcttgggacagatgatttctccattcagcatttagagttataacttctgcactctagtgattcttgaagtagtttggaatatggaaatgtgaatagttttacctccatcactctggatattatcccatgttctaaaatcattacataaaaatataaactcactattgtccttgtaggcttatcatgtacttatgggctcatcaatgccaatgtccattgagggaactgagaagagggggcatatacaggtaatgatgtcttctcataaaaagaaaaaaaaaaggaaatgttttggcttttctttagtaacatataatttgtaatgttctttgcctcattcacaatcctgtccgtgtataaacagtaatttgctcttgtaaacacatactgtagttagagttctattgggagcaattggtgttctttatctgtgacatcatgagcatttaaaaaacaataattataaatatcctccagggtgaaaaaatagtaaaaagaatcagaggatctgtctagagactttagtggttgtttcttactgtcctgtctttgagtatcctccctctaccccatct

SEQ ID NO: 212247 - DNA, 343 bp, Homo sapiens
gtaactgcattggtatctctgatcccataatttatgtcagcaaaaaatattcttctgtaaagcagcaattttgtgatcagactggcaatatgaaaacagcaatttgatcaactagaaaggattgaagaaatataaatctagaaggatatttggcaaaaatattataaagacatgataatacttctaattttttattttcttgatggttaaagctaaaacatatattttagtgacagtgaagcattgcatatgtagaaacttgttctgtaaaattttaattatcaactgtgtgcaaaagtagacatttacataccgaaataaaaaagctttatagcagtaaaca

SEQ ID NO: 212248 - DNA, 450 bp, Homo sapiens
caatagcatgcattttgctaatgggtattggcctaagaagccactcccaatttcatctcttggtcccttttcatgtattctggctaggggagaaataatatcatatatcaatcacagttaaaagtttatacatcatcttgtaagacaacacttcaaacctatgaagtgttgtcacctggccagcatcatagctaagtcttccgtaggtaatttcgctgtttttttttttcagattggtttttctgcatgataggatatacggtagaaccaatgagtcatatgattatatgagccattgtttcacttttcttgctataaagtgattttcttggtcagaagcaatatttttttttattactacaagtctagatccgagttatatatcatgacgagaaataaggaatttggtaagtccacaaatggtggtcctggcaaaagcgttatggacag

SEQ ID NO: 212249 - DNA, 244 bp, Homo sapiens
taataattctttttattgtttttttaatggagtgttgatttccttacataaatttaattgtaaacatgtacataggaccgtgattttgaattaaaaaaatactttgggccttcggccttcttagtagtttttttttttttgttttgttttcgtttttgttttgatacggcgtcttgctctgtcgcccagaaaataaacaaataaaagtcttcctcagcgacaaaagcaaacgcaagcccgagct

SEQ ID NO: 212250 - DNA, 170 bp, Homo sapiens
agaaacacatatgaaaaagcttgtatcaaacacatatgcttggagggtctgaagacatcttttaaacacaaacaattcattaaatggaaatgcaaagcatgcctacatcctactactatataatgaaaatcgatgtgttatcaccaaccaacatttaacgtatcaaatcc

SEQ ID NO: 212251 - DNA, 465 bp, Homo sapiens
agggaaagatgtcacctttgataatttcagatttagatattagttcatttgaaacagaagagaatttcattctttcatgctctgtacctcaaatgggttaagcattagtgaaaattgtggtaagacctcaaactgcaaatgactattcaagagcttttggataaggaggcaggaagaagctctttatctttcaactgtatggagcttgttaacaagcctctgaggtgacctaggaggattgagtttgggggtatacatttcacacattcttttgcaagttttaggttctgcaaccaagggccagaaatcttttctttcttccagatgctagtgttaggagttaaatggaaacaagaaggacatggggcaaatgtttttactgtcaatgtatattgcaaggtgaattcaaatgcatccttttattctacttcagaaaataaatttgatatttttcaaaactgtgta

SEQ ID NO: 212252 - DNA, 406 bp, Homo sapiens
ctgcctaaatccattcagtaatttttaaaaaatatattatctaaatggccacatcttatcaggaatgaatagaaaaggaatggtttgagacacttcatctcttcggctcacttcaaactatgttttcctccactgtttgtccttcagcttttctgtccttccagtgtttttctaaagtaactcactccctctggctgaagggcatttttatatattgttccttctacctagaacagtttctcccctactattagtcatttgaagtgcatttaaattgtgatttcttcaaagaagacttaccctctaaaactagatcaatttaatttacatttgtgtgcattattctttgataaatatacatctccctgactcgacacaaaactccaagaggataaggaccaagtct

SEQ ID NO: 212253 - DNA, 553 bp, Homo sapiens
ccgtggggatcccggggcagccgagggcccctgactcggctcctcgcggcgacatggatcggatggccagctccatgaagcaggtgcccaacccactgcccatgtgctgtaggccagcggggtcggcgctgggctggaggcggcggagcgcgagagcttcgagcggactcagggtcgctgttggtctagccttgcctcccgcatacccagtctagagcctggccacatgcccatcaaaagactctcactgctctgcctgccttcttctgtcctggcgtctataccctcagaccagccttgcatacctactcctgccagcctcctccaggaagccttgcctcctcaactctcctgcaccatcctcacatttcacgctggcctacagcacatgccgctgtgcggaccatcctcaactctatggaagtcacaacagaggacacaagcaggacagatgcctatgagagtattcggggaaaaatatatcacacgagatgagactacgataaacgacgggatgtatgcggatctcagaaatgtgaggtggagcgcaggc

SEQ ID NO: 212254 - DNA, 674 bp, Homo sapiens
ccgtggggatcccggggcagccgagggcccctgactcggctcctcgcggcgacatggatcggatggccagctccatgaagcaggtgcccaacccactgcccatgtgctgtaggccagcggggtcggcgctgggctggaggcggcggagcgcgagagcttcgagcggactcagggtcgctgttggtctagccttgcctcccgcatacccagtctagagcctggccacatgcccatcaaaagactctcactgctctgcctgccttcttctgtcctggcgtctataccctcagaccagccttgcatacctactcctgccagcctcctccaggaagccttgcctcctcaactctcctgcaccatcctcacatttcacgctggcctacagcacatgccggcatgtgctgtaggccagcggcatgggcggctgccctgggctcgcctcttccagcccagcatccagctggcccgccagggcttccccgtggtcaagggcttggcggcagccctggaaaacaagcagaccgtcatcgagcagcagcctgtcttgtgtgaggtgttctgccgggatagaaaggtgcttcgggagggggatagactgacctgccgcagctggctgacacctatcgaacgcatggcctacagcacatgcccgggtaaccgaaatcgattgcgta

SEQ ID NO: 212255 - DNA, 528 bp, Homo sapiens
ccgtggggatcccggggcagccgagggcccctgactcggctcctcgcggcgacatggatcggatggccagctccatgaagcaggtgcccaacccactgcccatgtgctgtaggccagcggggtcggcgctgggctggaggcggcggagcgcgagagcttcgagcggactcagggtcgctgttggtctagccttgcctcccgcatacccagtctagagcctggccacatgcccatcaaaagactctcactgctctgcctgccttcttctgtcctggcgtctataccctcagaccagccttgcatacctactcctgccagcctcctccaggaagccttgcctcctcaactctcctgcaccatcctcacatttcacgctggccactgtcactgccagaggaggcaccactgacctgcctcatggcccagccactgcacccatctccaaccagacccttggtgtgttccccacccaatccatcacaagccactttcaagctttagggaagtgaaaagtactgcctgccctca

SEQ ID NO: 212256 - DNA, 929 bp, Homo sapiens
ccgtggggatcccggggcagccgagggcccctgactcggctcctcgcggcgacatggatcggatggccagctccatgaagcaggtgcccaacccactgcccatgtgctgtaggccagcggggtcggcgctgggctggaggcggcggagcgcgagagcttcgagcggactcagcagctgcagaggagatactcggaggaggaggaaagagaagtcacggagccctgttcttaaccgagttttgcagtcacctccccgtattcctctctcactctgaagccgagcacagaacccagcctctggtggtaccgagtgaaggttggcctggttggttggatggatggccaaatgaactccagaccactggattgtataacaggacagcaagaggcagcacagagccgtggaaagaacctgtagccataacatttgatgaatgaatcagacatgtgacattagttctgtttcttctttttttttgagatggacactctgtcactcagtctggagtgcagtggcgcgaactcagctcactgcaacctccgcctcccgggttcaagtgattctcctgcctcagcctcctgagtggctgggactacaggcgtgcgccaccatgcccagctaatttttgtatttttagtagagatggggtttcatcatgttgaccaggctggtcttaaactcctgacctcaggtgatccgcccgccttggcctcccacagtgctgggattacaggtgtgagcccctgcgcccggccatgttctgtttcttagaggaaaccttggcttccctgtgtgtcattagtgctctgtaagtgcccctgctgcagagcgtactgaggcatgtgacctggctgtaagtgcctttgctaaagccagaggtgcccactagttttcgagactgcagagaccttgtgtgcccagcactcaa

SEQ ID NO: 212257 - DNA, 387 bp, Homo sapiens
tttgctgtgcaggagcattttagttaaattaagtcccttttgtctatttttgttttcattgcttgtactcttcaggtcttagtcatgaatgctttgccaagccaggcgcggtggctcacgcctgtaatcccagcactttgggaggcccaggcaggcagatcacgaggtcaggagattgagaccatcctggctgacacagtgaaatcccgtctctactaaaaatacaaaaaattagcctggcgaggtagcgggcgcctgtagtcccaagtactcctgaggctgaggcaggagaatggcgtgaaccccggggggcggagcctgcagtgagcctgagccaagatcgcgccactgcactccagcctgggcgacagagcgagactccgtctc

SEQ ID NO: 212258 - DNA, 411 bp, Homo sapiens
tattcttttcctcaatctcaaagattcaactcaaatgccaccttgcccatgaagtcacctgggaatgttccaccaggagtgaatgttccttctatatccttgaagagtttttgtaacataagaaattagttgtattgcattattagtgtgcttgtttcgtctgtgttttactcatctttgtaggatacttggcacttgctgaggtagtgtgcacctttttgctaaaaaagagagtgaagatattgatactgatcaatcgagtgtccctggatacctaagaaatacaatgtggcagtacagagcctgacacactattttccatatttcaaaatattgaattaaaagttggccaggcatggtggctcatgcctgtaattccagcactttgggaggccgagacggttggatcac

SEQ ID NO: 212259 - DNA, 1137 bp, Homo sapiens
atccacaacacagggagaagaatcagataaggtgtccagtctcggagggtcctgggcagcaggcagcgcctccaagatcatcacctccaaccctgattctgccaagccccagcctggtaactacttctctcaaggggtcccagctctcagagctaggagtggccttcaacgccaggtctacaccccatgccaacagaatcccttccctgacctttgcaccagccaacccatcctccgtcatgcagccttcgacgatcggaaaccaacagcttctcatgacggtccctccgatttccagacaagcctgattcttaagccagcccagccaagctacagctcctatcccatctccccaagaacagacttcatcgttttctgaatttggtccacgcccatggtgtccgtgaggaaaaataacaacataagtaacatatagtacaatgctaattttttgagacgggatcttgctgttgcccggctggaatgcagtggtgcaatcatagctcactgcagcctcaacttcctaggcttccaagcaatcctcctgcctcagcctcccaagcagctgggaccacaggtgtgcaccaccatatctggctaatttttaataaattttgtagagatagagtctcactatgttgctcaggctggtctcgaactccagggctcaagcaatcctcccacctaagcctcccaaagtgctggaattacaggtgtgagccaccacacccagccaatactaatatttatacataatatattgaataatattagcagtgattccagcaataacagtgataaccaggaccaccacccatccaggtcacagcctcgtagtccatcccaatcttttcaatgaccctagggagtgattcctatcctgtctgacacacaaggaaacagaaaggttccatgttttcttcaaaattcacacagaaagaaagtcacatggtggctaagtaggcattctaaatccaatgcctcaccatgcctacattccagaaaactctagaaggctctgggagtttctagaaggttccagaagattccagaaccctccatgattcgccacctttcactttttacatatcctattcccccaggtcccacttcctcaaagcaggacagaattttcaa

SEQ ID NO: 212260 - DNA, 425 bp, Homo sapiens
cgggtggatcacctgaagtcaggagttcaagactagcctaagcaacatagtgaaacctcatctctactaaaaatacaaaaattagctgggcgtggtggcgggtgcctgtaatcccagctactcgggaggctgaggcaggagaatcacttgaacccaggttgcagtgaaccagaatcatgccattgcactccagtctgggtgacagatcaaaactctgtctcaaaaacaaaaacaaaaataatcctgtgactgtcaggctgtccattagagttgtcctagacatggctttcctggcattcatgcccttcttaatatctttgcagacataatgggaaacttgaacctacagtccttaataacaacatacttaatttctgcaaagctagcagaaacctcattactaaacaagtcaagctactattcca

SEQ ID NO: 212261 - DNA, 425 bp, Homo sapiens
catatttgctaatttttgacaaatgtgtttgcttatgaaacccaaagtcctttcaagatacaagacattgccatcaccccagaaagttatgtcttaccttgttagagtttacatgtaccaccattttccccactcccacccgtcattccaactctgctcttagacaatcactgttctaatttcttctgctgtgaattagttttgcctattttggaaatatacagtatgacgtcttttatggaaggcctctttcactcagcatgtttgacattcatctttaatgttgtaagaagcagtagttccttccttttttattaccgttgtataaatatactacaattgacttgtctcttttcctgttaatggactcttgaattgtatccagtttttggctattacgaataacactatctacattcttgcac

SEQ ID NO: 212262 - DNA, 490 bp, Homo sapiens
ggattcacctgtaagcaggacagtcttttggatgacagagggaattctcatatatccacaggcagatggaatttacaagtggaaagacctagaagttcagagacagggggactgaactttttgctttcagtcagaatctttgcttacggttgtgcaaatgcttgcattggtgggtttccatgccatataacgtgctacatatttttacgttacccttgcacataagcatactgttgggagggaaaatgaagagggtggaggtggtaacaaactcaagctaaggaaatggaatttggatgggtacaaagtccagagaattagcttgaggaaaatgaaccaggattcacacaggagttttcaaacatctcaatatcaggacccctttaccctcttaaaacttacttcgtgaggaccttaaagagcttttgtttgtgtgacttatatgtattaatatttactatattagaaattaaaagtaaggaatggttgt

SEQ ID NO: 212263 - DNA, 772 bp, Homo sapiens
caaaatatctagtgaccatgtcttctcagtaatccacaggaaacgcgtatgtatcatttacacatcctgtagtctccttcctacagtgatatcatcgtcagccagtcatgcctagtttgctggacacaggcattatccatcgcttttgatacatctctttcacctcaactgaatcaactgtcaagttccaaattaaatagttctttatttttttcttcttctctatttcttgtcaccactaccctgactcaaggcttataatcttttaactaatctcctactttctcattctactggtcttatatccattctttgcacttcagttaaagagaactaaatatattttaaataaacatccaaccatgccattcacttaatcaaaatgtgtggaggcctccctaataactatgcaataaaggcaagtctccttagcataaaataaatagccttccatgatccaaaccttcttaactctatctttgggtctaacactataatgatactggaagatatgttgctctttgcataaaccgtggtgttcctgactttatatcttcacccttagtgttacttaggatgccatttcattttttctttgttggtcttttatacataattaggtctggatatactcaacggtctattaacctcccggggtcctctaccttaatctatctcgaagccgtaccagtttttcagccgggtgcttcttccattattaatgtatttgactaccgatgggtaagactgcccggtccgtccacattgttgc

SEQ ID NO: 212264 - DNA, 1090 bp, Homo sapiens
acccgcgaccacaccaggctaatttttgtatttttagtagagacaaggttttgtttgccctgttggccaggctggtctcaagctcctgacctcaagtgatcctctcgccttcgccttccagagtgctggggttacaggtgtgagccaccgcgcccagccctctaatagaatataaggccactcagtgtcacctggaggggttggtaaaatgcagactacaggctctgccctgctgccctggagtttctgattctgggcgtctcggagggagtttgtgttctgagcaagtgtcctggtgtattgccgcctcgaggatgacactttgagaaccactgcgcttgagaatcaaaaaagaatcctgaatcctcattgctccccactctagtgaagcacacagtagccttgcccatttgaaaagcagagcaagctacaatcagtgcttgcagcctatggcttgtatttccaaagactgactttggaaccgctgacctaactttgggaattgaataggcctgtaattataagactcattagagcctttgcgattttagcatgtatttataaacctgttgggggcagaggatgtgtgttccatgtctttttgaccttggaaccttatttttatttttagaaatgggaatctcgctatgttgccaaggctggacttgaactcttggcctcaagcagtcctcctgcttctgcctcttaagtagctgagattacaggcttatgctactgcgtgccacttggaaccttatttcataaggagtgcatctctcaagatctagggtgcagtagtctttttggaaaaccccgaactagaacaaatgctctgaacctgataattctcaaatttgtcaggataacttttcttaactgtggtattgcctgctgctcctgacttcctgatcagatgtagacgccagcctaaaactcagggccttttttagtacccagcttcctcctctctgctcttcagctcctctgccctgggtgggctcagctccctgtgctcctccaaagctcagtgcctgttcctgggcctttgaacctacccctccccatgctcagccactgcaggattctcaga

SEQ ID NO: 212265 - DNA, 273 bp, Homo sapiens
cctcagttcaactcccaagattcccaacctcggtgtgtgagtcacattgcaattgcctacgatatgcatctgcacggattccttctgcttcagcagggaatttcaagctcctgcctgcctataatgaagaagaaaattagtgcgacaacgtgtccggatgctgaaaagctggcagccagcaaaacagtagtgcatttggctaattttcttttccaggctttttactgtaaagaaaattggcctccatggattaaaaatatttcaacatttgca

SEQ ID NO: 212266 - DNA, 529 bp, Homo sapiens
aaagagaaataacctgtgtgcacacaaaaatacgcacacgaatgtttatagcagcttattcataatcgccccaaacaggagtcagcccagatatatggtgaatagataaactggcactcccattcaatggaatgcaattcagcaataaaaaggcacaaaatgtcaatgtacaaaacaatgtgagtgactcttagatgcaccagccaaagtgaagccagaccccaaggggtgcagactgtgattccatttataggacattctggaaaaggcaacctagggggctaagaagaggtcagaggctgcaggggcgggattagggagtggctaggggcaggaggagggtgtgacgacagagggaatgtgagtggctgtgagggaacatctggggtgatagagttcttccgaatcacaccacagtctaatgcgtagttacatgactgcatctgtcacagttcagaactgtgtacacacacacacgcatgcacagattttactttatgttaaaacattatatatatattatatcaac

SEQ ID NO: 212267 - DNA, 437 bp, Homo sapiens
atttgttctctttgagcctaggtgtctttatttgtcagtctgggatgtaacgtccccacctctcagaattgttgcaaggattaaatgagagtgtagggataaaacactaggtatggtgctggaaagtacccaataaaagtagtagggaggccaggcatggtggcttatacctgcaattccagcactttgggaggccaacgcaggaggatcacttgagcccaggagtttgggaccagcctgggcaagaaggcaagactctatcactacaaaaactataaaaatgacccttgtatggtggcatgcgcctatagttccagctactcgggaggccgaggtgggaggatttcttaagcccaggagtttgaggctgcagtgagctatgattgcactgctgcacttagtctaggcaacagagtgagaccctgtctcaaaacata

SEQ ID NO: 212268 - DNA, 916 bp, Homo sapiens
ggacacctggatattttattatatgggttaaaattcattacttactatcattgttttgttgctcaaattcttctgcatttgcccattaggaactcctttgagttaactcctaggttctttaacaagttcccatatttttttgaacactttcttactggcaccacagaatactacaggaccatctatttttcctctcccagccctggaaacaaccacttcaaggaaccctggttcctttaattggaaaatggtatttagaaaccaacatttgttcatttaagtatactaattgccaatagggtgtcattgcctcttgggcctttcaggagatacagctgggaaatacatgtatgtgtattaatgaatatacatttatgtgtctgcttattaaaaactcatgagttttgtactgatacttctgattctaatttaacaccacaggattaatttctggttttccttatttgttattttttccaatatgggtaacctgcctcttgtctgcagtgtatttacttactgtttttttgttgttgtgtcagtgtaatatacatgtagtttcagaagagctaattcataccctaggagaaacacattaactacattgcactgttctgcaattctttttgggttttgcctcatatatcagtcaagaaacagtttttcaaagttactgacgttcttttctttcccaccctctctgatctgtggactgatttgtactcttggtccattttttactgtttgagcgttctctccacagcctggttgattttaatggtttattttttcagtatgtgaaacgtggttttcagagtgtgagctttgtaaaaggatatacatggagaagtgttgttcgtacctcattcctaccaccccattcccgttcccagctgctttctctcactttcccacc

SEQ ID NO: 212269 - DNA, 413 bp, Homo sapiens
ggacacctggatattttattatatgggttaaaattcattacttactatcattgttttgttgctcaaattcttctgcatttgcccattaggaactcctttgagttaactcctaggttctttaacaagttcccatatttttttgaacactttcttactggcaccacagaatactacaggaccatctatttttcctctcccagccctggaaacaaccacttcaaggaaccctggttcctttaattggaaaatggtatttagaaaccaacatttgttcatttaagtatactaattgccaatagggtgtcattgcctcttgggcctttcaggagatacagctgggaaatacatgtatgtgtattaatgaatatacatttatgtgtctgcttattaaaaactcatgagttttgtactga

SEQ ID NO: 212270 - DNA, 558 bp, Homo sapiens
tggtgcttcctgccctgcacctctgatctctgcggggttgacggtcttgtcctccgagtccccttagacccggtgtccttagacccggtgttctatctgctgccagggcactttggactccttatgtcccaggaccagcaggtaagaagggaagtcaccgtcttggcaggaggcattggccgggggcacgtgtgtgaaacccaggcgtctcgcctggtgccccgtgcccccttgtactggccacagggcttgagccatgccccaggggagccattgagacttgcccgggtgatagctgctgcgggtggggggattcggaatggagggagggacgtgcatcagttgtggccccgagacccctggcagggaggagaggccggtgagagcctcgaagtggctctggccaatgcccaggggagcgagtgagacagcggggagtgcggtacgcagggagtggaatgatgggcagctcccagctcctccacctcagtgggcctggccgcgtgctcccagctccgttcctgggacacacgggaccccttgcagtgctgagctgag

SEQ ID NO: 212271 - DNA, 408 bp, Homo sapiens
tccatgtgggcattccatgtccatggatgaatggataagtaactgatccacaagaggaggcaggacctattctatcaaggatcggtaattgggaataagcttctcatttcatcctaaaggattctgtcactccactgaaatcttaagagtctccagtgcttgttaggaaagtgtggaagatgaaccccttcttcatccacagatgctgagaatgctaattagaagacaggtatcaggaagcccacacagagacggttttgggattttgtcagcactgggcaagtggcttaaggtgagatagccattctggagtcacagccttactcctcctttaatgaagggaaaaaataaattttcctgtatcaaaacctagactggtctaaataaaaattccattaaaaaatcact

SEQ ID NO: 212272 - DNA, 386 bp, Homo sapiens
gcagagaattcgctggagacaatgcttcgttttcactgtttgaagatcgtaactggcctaatggtgtttgactaacacccttttctagtcggaggaggataaacaccccctccgtcaggtggtaaatacttgaagtgacagtaactgaggctgcagacccacttgtgttattgtaaatgaatcagaggggcaagaccttgttctttacggcgtgtgatttaaaatcagttttaaggtacctgccaggtgtatttagaggaaaaggcatgaaggaagccacaggcttatacattcatttttagtgcatatttctttttgttcattttcatcctattgagttcctttgtcatttctctgacttgcaaattatacccttctgtttaata

SEQ ID NO: 212273 - DNA, 182 bp, Homo sapiens
tgaggagatgagacagtgttccaaaataggctgggtgatggttgtacaattctgaatataggaaaaaccattgaattgtacactttcgaggggtgaattctatactgtgtagactatatctcagtaaagctgtttttaacaaaaagaaagaaaagtttttgcctctaggctgagagtgagga

SEQ ID NO: 212274 - DNA, 380 bp, Homo sapiens
ctttgggaggccaaggcgggtggatcacttgaggccaagagttcgagaccagcctggccaacctggcaaaagcctgtctctactaaaaatacaaaaattagacaggcgtggtggcgggtgcctgtatcccagctacttgggaggctgaggcaggaggattacttgagcctgggaggtcaaggccgcagtgagccatgatcctttctcaaaaaaaaaaaaaaaaaagtactgaaaattagctcatacatacatatttaagcataattactgggttttatatagtttacatgttctaaggtatctctgaaaaaaataatcttctaatgaaataatcagcaaatgattggctaatggcaatcattagacaaatattggatgat

SEQ ID NO: 212275 - DNA, 487 bp, Homo sapiens
actatttcaagaaatcatggctgatgactttctaaatttgatgaaagacatgagtataaacatccaagatgcttaacgaactccaaataggataaactgaaagagactcactgaagcacataataatcaaactgttgaaagacaagataaaagtgacaattttgaaagcagcaagatttcttatcagaaactctggaggacagaagggccaatatattaaagatactaaaacaaaaataaaacgaaacaaaacaaacacatacaaagaagcctgtcaattaagaatcccatatctgacaaaactgtctgtcaaaagtgaaggaaaaataaagacatttcccgataaacaaaaactgaaagagttcattgcaattagatcttccctgcaagaaattataaaaggagttctgcaggttgaaatgaaagaatatggccgggcatggtggctcatgcctgtaatcccagcaatttgggaggctgaggtggg

SEQ ID NO: 212276 - DNA, 313 bp, Homo sapiens
aggagtccctactagtgcagtgctgagcagtatagataccctggaaggatatacaaaaaactaataaaaggggttacaccaagagagaaggcagtataagtggggtggatggggaacagactggaagattggagattatctttttatagtatttgatttttgaaccatatgtactcaaaacttgttagctgttgttaaaaaagaaagctgaagtcctttccttcttctcaccccaggcagggagaaagctgtgctctagcagaggctgggtggggaatgaaaggctgaagctggggcatgagtgtgtagaaca

SEQ ID NO: 212277 - DNA, 504 bp, Homo sapiens
ttgagtagatgggacacaggcccgtgcctctgcgcacagctaatttattgtattttttagtagagacggggtttcatggtgttttagccaggatggtctcgatctcctgacctcgtgatccacccgccttggcctcccaaagtgctgggattacaggcgtgagccaccgcgccctgccagcaaaattctttaagcccccactggggcttaacatctattgatgctactgcctaccctttcactgctccttacctttagtttatcactgtaattacccccttttatgtattctccatttcttgttctgtctctcattttatgttacctggcaaaatctcagccctggtttagatcttactttttttttttgacaaagtcttgctctgttacccagggtggagtgcagtggtgcgatctcaaggctcacagcaacctccgccttctgggttcaagcaattctcgtgtctcagcctcctgagtagatgggaccacaggagcgcgcca

SEQ ID NO: 212278 - DNA, 379 bp, Homo sapiens
caagccagcagtgacacacacaaccccaaggtggcatgtgacatacctttacttcatttacagacatggcatatgtcagagtgcttggccctaccgcacagttggtttgagcaatttccattccattatgttttcttacagcttctgttttatgccccctccagcttattcaagtgtttaaatttcaaattagttgcttgtctttatcattcatttttggattagagaaacatattatagccgttggacatgtttaccatattaaaaataataacaaagaaaacaaaaatgataaccaccgctccccacccccgacatactcaaggctttaaaggttgtgttgaaatcacaggctattccaagaaatcaccttaatcca

SEQ ID NO: 212279 - DNA, 377 bp, Homo sapiens
gcagatgccagctgtggagtctcccacaagtgaagagaaggacttgagtaggtcttacataatttcttcaaaagcagaagaaagatcacaggaattagcaggctgcatggtggtccaattgagaaaaaaatgtgactgcaccactcttctgtcaagagtctatgagtggctgcaatataaaaagaagaaaacgcacctcaaagactttaaaaagcaacagaaataatggtagggtcattgtgggggtcaacatggattcacgtcaatatttgttactttcctagtcaaatctatataactatttaattataattgtcatcagataatgactataaaataggaacattttcaaccacaaaataaatattaagacaatt

SEQ ID NO: 212280 - DNA, 164 bp, Homo sapiens
atttatttattcatttgtttagggtctgtgaccttgcaatgacacattctctatgtctctgcatcaggcttctcttcaactccctgagcttcagatacttcctcttacctcctccgtccttcctgagtgctgggatgatgggtgttggaaaaggactttgaaag

SEQ ID NO: 212281 - DNA, 277 bp, Homo sapiens
tacagtgctgtggaaaaactggaacagaagtgcgtgagaataaaaagggcccagaaacactggcctgagttacttaccagctgctccctagtgagaacaagacagaataatacatttatgctgtgagaaagttaattttcatttggataaaggtcaatcttcctatcatgtggggtgttaggtactagaaaaagctatctctaaggacaataaagacaataataatttaaagtcaccatccaacaacagaatagctaacaatatgcttttaaaggtt

SEQ ID NO: 212282 - DNA, 510 bp, Homo sapiens
caactggcagagtgcttgcagcatggctggggctaaataaatgtgtataaactaaaataataaatgaaaaaagaataaacgttgaaaaatagaaaaagcaaatcactgcttgtattagtttcttgttgctgctctaacaaatttgtaaacaaagctaccacaaatgtagtggcttaaagcagcacagactgatcttcttacggttctggaggtcagaagtctgaagtcattttctctgggctacagtcagtccctgtgtcttttcctgctcctggcagctgcctgccttccttggctcatgtcctcttcctccgtcttcaaacccagcagtggagcctcttcggcctccccatcaaggggctagaagctttgatgtctggctgcttccagggttcaccctttttctattttagttttattctactagaatataaactgcagtgggcaggcccttttccgctctgctcactgttgagtcccatgcactcagaactgtgcttggtccatggt

SEQ ID NO: 212283 - DNA, 461 bp, Homo sapiens
catccacgaatggcacaggctcctttgaagagggcgagcgccccatcactggaggtatagaagcagttagtcaatgaatgctttgggggatgctcagggtgggctggggattggggccaaaacatctggcagtggggtggacccaaagggctgtgtgtgcttctcccagccttgagattctgtggctctaaaatagaaggattagggggatggcagtgggattttagtcataaaccttaagggccaggaggctggggacagttccttgcatgttctaaatggtgaagcatttgtgctattaaatatagcttttgttgacatgagctggctgaagctgttagcttcacgggaagacatacagtcatttttcatctccaaccactttggaagtaggtgggagaagacaatgaatgatcaaaacattacaaataaatccagtttaaagatgtcaaaaaaaaaaa

SEQ ID NO: 212284 - DNA, 506 bp, Homo sapiens
agttttgatttggagatatttgttatcaaaaagtggtttacctacattggaaatgctacttttgaacaaaaagtgtgactctaaaacatgaaacaaattttcttacgccgctgtaatgacaccatcattaaaatacatttatagctacattcccctcctccagtgtctgctctgtgggttatcactcatatgctctagtatgttgggtaaaaataaagttcaatcatttaatagccatacttcctactactgtaggtaaaataacaagccctgaaggtttctaaaagtcaaattattgattatttgaaagcagttacaacactgatttttaaatttaggcagctgtgattcaattctctttttttatactatactgaaaatgaacattactcttttagcatatacctgacaccagcctactcagtcaattgtctactcctgttacaaacacacacatatacacatgtacactattttttaaatcccccatacatgtattgttttcc

SEQ ID NO: 212285 - DNA, 262 bp, Homo sapiens
attctgtgtgtatatataacaagtgatttaatcttttaaaggctataattctatttatattttctatatcttcttgagtcattttcaggatgtagtttcgcaggaaattgctcatttatatctgttttaatagctcaggagttcgagaccagcctggccaacatggtgaaaccctgtctctactaaaaatacaaaaaattagctaggcatagtggtgggtacctgtaatctcagcttacaggcctcaggaggctgaggcatg

SEQ ID NO: 212286 - DNA, 456 bp, Homo sapiens
tctctgtgaactccagactcagctctgttcagtgtcttggctcgaatgtttaataaggcatctcattcttgacatgccccaaactgagctcctgctctcccccataaaacttcctcctctgaagtcttccccacccacgtttatagcattcccattgttgcacaaccatctccaccatccatctccagaactttctcatcccccagctgaaacgctacacctattaaacactagctcccccttccccagctcttgacagcccccattctacttcctgggcctgggcttttactttgatggtgtgggcgcgattggtggcctttgagcagaggagtgtatgatttgacttgggttttaaagaagccctcgggcgctgcgttgagactgacatgccaggcgtgagggagaaagcaggacgcagggggtcattaggaggagcccagaggctcagccaaa

SEQ ID NO: 212287 - DNA, 483 bp, Homo sapiens
atactccatccaattcagaaataatgtttttctccttggaatagctttttacattaactgtatttgaagatagaaaatttagatctgaatagcagcttttaatagccccataaaaataagtgaaaatatctttaattttaaatttaaacaaaatatctaaaacttaaaaggtatttaatatgtcagcatatttgcaatacaaaaataaacatgctccatttcatttttttgctttcttactcccacggccaggtgatataaatatttcaatttgtgtcactttctagctatcgaatttataaagcggctttcattttctacgtaagtttttaagcttaattttttcagggaaaaaatagatctcaagaaaaaaagtgtttgggatcataagttaataactcatcctattggtaagggaagttgaataagagtccaaactaatggattagaattgtgtaatatttgcttaaccatttgttaaaa

SEQ ID NO: 212288 - DNA, 166 bp, Homo sapiens
ctgccagcaccagtcagattcccctgctcaccactccctaatcctgggcaaatgcttaccattaccttgtaagagtgtgtgggtgggtgagcagtcagttcggagctcctgatgtgggagtggtgagcaggggaatctgactggtgctggcagggcatgagaggta

SEQ ID NO: 212289 - DNA, 404 bp, Homo sapiens
aggtgagacagaccacacaagaccctctgcccatccagaggtgccacagcaggttgtggggtggggagtgggcagagcactccactctgtaacatttttttaaaggctgaaaataaaaaacaccagcagctccagggggaagaagctgtaaaagatcatttgtgagttaactaaccacagatggggcaaaattaaccttggtgtggacaaggaatttgttgagatggaaaggaaggacagctcagagaagctgagaaggaaaaaatagcagggggttaaggactgaatcaaaaatgtgtaaagtaaaccatcagcagatatttattaccatctcaggattgtgaatctgtgccaagacagcatggtcgggctcttgaatgtgatgagacaatgaaagaatagta

SEQ ID NO: 212290 - DNA, 1137 bp, Homo sapiens
  misc_feature (718)..(718): n is a, c, g, or t
  misc_feature (860)..(861): n is a, c, g, or t
  misc_feature (863)..(864): n is a, c, g, or t
attattagattttggaagcagctctcttcttttttaatcagaattacatttgaaggacaaatatacttgctttgatgttttctgactacaaaagtaatttagtttttagacaattttgtcattaaataaccccatataaattgaattgccaaaaatagacttcttcactgttgggcttattttacagaggtaggtttatttcacaaagtttcaagccacactttagaatttggccagggtgccagtgtgataatatgggtagtctacagatgtaaggcctccattaaaaaggaaaatggcagaacttaccctcttgcccaagagaataggagtgctattttttgggtgcagagagtgagggtagtggatagaggtctgaaagtgtagacagagtttgccataagagcagcgttagattttgtccaggtttatctcatttttctctgttggagaccaagatgcttgacgtgaagtgtgtatttgtgtaatgtgtattggttcatttcagttttttataacttcaaactatgccatcaacctaatcaattttaattttgattgcatatcaatagcaaccataaattttttcaacccccaaatttatgtagctctgatttgtagaatattgttttttgcagacctttcacatatgtgcttaagtgaatcccctaaatcggaagttcggaaactggcgttggcccggttgtacttgaatggnacccggtggactaattacacccgggcgaattggtaagaaagggggggggggtgtcgaccccttaggaaggcgtcatgagtcaccgcgataccctatataaagtggtctctgttccgtcggggtcgcatagaggacctccccnncnnaccacaaagcaacaggaaacacaaaaacacacaacaccaacagaaagaagacagaacgagagacaaaaaacagaaaagaaacggaaggacagaaagacagacaacagacaaagacaccaaaccaacaacaacgaaaaaaacagaacaaaagaaagaaacaaacacacacaccaaagaccaacagacaacagacaacaagagaagaagaaagaagggaaaggagaagacaaagcaacgacgaaagaacaacagacacaggataagcacacgggc

SEQ ID NO: 212291 - DNA, 443 bp, Homo sapiens
atgtgtgctgccccaaacctcgccgctccctagtttggtattctgtgtccggcctggggtagtagctggacaccagactcaatcttgggctccagttcccgacttttcgcctcctctgggtctgtcctggggtcagtaattaacccgggtcccaggggtgtcgtcttttccctccagggtggggcgctgcctgtacatgccagggatcttttgcagggcttttcatccagatttgcttcagggttgtccgggatcgatttggactgggctcggaaccggtcctggatacgtaggtcgctgtggcaccagcatgctctgtatcatctttactcacttgaaagcttgctgaagctgttgttgaagtaaacttaaagaaaaaacttgcttaaggaaaatcagtagtttagacaccccctcccccgcctttttttgcagacatacta

SEQ ID NO: 212292 - DNA, 512 bp, Homo sapiens
tgaaatgtcggaagcatgcacttctgccctccagctccaccctgaatcatcaatgcctggagaaccactcacacatgtgcacaaagagacatgggtgagcatgctcggtgcagaattgtttgtatggtaaaaactggagccaccttatctcttcatcaggcagggctgctgcattctgggtgtggatggcatcccctggaattgtgcagaggcaccatttaccatgaacaccttttgacccatgccctctagagctgggaccctgagtgagggggagtgagaggggcgtggttgaatcaactgtgttacaggcacgcatggaatattaggtagaggttaaaacaaaaaatgaggatagccaggtgtggtggtgctcacctgtagtcccagctactcatgaggctgaggcaggaggattgcttgagcccaggaggttgagggtgcagtaagctatgattgtattagtgcactctagcctgggcaacagagtgaaaccgcatctctagaagaaa

SEQ ID NO: 212293 - DNA, 493 bp, Homo sapiens
gtcacaagctataggcaaagctgaaaaataaaaagaagtatccagaaaagtgagccttcattcctggtctcatcctccctagccatgggagactctgagtaaggcggtccacttctctgagctgaaattcccttcgctctttagggaagatcattccccctgccctgttcacctcacaggcttgctaaggaggatctaagttgtcttgaaacatgggaggcaggttgagcaagctcttcctaattatctcccaatatactccttcaggaacttatccaaactcacctgatcagaattactgtgtatgcagaatggacattgaaggctcagagagggagagggtgagaagggggctaagggatgaaaaatcacctactgggtacatacaatgtatattatctgggtgatgggtacactaaagcccaaacttcaccattatacaattcatccatgtaaccaaaagccacttatacctctaaagctgttgaaatta

SEQ ID NO: 212294 - DNA, 422 bp, Homo sapiens
cacacacacacacacacacgtacacacacaccttccacccttccttctctctacttacaggtggtaatcttgtctcctactgaaaacctctttaagcactaggacttgttttactttcactatttagaaatatttcaaaattacacacattcctgtcttcttcagtaaagtacacctggcttcatttaaccattctctctgcaactgaagatcactatgaaaaaattattctgaggggagccacagagtaaaaatattcaagagatctggatagttgtaataatcatgataatgataatgagggtaactaacctttattagtgcttactacatgctaaggacacggcaagtgttaacttattaaactcttaccatacctgtaaaaaactgttactattattatccctattttacacatgaga

SEQ ID NO: 212295 - DNA, 532 bp, Homo sapiens
aaatgtattttttctcacctagaggccattaagcttcaaatgatcatgcagcagggcttctatccagggaatgatgccagccccggccaacaagaagtcatcctgtctccactagacagagcagggtgagagttccatggtccccaagtagatagggacagtgccccaaacagcatgaagcagttacagaagaaagactgtcagtccctctacctcctgtaaatatttgatattaagtctctcaagggggaatgaggcaggagaataggatctggagacagggagccttcactttagcctctgattggtcgcaggcgaaatcttcatttgcatagggtgtaatttcacttcagcctccaattggtcatgggctacgtcttcatttacaaagggtgtaaccaataggaaacctctaaagggtactcaaacccaagaagattttgcaactggggtgcttgagcctcttgcccaagcctgcttctgctctgtggaatgtactttcacttcaataaatctgtgctttcgttgcttc

SEQ ID NO: 212296 - DNA, 375 bp, Homo sapiens
  misc_feature (17)..(17): n is a, c, g, or t
gttctagaggatcccgncatcttctcccatcagtgaaacagcaccactcagaaaaccacaggggtggccctgctagaatacacatatagttgctgaggaacaggaaacgaagccagatggttctgctgagggaagcacttttttttctttataaaaccaaaaaagtactaataggtcaaacataaaaatgcagatatggtaaagcggaaagctaacaggaagatttatgtaaataaggcaagcttaagtttgcattatgttcccatctacatcagtgagtggatgtacggggggaaaggaaaaaataatacagtatatccatcctatagatctttctgctgatgggacaatgctactagcaatcccatttaggca

SEQ ID NO: 212297 - DNA, 377 bp, Homo sapiens
ttaaatctagattggagggacagggaggaagaggtgagcaaaggcaaggaagggcggtgaagttcacagctccccccataccccactagtgaactattatgctaatatgagaagtagtatttggaggctgagtcaaaggcaggcctggcccgggggtgagggtgccgggtgcccctctgcactcattcgcaattggaacaccaggacttttttagaaagtagttctgggtctccaaccctcacactctggctccctccttctgagtctccagccccggcttcttccctccactacaccctctctattcctcccaaatctccctccagtctccaggcccagtctctaaccaagggagagggaaagaccagaacttaaa

SEQ ID NO: 212298 - DNA, 690 bp, Homo sapiens
aatacacaacggcacgcgccgcttggtcgcggcccgcgcgaaatcggatgggtaaccaaccatcctcagcctgcactccccttgagtgtattctgaatcactgggactccgttgaccctcagactgtagagaaagaggaaaaaaccttttccctcctctgtcctctcttccagccaggcatgaccatgtaacagtttgggctgctgagccagaagggaaagagtactactgctagacttccaggaaggctgctctaagaaagatgactcagaggttgcacttttttagttttgggggtttttttccctctacttcctgcttcttggaactaggacatgatgtctggaactctagcagccattttggaccatgaggtgattgtgtgactagaagacacatcgtagaatggagcaccaagacgaaagcccccaaagctgccctataagacctggacttcaaaccagcaaacttcttccatgtgagagagaaataagcttaggttttgtttctgccagtgttatctttgttttcggttatgagccactaaatgtgatcccacttgttaccccagtcattctcccaacttcctagacccattaatagcattctacactcacagtccatcagtggtgcaagactacaacacgattttaaatccaaaagtgatataaatgattttgtgattctgtg

SEQ ID NO: 212299 - DNA, 1040 bp, Homo sapiens
ctcctgctctcccagagtgctgggattacaggcgtgagccactgcgcccggccaaagccctatttttataggtagtggatgaagaagagtccttcccctatcccctatgtgagtcaggcattgtcagagagattatggaaggttgaagaaagtaaacctataaagttttatatgaacactccttagccattttgcatggatctgaccctaaacagcacatcagaggctttgaaaactagaatacacaatagactgcctctccagggccagcctggccattgggtggcaaataagtggggcagatgcaaataacatagcaaaggagttcataacaaacctgacactggaaccataacacaacctacaaacattgagtaaaaacttgaagcctaaaccaaaccagattgtctgctgaaagtttttaaaaatcaagacctagaatgatgtaacatgtcaaaatatccaggatgccatcctaaattagtcaacatactcaaaaccaggaaaatcttaacatctcaaaggaaaagacagcagacaccaacctcaaggtgacatggaccaagactttaaagtatctgtgctacaagtggtaagggtgaatactttgttttaagagaggggtcttgctttgttaccctggctggagtgtagcggtgtgatcatggttcactgcaccctccatctcctgggctcaagcaaacttcccacatcagcctaccgagtagctgggactacagacctgcaccaccactcccagctgccttttttctttttaagagactggctattgctatgttgcccaggctggtcttgaacttctggtctcgtgatccttccttcttggcctctgaaccacagtgcctggccacaacagcctttaaaaaaagagaaaacaaaaataagaaaggaaaagactgttacactgtttagttcagccatggaacgtgtttaaaagtcttaatagaaatggtgaatataactgagaaagggagggtgggatttgttagtgcgtccagtgggtaaaaaggagtatgtgc

SEQ ID NO: 212300 - DNA, 432 bp, Homo sapiens
ccataagtgtaattggctgcctttcaataggacataacagacttcaagttaaatggaaactattaaagctcaaatgatttctgccgttgtttcatgacaaatgtacagttttattattatgagtattcattcttgtacagtggtcgacagcgatttgaatatacatgattattcacatgcccgatgatctagaatggtatatatcatcacagttaaaagaggtaaccaaggtgacgttgcttcaggtgctaatgtcattataaaactgtaaagcaattattctgttagttcttgcctggggttatgaatacattgaagagtgcagagccattagatgtagctacttcaaaaagcggggaaaagaagatgaattttaatgcatgggtaattgctcaacatgaccgcattcctaataaatttttgtatattaga

SEQ ID NO: 212301 - DNA, 427 bp, Homo sapiens
tgagatggagtctcattctgtcgcccaggctggagtgcagtggtgtgatctcagctcactgcaagctctgcctcccaggttcaagtgagtctcctgcttcagtctcccgagtagctgggattacagatgtgtaccaccacacccggctaatttttctatttttagtagagactgggtttcgccatgttagccaggctggtctcgaacccctggcctcatgtgatccacccacctcagcctttaaagtgctgggattacaggcgtgagcaaccacacccagcctggagtcaataaagatttttgctccatccaaaactttggtcagctcttgagagactcatagagtccacagggtaggcctaggattcctgacaaataaaacaatgccatcaaatagcaacatcatttaaagaatacagacatgcta

SEQ ID NO: 212302 - DNA, 173 bp, Homo sapiens
cgagctcggtaccccgcgttctttttgagtttcactcttgttgccgtgagccaaaatcatgccactgtgctccagcctggcaacaagagtgaaactcaaaaagaagaagaagaagaggaggaggagaaggagaagaagaaaggaagaagaagaagaagaagaagaagaagaag

SEQ ID NO: 212303 - DNA, 226 bp, Homo sapiens
ggaaggaaagaaaaagagggagaggactcacagggagaaaggacagtgccaaagggtgacttcgaggggactttagccccgctccctgtctccataaatccctcctggcactccaaacaaacctacaatcgaagtaaagcagcgcgctttcaatagcgaggcaaggtcccttgctccaaccagaaacgggatgatacctggtgaacccccatccagcaagcccggg

SEQ ID NO: 212304 - DNA, 392 bp, Homo sapiens
cctatattaatttggtaattcttagcctatagatctatttaaaggcatgggactaggtgaagtcatccaaacccagtgagaagaaaagagagcctctggaaaactgagccttgggtcaacctaaactttaagtgcaaaaagagggaggagagccagcaaagaaggctaaaaggagctgttgtgtctcagaaaacaagagaaaaggccatttgaaggaggaggaagtgcttacttgtgccaaatgcagctgtttgttgagaggttcaataaaataaagactgagaattgaccattggatttgtggcaagatggaattttttggtgaatttgacaattggtttcagaagggtgggaaaacaaaatcctgattggaatggattaaaaaaagaatg

SEQ ID NO: 212305 - DNA, 512 bp, Homo sapiens
cgctcggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccctgagggtggaaggggagtgagtagacactcgggaggtgtcttgagattatcatctgctgagggtggaaggggagtgagcacacactcgggaggtgtcttgagattatcatccgctgagggtggaaggggagtgagcagacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccccttcctgaccccagttgccaagagccctttcttgcagaaaggggggagtgcaatttgtg

SEQ ID NO: 212306 - DNA, 423 bp, Homo sapiens
cgctcggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtagagctgagggtggaaggggagtgagtagacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccccttcctgaccccagttgccaagagccctttcttgcagaaaggggggagtgcaatttgtg

SEQ ID NO: 212307 - DNA, 393 bp, Homo sapiens
ggattttgagacaggatctggcctcgttgcctaggctggagtgcagtggcacgatatcagctcactgcaacctctgcctcctgagctcaagccatcctcccacctcagcctcctgagcagctgggactgcaggtgtacaccaccacgcctggctaatttttgtattttattttatttatttttttggtagagacggggttttgctgtgttgcccaagcttgtcttgaactcctggggctcaagcgatctacccatcttggcctcccaaggtgctgggatgacaggcatgagccaccacagctggcctataatgaaatttccaacttacagctattgccattatccaaagcccagaatccctgatttccttccatagcccttcatggcctgacc

SEQ ID NO: 212308 - DNA, 533 bp, Homo sapiens
aacttaatcttggacttcccaccatccagatcataataagtaaatgtttgttatttaagccatgcagtctatgataatttattatagcagcccaaactaagacacccaaataaaatagaaatattaaaataagggcaaagttgatactgtagaaagtaaaaatgcagcagacatgatcaacaaatccagaagctggatcgctgagactaataagttgacaaacattaacaagtgttgataaggatatagagaaattgtaaccttcatacaatgctatgggaatgtaaaatggcacaggcattttgggaaatggtttgacagatcctcgcaaagtgaaacatagagttaccaaataacctaccatttccactcccaggtatacatttaagagaactgaaaacacggccgggcatggtggctcaagcctgtaatcccagcactttgggaggccgaggcgggtggatcatgaggtcaggagatcgagaccatcctggctaacagggtgaaaccccttctctactaaaataaaatac

SEQ ID NO: 212309 - DNA, 490 bp, Homo sapiens
atgtcaaaccaggcaatgtttgtctttgagcatcttccatttcttattttagtaggcatctcactggttccctgtgtcttttatcctgctctctgtcactggtagcagaacaagctaaacttccttaagcaaaactgtcctaagaaatgtacactgcagagacttcctaaagagagatggatggattcatttggaaacatctgtgtgcacactctaatttgtattcatttttccctagagaatgattacacctatataattaaaaagttgcctttgaaaactattggcaccaaaaatggacaataattaatgacccatccctcattttttaaaaccattttattgtggtaggattgacatacaaaaagctgtaaagatggaatgtatacaactcaatgagttcggagagaatcatcaccacaatctatgccataaacccatccatcacttccaaaagtttcctcctgccctcttatgtattgttatttgt

SEQ ID NO: 212310 - DNA, 671 bp, Homo sapiens
gtgaattgctcatattcatgtaatttcactttgatttttgttacgtaagattgatcgtattgttataaaaataataacactgtattgattccaggattcagtgaaactcttgaatttaataattaaaataataatgctaatagtagtaataacaatatcagagaaacattataatgataataaaacatttcaaaaaggatattacttcaagttgtccaatgacttacctgacatgttttgaagttatgcacacaaatacaaatggtggctttttgtaattcaatttaaaaaatttcttatcctattttactgagttattctgatttttacattctataaattatttctctttcagatatctatcctagaattctctaatttctaaattatataggagtcatttgcataaaattcaatatttgttagatataaaaatattcaagtctagacaaaaaaaatcaaaatcaattgtgcactagtttgggtaatgtttgctgctgtaataaaccccaaactgaacacaatagaactttatttcttgctcatgtaacagttcagtgaacgtgctcctgctttgtgggtggcttttcttcattgggtggtgcaaggattcagatttcttccttgtggatctgcacccttaagggacatagggtctcttgaattcaagt

SEQ ID NO: 212311 - DNA, 464 bp, Homo sapiens
ctagttgtcaggggagtgcagaaggtggaattctcagacggatggggctaggtcaagatttggtggaagacatgggggtggtaccagatcctgaatgatagatagggtctgagggacagaaaagcagcatagtcccaatttagtttctcaaaacacatagatgagagttgacatggtggctcacgcctgtaatcccagcgactctggaggctgaggctgaggcagaaggatcgcttgagaccagtagttagagaccacctgggcaacaagctaaaccccatctccacaaaaaaattaaaaaattagccaggcatggaggtgtgcacctgcagttctagctacttgggaggttgaggcaggaggcttgtttaagcctagaagttcaaagctgcagtgagctatgatcatgccactgtgctgcagctgcggtgatggagagagaccctgactcttaaaaaaaaaaa

SEQ ID NO: 212312 - DNA, 118 bp, Homo sapiens
gcttgctagactcgatcaactttatttatgaggagccatttataacattcacaatggactactgaacctcaaagcctctttaaaacaagctttattgcaaggtgctgcttcactataa

SEQ ID NO: 212313 - DNA, 521 bp, Homo sapiens
gaagcaatttagctagttgacagtcttatctcccagaagcacatatctcctgcagcgaacaagtctgttagttttgcttggtcttctgtgttgtctaacacagatgcagggagttctgttggcttcagttctcaaatgcctacctagggtatagtaggtattcaactaacgtttgttgaagagatagaacgaatgaacgaatgaatggttcaatggataaatggtggtgtgatttacccagggcctcataactagtgagtagaggaaccaggatttgaactggaggctgcttactccagcccataaagctcttaacagttcactcactccaatgtcctaacatctgacagcctcttccagtggagggtaaggcagtgtttcttctcctgcacctacttacatttactcactgatatggtttggctctgtgtccccacccagatctcatctcgaattgtaatccccactagggcgggacatgatgggaggtgactggatcatgggggcagtttcctcatgct

SEQ ID NO: 212314 - DNA, 632 bp, Homo sapiens
agcaacagggtctcgctgtgctgcccaggctgggtttgaactcatggcctcaaacactctttctgcctcagcgtcccaaagtgctgggattacaagcatgagccactgtgtcgggccagcattccactttgataatagacctgtggaaaaggcccatgcaatcctgaatgtgggcatggattcaattaagtagggaattccaggatcctggatacctagaatatggtgatcagactcagggtgggtgcatctccttgggccttcaggccccttgccctgtggggagaggtggagtcttttaaattatagaatctagggtaggggcctctcttggaacaggttctaagggtggtaatgagagacaaaaattctctggttcaggaagcccatcaaattccaaagcggcaaagaaggaaaggaaagaaattcatgtctaaacatatcagtaaacctgtgaacctatagaacatcaaaaccagaaacgattcttaaaaataggaagagagaaaagacagattacctacaaaggaacaacaattcatatgccagctggcttttctataccaagagtggaactactgaaacagtgttttcaaagtaggcagtgaaaataactgttgatctagaattgt

SEQ ID NO: 212315 - DNA, 368 bp, Homo sapiens
ccagaaggtaaagtacataccctggaaagcattgtgtacgtggctccgctcctagttgttgaccaaaataagcagagctaatgaaatgccatggcatttccctgtgccaagggaggcattaggctgttctcaatgaatgactcacggaggcagcgtatagaggcctccctgctggctgctggcggggcatcggctctctctggtaggcattgtgctgctgtggcttcacccactgactggcacggagcagagccctgcttcatcgcctttggtaatttcctcttaaagcatgtgtctccagtgggctttgaatggctcctctgtgatttctaaactcaacctaactgagtatacaattttaattggaa

SEQ ID NO: 212316 - DNA, 540 bp, Homo sapiens
tgcaagatagttctgtgtctacaaagaggtcagttatggccataccacttgtggaaatctagatttgaaatttcaggactcaggttcttcctaaaagtaagtttaggaagggattcattctttcaaataattaaaacttaatgagcatctcttattcttctactgagtagtctgcaagctttcacatttgcaagatagttctgtgtctacaaagaggtcagttatggccataccacttgtggaaatctagatttgaaatttcaggactcaggttcttcccaaaaattagttcaggatctaccaggaattattggagccttagcttgcaggtgtccacatcagttattgctaacatatttcctcactgtttgcagggttctttaggattcccaatacaaaagaaaaaaaaaaaacacttctgactcatatttaggcacctctccgttagcactgtctaccaaaaataacttaattttctactcccgtccacatggatagtcttatgtccactctaaaagggtatgcttcctaaaattaaaa

SEQ ID NO: 212317 - DNA, 255 bp, Homo sapiens
aactgtaaaatgtaatggttaaatgctctgcctccccagacacctgcgcctatcatgatcttgcatacgcagtggctagaaagaagttgaattgtatttggtttggagttttaggtttacagctgcactttggtgttttcactgctggaatatatatatattagcattccctaaatatttgttttgtgagtgttcacttttaactgatttttctcatttgtaatactttttcatatctacccttcataaacttgc

SEQ ID NO: 212318 - DNA, 223 bp, Homo sapiens
ttccctaccatctgggctcttgccatatcaggagtgttttttatttatctagggaaagggtaaataaaaatagaagatttggaaaagcacaatggggcagagttctagaagtgctactcaccagctctgtgatcgtggggatggcgtaataaatgtgccaaaaccatggggtcattatgagtataagtggagaagaggcatgtcagctgattggtgcagtgcc

SEQ ID NO: 212319 - DNA, 237 bp, Homo sapiens
gcaagtggaaaggtaaaacacttagagtgtattttcagttgttgtatataactccagcttctgaaatgatgtatctgacacctcctcctttttaaaaaaaatttaaaacagccagcaagaaatagcataatcgatgcggctaaagtctggccaaatataccacctccaaatactcaacctgcacctcttgctgtccctctgtgtaatggctgtggaaccaaaggaacagggaaggag

SEQ ID NO: 212320 - DNA, 1054 bp, Homo sapiens
ttaacagggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaa

SEQ ID NO: 212321 - DNA, 275 bp, Homo sapiens
ttacctcagtggctcctagcccagatgaacagcaaaatcctgaaattcttaatttaaaaaccagacatgtgtttctcaagcctaccctccagtatctgatttagtagtttatggtaagtcctggtaatttgcatttttaaaaggtccccaagtgattctgatgtgcagctgggttgaagaaccactggtttggttcatttaattcctcctcactcctgattacacatttactttaacctctcctctcctttcatttcattcttacctagttaccc

SEQ ID NO: 212322 - DNA, 351 bp, Homo sapiens
cctcaacataataaaagtcatatatgaaaagccacatcacactcaatggtgaaaactgaaagcttttcctctaaaattaggaacaagacaaggatgtctgcattcattacttctatgcaacacagtgctagaagttctaaccggcacacttaggcaagaaaaggaaataaaaggcatcaaaattgaaaagaaagaagtaaaattatctctatttgcagataggatcttataagtagaaatgcctaaagggcgtgtgtgcacacacacacgttagaactaataaatgaggccaggcatggtggcctgcgcctataatcccagcactttgggagtcagacgtgtgcagatcac

SEQ ID NO: 212323 - DNA, 148 bp, Homo sapiens
ctcacagttctgtaggctgtataggaagcatgatgccggcacttgctcctggtgagggcctcagaaagctttcagtcacggcagaagatgaattggaagcaggcctgtcatcatttatgagggacccaccccaatgatccagtcactt

SEQ ID NO: 212324 - DNA, 369 bp, Homo sapiens
agatgaaaccctcaaacagaggtgtttgctgtggaagctttgaagaggcttctgaaaggtgacgactgagagagaaaaaaaaggggcagctcctgccatctggaagctggctcagtgctcacagctgggccacgccgtccttctgtgggacataaacaatctaacgaaaccaacctctgccaagggcgctctgagaccaagataaagggagacagagtgaggtcactggacagaagcacggtccctgtatcacccacggaatacgaaacaccccctcttgactccttcccttggcttaaatgggtgactgctaggcctccaccaattctagctcatcctccttctactctccctccctgcaggttagca

SEQ ID NO: 212325 - DNA, 433 bp, Homo sapiens
aggagattgttatgacatttttcagttgcagtgtgtatttaggaaaagcaccgtttcctgttaattttaatagctggccttatctgtctcttttatctaatcctgatgaatagctgggcagacttttactttctcagcttttatagccatgaattgagcatccttctatggattccccaagtcatcatgaagtgacattagaatgttacagaagtgctttctacatattttaataacttgtggccagatgaggtggcttatgcctgtaatcccagcactttgagaggcagagatggaaggattgcttcaggccaggagtttaagaccagcctaggcaacacagcaagaccccctctctccaaaaaaaaaaaataaataaataaattagctgggcgtgttggtgcatgcctgtagccccagctacttgggaggc

SEQ ID NO: 212326 - DNA, 400 bp, Homo sapiens
agatacaaagataaataaaacatggttcttgcccttgaagagatcttgtcttaatgagaaacacagaggttaaactagacacttataatacaatgcactaggtgcaatgatagagaagcactaagaaagcaacaaggaaggtagagtaaaggtaaatttcctgaaggaggagaaatatagcctgatgacaaaataacaggtagtaattatctaggtaaagagggattggcagaaagtgaaggacgtctactgacagacacaagagtagaagtaaaggtagaaaggttagaaacagcatggaaagcaggccaaaatttatgagaattttgcagctctccaagcaaaaagtgatgagaatctatcctaccatactaatgttgtgaagagaatgaaagacagg

SEQ ID NO: 212327 - DNA, 485 bp, Homo sapiens
ttttaaaattgtgtttaaacaaaacaaaacatctggtaagtggaaacaattgcttgcagtcattttttcaaatttattcatttatgtattcattaaacacggaattctcgccatgtactaggaaagcagtgcatgctcttttaaagtttacagtaatacctgggaaagcaagtaattagagatgcgatgagggctacagaaagaattaccaggccgggtgcagtggatcatgcctgtaatcctagcactctgggaggcagaggtgggtggatctcttgagctcctgagttcgagatcagcttgggcaacatggggaaaccccatctctacaaaaaatagaaaaattagctgggcatggtggtgtatgcttacagtcatagctacacaggaagctgagaggggaagatcacttgagcctgggagggtgaggctgcactgagccatgatcacgccactacactccaacctgggtgacaggaaaaaaa

SEQ ID NO: 212328 - DNA, 333 bp, Homo sapiens
accacgcccagccttaaaaaaacagaaaattttaagttatgaatcctctagtcttgggaatgatcccaacctttccagtcaggggtcagggtagctctggaaaagattcagtctcaccaataacagagaatcatattgaaaatccgaagcccaacaagcagaatacaaatggttatatatgtgatgtaattttaatctcagtaaaataaatatatcgatacatacacggaaaaggaaaaaagactagaagaaaggttaagactgattctatactgaggtggtagaattacagcttaattattcttcttttctattttctataatgggagaaag

SEQ ID NO: 212329 - DNA, 377 bp, Homo sapiens
gggctcttgccagaggggactgtacaagcagtccacagatgttctcgaagaaactccctggaactttactactcggttatacaaagagccgtcaaggccaggcatggtggctcatgcctgtaatcccaacacttgggaggccaaggtgggcagatcacttgaggtcaggagttcaagaccagcctgacaaacatggtgaaaccccatctctactaaaaatacaaaaattagctgagtgtcttggtgggcatctgtaatcccagctgctcgggaggctgaggcataagaatcacttgaacccgggaggcgggggttgcagtgagcctagattgtaccactgcactccagcctgggcgacagggcgagacactgtctca

SEQ ID NO: 212330 - DNA, 320 bp, Homo sapiens
attttcacttgtgacaccaccacagagacagccactgcttgcatggtgtttctctgcagtcttcttcctgtgcatataggaaggggtcacgtactcagtgtgggaactcttcccctcagtagcctatttatactgagcattttccacatggatacccttgaaaaaagtatgtcttttgttgttgttgttgttgttgttgttgttgttgttgtcggcggcggctctttggtatcgtattgtttgtttattgaatcctctgtgggggttttacggtgttttcaagttctgatctgtgataaactttccttgtgcagagtatg

SEQ ID NO: 212331 - DNA, 823 bp, Homo sapiens
cccaccgtaactcgatcaacctaaagccaaattgagacccagagccaccctcatgccacggttagtggagcaaagaaaaggggtatttccttgagaaagggggaaacttggtttgttgaaataacctgtagacatactagctttgactcccagagttgtgtcagtatagaaatacctggatccatgccaattaccataatcacgagggcatcctaggttctttggatatgtcgggaatttataggatcttatatgccttgaaattaaggaacctctcagttattatttggaaatcttattatcagagagaaacgtattacccggagcgatttgttctgataataccggtaaccccaggtcagggaagatataaaccagaaggtctaatacaggccagttctgccacttaccagccatgtgaatctgggcattatttaacttctctgagcttcaacttcctcacctgtaaaatggggataatagtagcgccctcctcacagagttcctgtggggcccagatgagttcatatatatgtgaagtgtttcaagtgagcctgggacagagtaactagtccataaatattatttgctgttgttaacaatactgttctaattgtgttattatagacccttttataaactattatagaccctattgtagtctatatgtagactctttccccaggaaaaggcttcacacatgtaattgtttatgcagcgttagggactctcagattctgtggtctctggaaggatctgagacccagggaagccatagcaactgttcagccaggagacctgctctcagttgatcgagctacta

SEQ ID NO: 212332 - DNA, 1721 bp, Homo sapiens
tgagagtcttattgcatttcaccacactgccatatatggacctgtgagaccttcacttgtaggaaatttccctttaaaaatgcatctgaagactacaatgaaatggggaaaagcatagttttggttgagaaggaatgtaaggatttctctagatgtttaattaatcattttgggatgagtatatttcttgtcagattagcagcacgtaagaactggaggctcaagtgtattctattcacacagaagtggatagattccacacacagtcaataaaaagcaagaggcttatgtaaaacaaggctaagaaattgcagttaccttcccaccaaaagaaattatttcaaaagcaacatcacatagtcgcaattacagtaaaatggaattttgttatgtcctcttgctttattccgaattaaaacttccttaaattaattcactaaaattctaatcatgttttaaggaagttgagcaaatcctgcaaatacatatatctgccagtttttttcttttactttttagtattcattagcaagaaaattttgcctaagacaaagacatgaaagcatacaatgttcaaattaaatgaaattaagtaaagtcaaattaagtaaatgaaaacaaatctaacatttcacttttattaatttggggagggcataatttgatgttggcataagcagtaatgtttgtaaactgtttatggagatgcggaaagagaagaggatgaatgtatattatatgagtgaggtttgatgtctaccagtcctcattttcatatgaggaaactgagattgcacattttaaaaaaacttgcacaagatcacaccactagttaaatgacagattcataacccaaatctacttctgcctggcaccaaagttcacgttctttctttttcacttttggcatacttgatcttgttataagtcctttagaaatagtagtgcatttagttctcttaataattctatataatgaaaactgtaattaccactgctttacagtgaagaagttaaaagactgagaagtgaagaatttgtccaggtttacgcagccaggaagtagcagagctggaaattaaacccaggcaatttgagacttaagtctgtaccttgaaatacaacactgtggcatctcttgacatgctttggaaataaatggaatccatactgtcttcagtgggaatatgatactgtagcctagtttttacaaggtaaaaactctccaggaagtaatcaatgtctatattataataaatataatagtctacttacatgatcaatatttgtactatttcttggttcccacagaaacctaatagaatagaaacaccacttttttgtcctgtcactagatttctataaaaatgcttgtttgtgggcagggaatactctgaagaagagttatgaaaaggaagggcacatttattgctgtagtttgaaataaaactttttttcacccaacttagataaagcgcaaatggaattttatttgcaggggcatattaacatagaattaaaatgacaactatatagttacctagtgctgaatagcgtctatatctaacctattttctaaaagatattttatgaccctctacacttgtatgcacagtacagaaaatacactgatgtctgtagttttgtttctgtagcccctaccacttagcaggtattctgcaaatacgtgcctttggggatgaagaaaaatgatttatgtt

SEQ ID NO: 212333 - DNA, 480 bp, Homo sapiens
caccatgaaaatggactaatatatagatgtaataactttttgcaagttatgcaattttgggccatagattcctttattctgaagtggagaaaatactttccttatacaattgttatgtttacataaaataaggtgccagatacatagtagaaataaaataaatgatgttactacttcctaaaatcctaaaagtttcatttcagattgctgagtaaacccagttaaagaaaccagcctctgtgttttggtgttgtcattaatgctaagttacatttccttagggtatctgcattaagcaaatgtaagatgtttgagtttcaaagatgaacaagtgacttgtaagtgtaaagtggtatggctgtttttaataaataggtaataccacccttttggcgggtagtagagaaaagaagatgagtttttagaaaaagactcagagttactcagaattaagaaaatgaatccttactgtcaatatga

SEQ ID NO: 212334 - DNA, 493 bp, Homo sapiens
gggtgactaactcaatagccattcccagcccctctcccttccctgcttctattctagaagaggctggaaaaacccaacatcccctctgtaggccttttttggagttaagggatgacaatatgaccaaattctggctaaaaagacagagggaagtctatctggatgcttctagaaagccttttgctttcctgatggaagaaacaggcacaagagagagcaagctcaccagcactgtctctcctttgcccctggcttccatgtagacttgatgcctagacccgtgggacagtagttggcttcgtattgtgttggtccagctaagcagcatctgttacgcagaatcctcccatagttccaggttagcattggccacaagggaaatattgcatgagatctgggaggcagcaaccaagcagcagccatggtttttatgctgtgaaggacaacacaaggcgtgaggaacattggcagttctcacgcattgtcgctgacc

SEQ ID NO: 212335 - DNA, 362 bp, Homo sapiens
caattttaaatttgcccttacttgttagccttttggaatgtctgacatcttacaaattcaaaactgttctttgcatgtttggaaaatttaatagcattttctgaagtgtctccacagaatgtaacttttggtttaacttcatgtaactcatatgaaagaaaaaaagccagtttttgagactctcatcttagaatgatggcatttaatgccagagaaaaacatggagatagtccagcctaacaacacatgtgttcttaatcctgtaatctgttttccgcactccatggagaatggtattttagatttaaaagcaaatttcagcatgtctttcttctaataaaaactttaaacgatttttcagg

SEQ ID NO: 212336 - DNA, 521 bp, Homo sapiens
tctgatagagaaaaaggtacatgaacccttactatgccctcagctccagccacctctctaagaggaaattgttgggcaggtgggcgagagctagtcatggaatgaaactgtaagctgaaccgagtgtgaggaggggagatgatagaagaattataaggtgggggagcagaggttgaggaagaattggaacttgattcagcatgttgaggagtggccttgggaggggaaaaaggtcagaggggtctgaagaaaagaaggattcagaggactctgaggttggggtagagactgaagaaatggacaggagagaaagaagaaagatttagggtgagtcgcattggggtcagaggctaaggagggaacaaagtgtaaaaaacgcttggacgtaagacatctcagaccatttacccaattttcaacaaaaattatctaggtcttacaggatggagaaatcaaaagtgccattttctggccatttgaaaccactgttgagtttgtactggggccaagcagtattgcag

SEQ ID NO: 212337 - DNA, 291 bp, Homo sapiens
cagttcaacctaaatgcaggggtctggagagagacttaagagagttaagttgaaaacaaaaatccaacaaccagcctcatatcagcccgactatatataagtcctctgtatgcctaaaatggagagcttatcagtaatattcatcccaaatggcaaataatcctaaaaatcattgctgtttctcaacttacgagggttggtactgcaatttctcctaaagttaaccctagcatgcagtcaatcttcaacaagtatttattgaatgttaaataaatgaaagcttcatttcat

SEQ ID NO: 212338 - DNA, 476 bp, Homo sapiens
caggtgtgagccatcgcatctggccaagttctttttttgagttacctaaagaacttcagcatgtttccccagagttacttcttatctgccttgattgtgagaccacatttcaacttgctttacatacatcagctgggatagactactgatggcaggtgaacttgtatcacagaactggatgtgttttacacaagctttattttgggtattctcgccttgctatttcccatgaaatacggcttaccgatgacaatgggagaatcaatgaaaaggctgatgtacaatctgtgcaagtccaaataaatgctcacttggaagtttcaataaaatcttcaataagctttaacatggagtttgacatagtgttagtgacacactttgcatgacacagatgtctgccaactccattttctatttcttttttctttttgagacggagtctcactgtcaccgaggctggagtgcagtggcaccat

SEQ ID NO: 212339 - DNA, 526 bp, Homo sapiens
ctattcctagtctgtagacagcaggctgcttgttatatccttgttataagagggagagatagagggaggtcgtctttcttgtgtcttttcttataatggcactaatcctatcatgagggctccattttcatgacctaattaccacccaaagttgccaccttcacatcacatacaatcacattgggcagtagggtctcaacacatgaattttggggagtcacaagcagtgaatctgtagcaatgccataacttgaattccttcaaagtatatgagattaaatatcatcattgccttgaaaggacagattgtgtatatgttttcaactgttgtctttgaaacaaagtatcagaattaactggttaatcaacattttagaaactcattgaagcatattcagttaattatactgaagcatattcaatatagtgggccctccatctgcttgagtttcatgtccttggattcagccaactgtggatggaaaatatttgggaaaaaacaaacaataaaaaataacactacaac

SEQ ID NO: 212340 - DNA, 276 bp, Homo sapiens
gcgaagggggaagatccatgtaaaactgtgaaatcttgtgagaacttactatcatgagaatagcatgggggaacctcctccatgattcagttacctcccaccaggttccttccaccacacataaggattatggaaactacaattaaaggtgagattttggtggggccatagccaagccatatcattttgcttctgtctccttccaaatctcatgtcctcaaatttcaaaacacaataatgcctttccaacagtcccccaaagtcttagctcattcc

SEQ ID NO: 212341 - DNA, 399 bp, Homo sapiens
gctgatattatctgcgggcgaattgtaggggaagggtggctggcaactgtgtttctggaggaaacaaagcagaaggtgggggcttgtggttctgtgggaactgctggattgtccttttcttcttagggtgacccttctagtcttgtgtggctttttttttttttttttttctgcagacaccaaagaagagatgagttgacacctcctgcaaacagctccccaggctgctctcctttatgttttgccctaaagtctcacatgacttaaaaaaaaaaaaaaaaaagccaggcttggtggcttacacctgtaatctaaacacttcgggagtccgaggcaagaagatcacttgagcccaggagttcaagaccagcccgagcaacatagtaaaaccctatctct

SEQ ID NO: 212342 - DNA, 383 bp, Homo sapiens
ccttactttggctttagacatcaaagaaggcttaaatgagtgggtaaaatttgagctcagtcagaagaagtagaatttcattctcaatgattttcagaaagtaggataagtaacagataactgaataaaaccttatatgtctaatacattcaggccatgtaatatggctgtgtctcaacatatgtaagggaattatgcaggatgagacccacatggcgggtagggaccagatgatataaaattttatattctctgcttaaggaattgacgttttcctgcagatcacatggagagttcttcagggattttaaacagaggaaggggtgcaactttagaaggattatttctagttgcactttagaactggagaataccagatagga

SEQ ID NO: 212343 - DNA, 428 bp, Homo sapiens
agcaaaatgattatgacttgctgaatgctcagatgattgttggcatttcttagcaatattttaaaattaaggtctacatactattttgttaaacatagctattacacacttaatagactatagtgtaaacataacttttatattcactgggaaaccaaaggtcccatgtgacttatttaattgcaatattcccttattgcagtggtttagactacaaacctgtaataactctgagatatgcctacatgttgaattctaagacaaaatgaatttgtttcatctttttaagtaaaaaatttggctgcaaactaaatgtttctatttcaaatgaaaataatggattattttgttttctaccctcatggattcaatttctattgggtaaaccacaatgacattttaaaataaactttagcatatcatagaga

SEQ ID NO: 212344 - DNA, 611 bp, Homo sapiens
atgagaatcggtagactaaggaaagctgttgcctgggaagcaggatggacagacctgcagggatagaacacatggcagggcctggaagggagggggtccgggacatgagggtctcgtctcatctcctgctgggggtgcagtgcttgtcctgcatggcacctccagctgagcctgcagagacctctgaggtggacgcagaggctgggagcatgggtagggaacccgcctgaggcctgggtatggcgtgcaaagtagaaggtggggtaggaggtggccctccccagagtgagttggcctcacccaatctgtcgaaggccttaatagaacaaaaagacccggcttcccaagtcagaggggacttcggctgtctgactgcctgtgaatggaagcttcacagggtctccagcttgtggatgacagatccataatcacgtgagccgagcacataataaatctctctctctccctgtgcacatcctattggttctgcttctctggagaaccctgactaaccaaagaaccacaaagcaaggaacgctgctgccaccagaaactggaagaggccaggaagggagtctcccctggggcctccagagcgagcatggtcctgc

SEQ ID NO: 212345 - DNA, 403 bp, Homo sapiens
gccccagtccctgccctcaatgggctccctgtctgccagcggaggcgggcagggatactggcaagtcaagatccggagggatatgtgccaccgtggggcttaggagggacacaggggaggcctgaggtggggcttctaactcagtgcggtgcgtcatggaacgcttcctgaaagaggtaatgtgtaaaccgggagctggagatgagtaagaatgagcacaggaaagggcgagatggggacaaatgtgcaaggcagagagaatggcaggcacagaggcctgcaggcatgggagccccaagtccctgcgaggctttgccgctcctccctgtgcaggatggtggagggggtggccagccctccataaagcactggaattcttctggccgggatggggcacttaggg

SEQ ID NO: 212346 - DNA, 995 bp, Homo sapiens
ctctgtctcaaaaaaataagtaaaaaaagaagtgaacagtaaaagtactgcccacctccctgccaccaccaccctgcaaccccaagacacacactaggtttactcctcagaagtaactactgttcccagttacttgtgttatcttccaaggatttattatgcatatatgtatatatgacttgactgataaaaacagcattagtttgtttttgcattgtgggaagtctctgttactggttgagcctcacataacctcaggaccgggtagagtacagacatggattaaattctggagaactggatgcaatgcctgatgggatgtctcagggtgaaaagccttatcggggtaaccatgatctagagactgggatttgactttttggttcaagaaagtgacgtctctgctggcccaaaactggtcaggttttcgaggactgtctgatgtgagccatactggggagaaacagggatagaaattttcattacagttccagaagcacaggtagtgactggaatattctgccactctggaatgaaggtattcataagagtgatttaattgctgaaaagttgctttagtggtgctggaaaagagaagaagtgagatcattttaatcactgaagggatattagcaggtaaatttgacaggatttggtgatggattggataaaggcagcgagtaaagcaggaggaaaggaagatttgcagattgctggctgtataatgtcagggctggtggcgcctctaattgtagcaagccgtactgggagccttggaagaagtggagaaattatttaacatattgagtttgaagtgactttaagatgcccaagggaggaaaatggggtgtagtggaatgtgtataattattcaaatcctggtgtggttgagatttcttagagaggttacagatagaatgagaagaaaacagaagtactgatggaccctgtaaagatggagagagaagagaaagagaggtaggaggaaatccaga

SEQ ID NO: 212347 - DNA, 527 bp, Homo sapiens
ttgatttgccaccaagattgctctgaatctgtattcgcctttattgccaagtttcttcttaactgggagtttgaaaatataaactttaaccattttttctggataccacagaacccacaacgtattactgttatcagtttacagaaaaacacaatgactaatacgtgactaatgactgatgtagttgatatgagaaagactaatcatatcaatgactaatataggttcatatgagaaagaggaatgggaacctctttattccacatatgcttattattcaacattgccaaatttcaaaaaaccaattgcagcctccatgtgactcagttgtagccacattctccccttttccattaaactgccacacagctcttttcacttatgacctgatagagccaccccaggaaaagagaaaatggttttcagacaatttgtgtctgtaaattgtcatttaacttactttgtttttaaatttttatccctttcgaattttctggagctttgtgaagttagttactacttaataa

SEQ ID NO: 212348 - DNA, 279 bp, Homo sapiens
ccactgtgcccagcctgatttttaataggagcaggaatgctggttgttccctctggtttgataggttccttcatcagattttctttgttgtccctcatgtatgtcacaaagtcaagaaaaagcatggactttgaaattagaggacacagactcacatccctgctcgatcacctcctatttaacttgaatttggacatattttcttaaccttgattaaactaccttatagttgtattgtcagggttgaatacgaatacctttcatcgatagtgttttagc

SEQ ID NO: 212349 - DNA, 416 bp, Homo sapiens
ttaaaaatccagtgacatttttcacggtaatggaaactacaattctaaaatttgcatgaaactacaataggctttgaaaaaccaaagcaatctagaggaaaaggaacaaaacaaccaaacttcatactttatgatttcaaactatattttaagactgtagtaaaaaaaaagatgatacatgcaaaatatggacacaagaaaacaatgaaacagaatagagcccagaaataaacccaggcatataaagtttactaatctttgacaagtgcaccaaaaatacacaatgaacaaagtatagtctttttaatatttggttctgaaaaaactggatacctccaggcaaaagaataaaactagcttatttttcttacaccatgctaaaagttaaattacagacttaaatatgaatccttaaa

SEQ ID NO: 212350 - DNA, 436 bp, Homo sapiens
cgccagagagtgtctggcctcagaagggccagcgagcaaaggggtgttagccccgagcccggatggaggaggcagcagtgtgggtttggatgacagagggaaagtagagatttgggaagaagagggtggaaacagggtgggtctccgtggattgcaggggagggtttgtctgcaggtgtacagggagtgctggccctggtttggtttaaactgatgagggccctgggcacatgcaaatgcgtaaatctatccttcaggcaagggatgaaaaaccgttgaagagttttggcttcttcttcttccttcttccttccgtcttccttccttcttccttcttccttccttccttcttccttcctttcttctttctttctttcttcttcttcttttttttttaatagaagaaaagttacttaagaaaagttatccttgcgta

SEQ ID NO: 212351 - DNA, 557 bp, Homo sapiens
cagaggcgatgagcagccctgatgagggcttgctgcctctgacgacatttcccagacccagggaggtgggtcagttttgcttggtcattttgtgttagcatccagctctttctggccacctgtggaacctcatggcctgtagcgttggttggtatgtgaggattccaactcccagatttgggaggtggctgtagttaatcagacatgactagcttcctgttccagaagcggtcagaatgagtgtgtgcctggggatggctggaaagccagcctctggcttctataggcacctcactctccatgggaagtaatttgcagtctcaaaatatctcctttcaaagtcctttaacttctgttttgggaaattttgctctgaaacccagatgtgcagagaaagcagggctcaaaagatcatttgagaaacagacattacacctttgtttccccttttgaactgacatccacccaccccacggttagctcatgcagttaatggcctgtgtcatagactccctcacatgtctcctgttgtgtgagcgggagcctttctggaatgg

SEQ ID NO: 212352 - DNA, 1274 bp, Homo sapiens
cacggcctggaagacaaccagcactatccaccagacacattgaacgaggcctaataggaccacccggccctagttaagccaccagatggctggaaccacatgggtggccacaggaaagaccaaaagaagaactgctagggtgtgtctggtccaaattgctgactcacagaattgtgagcaaataaaattgttgttttacgccactaagtcctggaagttgttcattacacagtaatagataactgacaaaagtgagagggaaaaacatggagatacatgtagaacttgattcatatctcccctagaaaagagtttgatgtgacttgtaaatatacaaattatctctctcctatagctgcccaagatgccgaaagaagaccaagggcaagacggggccccagcccctgctatcttgaagcaacaggccaagaaagtggtgaatcccctgttgagtaaaggcctaagaattctggcactggacaggacatccagcccaaaagggacctcacccactttgtgaaatggccccactatgtcaggctgcagcagcaaagagttatcctctacaagagcctaaaagtgcctcctgtgatgaaccagttcacccaggccctgggaccaccaaacagctactcaactacataagctggcccataatacagaccagagacaaagcaagagaagaggcagagacttggcccaggctgagaagaaagctgttggcaaaggggatgtccccactaagagaccacctgtccttcaagctggggttaacaccgtcaccaccttggtggagaagaagaaggctcagctggcggtgactgcacatgacgtggatcccatcaagctggttgtcttcctgcctgccctgtctcataaaatgggggtccctgactgcgctgtcaagggaaaggcaagactggttcacaggatgacccacaccaccatcaccttcacacagattaactcggaagacaaaagggctttggctaagatggtggaagctatcaggaccaattacaatgacagacacgatgagatctgctgtcactgggggggcaatgtccttggtcccaagtctgtggctcacactgccaagctggaaaaggcaaaggctaaagaacctgccactaaactggattaaatgtacacggttgagttttctgtacataaaaataattaaaataatacaaattatcctttgaaaaatatataaattaataatatacacaactcaaatgtttgtgtttaaaatactggttgagatcaccatc

SEQ ID NO: 212353 - DNA, 566 bp, Homo sapiens
ctacagaaaatggaaaaaggaccccatttgccaatgagaagaccacatcatcctcagcagagcctacagaacacgcagaaaggactccactggccaatgagaacaccacatcatccccagcagagcctacagaaaatagagaaaggacagccaatgagaagaccacacaattcccagcagagcctacagaaaatagagaaagcacagccaatgagaagaccacaccattcccagcagagcctacagaaaatagagaatggacagccaatgagaacaccacactatccccagcagagcctacagaacatgaagaaatgaccccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgaca

SEQ ID NO: 212354 - DNA, 753 bp, Homo sapiens
agaaaacagatactttcatcgaatccattatgtgccaggcactattctaagagcttcacaacaagcctatgaaataggtgctaccactctttacagatgaagaacggatgcaagttcacacaagcagtgcatttcagagttgaaatcagaaactatatagtttagatccagagacttgctgcacttaaggaacacactgaacaagggaagttctagaattgggcagacctggacttctgtccttgggcatatcacttaagttctctgaatcttctcttactcatctgttaaatggccatatttcacatgagtgtaaaatggagtaaattaggtaagtcctataaagccctgagcaaaaattctcaatcaatattagtgttgaattaagtttcacttaaagctgcctccttgcatattttaagttcaccctgacagtttttctgtacatagtaaactataacctaactggatgtgtaaacagactgtaacctactcctgtgccactcacagttttggccaatcaaaggtggccaaccattcaaaccatgttaaaataaggcaaatgctgggctgtaaccaacacttccatttctgtacctcacttctgttttttataggtcattttcctttttctgtccataaatcttctaccaggcagctgcaccggagtctctctgaggccactctggctcggaagtctgcctgattggtgaataattctttgctcaattaaactctactaaatttaatttg

SEQ ID NO: 212355 - DNA, 346 bp, Homo sapiens
ctactttccccacttctccaaccaaaaattaatttaacttatttctctatgtacattcataaatgattcttgtctttgacaggcctttatctccatctatgtatctgtaagcttttaatggtctgatactgaatctgaccaaatcactctgtggaagaatggttaagtgttaaacatttttgaaagcagaggatactttcctcaactgaattcatatacatatgctcaggagcaaacatagagaagagagagagctgattgatgaggaggtagaagccagaactcttcttggtggcagccctagaataattgtgactggagagaattactatattttgcaatcagt

SEQ ID NO: 212356 - DNA, 500 bp, Homo sapiens
ctttaatttctgaccactctatgttatatagccagataaatctccctccaactagaatcacctttgcaccaagaatcaccttttcttctagtgatgagtaacagatatggggagaaacagcttactacatatggatgaataggaaccatcaggatattcaaatctggtctctggacaaaacactccatatccagctcacacatacaaggccatcctatgcctccttactatctgctcatatttcccacaccaacaagtcacctggtatctcaacttaattctttctgctatggtctagggtgtgttgacacagttttaggtaacattatcaatgagaaatgctcccatctctgatgttacttctctctctacctaggcggtccttccccagatcccacagagcccattctctctcttgcttcaggtcattactaaaaggctgccttatcagcacagccttccctgataccctattgagaactacaatacccacctccaca

SEQ ID NO: 212357 - DNA, 1191 bp, Homo sapiens
gtcagcagccccgacagccgacagtcacagcagctctgacaagagcgttcctggagcccagctcctctccacagaccacaagcacccagcagagaccatgggccccccctcagccgctccccgtggagggcacaggccctggcaggggctcctgatcacagcctcacttttaaccttctgggacccgcccaccactgtccagttcactattgaagccctgccatccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagcaagtataccccaatggatccctgctgttccaaaacatcaccctggaggacgcaggatcctacaccctacgaaccataaatgccagttacgactctgaccaagcaactggccagctccacgtacaccaaaacaacgtcccaggccttcctgtgggggccgtcgctggcatcgtgactggggtcctggttggggtggctctggtggccgccctggtgtgttttctgcttctctccaggactggaagggccagcatccagcgtgacctcagggagcagccgcccccagcctccacccctggccatggtccctctcacagatccaccttctcggcccctctacccagccccagaacagccactcccatctatgaggaattgctatactctgatgcaaacatttactgccagatcgaccacaaagcagatgtggtctcttaggttcctctgggagctgctcttgtgggttgatggagcgtccccgaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctg

SEQ ID NO: 212358 - DNA, 1606 bp, Homo sapiens
gaaacccataagtctgtttattaaatctcaggctaagaatactatacacaccttcattttattttgtcataattcttgtgaggcattccttagatgggttcagtatttaattttaaaagacaaagctattaagagaaaacataatgttactgggttttttttgtcacttttcttggctctatcaaattagaagtgcttgagatgtgacatgaccaattgaaataacatttccagattttgcagacttttgtaggaccatcttggttttacccagacataagacatctgttttcataggcttaacagtcttattctcattctttattttgctcagttctacttccaaacatatgaaatgaaatgacaaatgacatgagtgctatgtaattaggagagaattattttacctcagagagatttttcatcctcatttattttatattaagcatagcacactttcaatttcattttccttcttttgaatttttatcccatctgtttaggggattttaaaaacttagtctttaaaatgacttctgataagcagtagctgacttttttaaaagaaaatgtaaccaaaaattgttactttattcctgtgaagtatattgtaaagataggacatggtataatgtattggagtgggttttggtggtgtttttgttttattctgttttcttaactgttacatgatggcatttaataaagcatctgtaacattctggattaatcttaagaagaactaactttttctttgggcaacaagctactctggaaataataattttccctatgttggttatttctcatggcagccttccactgcattttctttgtttgggtactttcttttcttcctgccgttcttagctttctatttttcaacttgagtttacaaaaggatgtgtattcaaagggtttcctacagttcccagtaccttgttaatcctgagaaattacccagtgagccaattctcacagtaaggtataaaaatagtcatccagaaagattacagaatgtggtaccactgtggttttaactaatggaagacttttaaaaccaagatggggagaagaaaacagcacaaatgttactatttccttcgatttttatctgcacaatctattttaggagagccttcaaatttaaaaaagtaatagagcttcaccactgctttattggatacactcaaagatcatcataattggggacaagaaagaaatcacctgcaaataaatcacaagaacagagcctacctgtgattactattgagcatatatccacaatgttcatttaaccaattttattccacaaatttagtccagcattttattgagtgctttaataagttctggtgtgtgaagttgggtggcttaacttctctaagtctgaatttccatattgtagaataaggaagtaattaacctttttttattttaataaactttattttcaagaacagttttagatttacagaaatactgtaaaaatagtacaaagaattcctgtatactctgttattaactctattattattaccttgtattattatggtacatttattataattaataactcaatattgagatgttgttaactaaattc

SEQ ID NO: 212359 - DNA, 814 bp, Homo sapiens
tcacacttctctctgcaaaaacaaatatagcacaggaagagtcacttgtgtagtttaagagacctcaatacttattgaccgctatatggaaaaaagttatttttgcaaggccggagactgccacagtgctgtggtcagctgaccaaactttctaaagagaaactacacttcctggtgaaccactaactcctacaccctctgaaaatttcatttttccctttattaccctactaaaattacttttagcaagtcaccaataatctccaacaggcatcaaaatcttaatagcttcaattcctatgaagtatttcatatagatgattcaacagacacaattttacatccctgtatgacttagcaatccactcgaaccattgtgatggctactatcaaaaaaccaaaataggctgggcacagtggctcataactataacccaagcactttgggaggccaaggcaggaggatcgcttgtgccacttgaggagttcaagaccagtctgggcaacacagcaaaacctcaactctataaaaaacaaaaaacaaaaaacaaaacaaaacaagccagaataacaggtattggcaaggatatggagaaactggaacccttgtgctctgttgtgaaatgtaaaatgatacagttactataggaaacagtacggtggttcctcaaaaagtaaaagtagaattatcatatcattcagcaattccatttttgggtatataccccaaagaacggaaagcagggtctcgaacagatatttgtacaaccatgttcacagcaggagcattcacaatagccaaaaggtggaagca

SEQ ID NO: 212360 - DNA, 168 bp, Homo sapiens
gtcagactggtctcgaactcctgacctcaggtgatcaacccgccttggcatcccaaggtgctgggattacaggcatgagccactgcgtccagctaaaaactcattttcaatgctatatataataatttggttcttataagagcagacagaagcctacttagtcctata

SEQ ID NO: 212361 - DNA, 398 bp, Homo sapiens
tctaaaaatgaattggttataaaggatgaagaaaggaaggaggaaagggagagagagaagcccttatagagtgggtgcatttcttgtatgtggggccactttgtaagaacaggatttttcaaactgggcccatactggtatgtgtgaaatcaatttagttggttatggccatttttttttaaaaggaaatatcagtgatcactatagtgtaagtatattgtttcgtgaaagccatcttagttatgtattatgtctgtatgtgtaagattgtgatataaaatgtatttctgtggttaaatattcaaagaaattggagaaccattgctacaaggggacagaggactccgtgtgagctctcctgccttccctgaataaacttacacaatttagtgctggga

SEQ ID NO: 212362 - DNA, 201 bp, Homo sapiens
gccttttctacagaggatatgatttgattttttttaaaagacatttatgtgataaccttaatataaagataaaagaagatcaggaggggctgggtgcagtgggtcatgcctgtaatcccagaactttaggaggccaaggagggcggatcacttgaggtcaggagttcgagaccagccctgtccaaaatggcgaaaccacgt

SEQ ID NO: 212363 - DNA, 442 bp, Homo sapiens
gcaggtaaggaagctgtttaaaacttagagttaacccactgtggatatgccttaaaactataggtaaaccactgtgggtatacctacagatacaaagccaaaaagataacatgaacattttgagactctgagtatagaaactgtaaattaccttggcatggttaacagtttactgcattaggctgataactttatctgacaatattgacattaaataatccttattgatctgatgtcatgctggggtcagtcttcacattggatatggcagcatttgatggagaaaatggattcagtgctgaagtttattccatttatataagattattattctctttagtttgtttaacattttggtttgacaataagtatcactttttagtgctaatactgtgtctttccaatactgttcaaatttctatagattttcttattaatattt

SEQ ID NO: 212364 - DNA, 275 bp, Homo sapiens
aatatatattgtgattattaaaaattgcttcatgagtgaaagaaaatataatgcactggctttataaggacatcatgaaatttgcagttaagtggatattggctttttatttttgtcttccttctggaatgagggttgaaaataaatttgtaattgggtcaggctcagtggctcactcctgtaatcccagtgctttgggaggctgagacaggaggaacacttgaggccaggagtttgagaccagcctggacaacatagagggaccctgtctctta

SEQ ID NO: 212365 - DNA, 339 bp, Homo sapiens
tgctgtgtaaggtaacatattcacaggtaccaggtgttagaaaagggacttctttgtgggaccattctacctaccatggcttcttattaaaatagatgaagaaatagcttgaggaaaaaggaagagttcaaagcactgtatagaagaggtggtcaacagaggtttcatttttgactttgataatagatcaaatgagtttcaaaataagaataactttggggctgggtgtggtggctcacacctgtaatcccagcaatttgggagaccaaggagggtgaatcacctagggtcaggagttcgagactagcctggccaacatggtgaaatcccgtctctact

SEQ ID NO: 212366 - DNA, 243 bp, Homo sapiens
ccaactttcagtcaagtgctgcatggagaaacaaaatgtgacattagtaaaactgaacaacattcagctctaaaaaggaatgaaatacttattaatgctaccacatgactaaatctcagaaacattttaataaatgaaggaggtcagattcaacggaataaatatcgtacgatttcatttacatgaaatgtctagaaagggtaaacttacagacagaggatatcacggtagcctgggatggga

SEQ ID NO: 212367 - DNA, 213 bp, Homo sapiens
gagccgagatcgggccactgcactccttcctttgcaacaagagcaaaactccatctcaaaaaaaaaaaaaaaaaaaaaaaaagtcttcagtggtctctcattgaaaatctaaacccctcagtcattcatggcattctgtgtctcggccctatcctactttctcactttatttcttgccatttcttttaacgagcctttcttgcacttgctttc

SEQ ID NO: 212368 - DNA, 347 bp, Homo sapiens
ttgataattagaacctaattcccatagagcacccatgtcataaatggtcctatctagccactggctgtattttggatatgaagtctgttctacagcaccagaaagcaagtgggctgtctgctgttgatcatgactagcagtctaaagcagttaataactggtcatattctactgaaatgaaagatgctattttcattgtatctatcaaccaaaccttagatgtcaaatatattttgagaaccagataaaaataatgacatgaaaggatctaaaaagaatccaagagggaaacaaaaaattgaaattcagtttcaaaatagtcaaactgattttagtaactagtgtaa

SEQ ID NO: 212369 - DNA, 194 bp, Homo sapiens
acctgaactttttgtgaacaggagaagctgacttcaactctgatagccgtggcaaccatacacttgaaatccaaccctgactagattcatagaaatgtggttaatataggcccagcagaatgtaatgtgtgatcgtctccatgaataaaataataaacacaagaaaataaattacaagtgaaatgcaaactgga

SEQ ID NO: 212370 - DNA, 430 bp, Homo sapiens
tgtatagaatgacatagggcagagtcaggacagccctgagcaccagctgtgtcgcttcaactccgttccttttttaaaatgttaattcactaggaagaccaatttctttaaacacctctcttgagacatgagaaagaagataaaagtagaagagttttgccacctctctttggaaccaagtgagaaagacaagtgttaatgatgagctgaaataactccccgtgtgagtgataactaacgtcctaaatcttggtcccagtgattacgactgaagcattcatatgatatgagctgggtatactctaggacaccgagttttttcatgaagttgaaactcttgcatgctgtcagggagtttgcgacagtctaggtactttaaacaaatgcgcttactaattgtgtaatgatgtcactgagcttggcaccccat

SEQ ID NO: 212371 - DNA, 305 bp, Homo sapiens
tgtatagaatgacatagggcagagtcaggacagccctgagcaccagctgtgtcgcttcaactccgttccttttttaaaatgttaattcactaggaagaccaatttctttaaacacctctcttgagacatgagaaagaagataaaagtagaagagttttgccacctctctttggaaccaagtgagaaagacaagtgttaatgatgagctgaaataactccccgtgtgagtgataactaacgtcctaaatcttggtcccagtgatttaacattttaaaaaaggaacggagttgaagcgacacaggca

SEQ ID NO: 212372 - DNA, 511 bp, Homo sapiens
cttcacaattgaggtgagcatcactaacccgtacggttttcttgaccaaaactttcagtgctctgtttttcccatctgtaaataatgttcatacatctaaatcctaggaggttgcagggacagtggcttagaaagtcaccacattctctaaaggagtgacagagaggatgaaagaagcatgctctataattaggttttattacatgctttttaaggttaattgaaggacttcccagcagcttccctagccactttttcaaatactgaaagcttccagaaagcagcagacaggtgttcctcacaatctgacacagacttcagttactgttgaaaagtgaaagagggctgggcgcggtggctcacacctataatcccaaagtgctgggattacaggcatgagccaccccatgcccagctggaattttttaacttaaaaaaaaaaagtttcagtgtttgtccttacccattatgtgcccagttagttctataccagtgaaagttccccccaaaa

SEQ ID NO: 212373 - DNA, 788 bp, Homo sapiens
ctggccagtgaaaatttttgtatgactgcagtccatagcattaacaagctaaaatcaataccatttatatatacaaacagcaaccagctagaagacataatggaaaataaattccaatttacagtagcagcaaaaacaactaaatacttaagaatgaaattaataagtactacacaatctacatggggaaaattaagaacacttttgaaagatacaaagcagacctgtacaaatgtaaaatgtgttactcttggataggatgagttaatataatactttctaatttaatttataaatttaacacaatcccaataaaaatatcagtaagcttttttacagcattagaaaagttgctactaatagaacttgctacgtaaagctcatagggaaaagtaaatatgtgagtataaccagcaaagctgtgaaaaggaaaaactatgagggcagctagcgttaccagatgtcaaaacatactataaagcctttacaagtaaagcaatgtgctactggtacatgaattgacaaactgatcagaggaatgactagaaagcccaaaaattgactcaagtacatacagaaatttactgtatggtaaaggcatctcaaatcactggtcagagatgaacttttgaattactagcactgggacaagtcgtagccatttataaaaagaatgagaccacaccatatacaaaaacaacctctaaatggattaaggatctaaatgtaaacaacaaaaccatgtaagtattagaagacattagtgaattcttctgtaatctcagcag

SEQ ID NO: 212374 - DNA, 629 bp, Homo sapiens
gagcgtccgctggctccaacggagaagatccgcgcaaggcttgtaatccgctgctggcaaggcttatttgacaaggaagttcctgcgctgcctgtcctctgagcatccagaggccccttttgagacttcggcagcattaaagtaaatccagcaacggggaggattcgcgtggacttgcttgtggagacaggaacctcagaaccagcctgggtcttccagcatctgcttatgtaacgtaggatttcagagctctctgccctctggttattttcggtatttaaaacactctcattcctaacaatcggaaaacgtcttggtgccacagttctttctcagtgtgtcttaaacattaagagaggattcaaccaacaagtggctaaaggatcagtctgaaattactaagaaatgcattcagagaaagaaaaacaagctcctttcgctgctgagtggtgactcacttcctagcccaagcctgatttttgccaccaaaggaattaaagcattttaaaagagaacctgagacttggggtgggagatacagtaccgggagggggaaaaggcgggaatgggaggggggagggatgggtaggctggaaataataaaggaacgaacttgtactgaatatgta

SEQ ID NO: 212375 - DNA, 1011 bp, Homo sapiens
agaaaggctatttaatatgatcccaattagagggaggaggatctgggatggttgttggaacatggcagacgggggagacccggagggaataaaccaccccaggatgctgtgtgaccacctgaccctctgcaaagcagcatcgtggcactctgttccctttcaaggttcccacagtgagtgccacccatttttaccacaatggcaacaggatttatgctcccacccactctcagttctgaactttctatggctttgcccctcattggtcataaaacacgtgtcacctgcctctctgacttggcttttcttgcaattacatggtttcctttgcgatcttcctggccagtggaagcagaaggatgcttttacagacagggtattatagatgggttggcagatgaggtgatttctgagggcctggcacaatgcccaaagggacgtgagtcagctctcagaggaggtttggtttttccttccaaattcatacaaacagcagtgaagtttaaaagatcctcaagtggattacaacccccattcatttggcagcagaggagcacaactgtcaaaaagtccaggtactttaagctgtggaagaggcacagagtcactctcaagttggacagggcttcaagctatttccaaaatttacattcggggcctttcgttccctttcgaggttcctttgaggaatgggtgaaagccacctcttcttgaccacagcagtgactggatttatttttgtcctgtcttcctcctccacattctcagttctcgaggctttttattgtttttggttttagccaggcttgggctggttgcttactctccggtgtgcagggcttctagaagtgttagccacagccagcgggaggcagccgatcacccatcccacctgctgagtgtcgcgggcagacatctgttgagctcctccccagcaccagccgcaagaatgtacctgatgtggtctttgtctgcaagagctctcagtttagagcagtctttttgagaaaa

SEQ ID NO: 212376 - DNA, 270 bp, Homo sapiens
cataaaaagagatgcaagggccataggagaatactagatcttaagtctgtggaactgcacagacccaaatgtatatttaatgtattttaaatgtttgtttaatgagaatagctggcacataatactttattattgaaatcatatttatatgtcacctcatcagaatgttacttctaaaaaaatgtgggcttcttgcgaagtcccacagtggagtgagtggattaaaataaccttgttaaataaagctgtagagccagacttactgggtac

SEQ ID NO: 212377 - DNA, 172 bp, Homo sapiens
cagacagtaaatgaaataggagaaaagaacagtaatgtgagagagaatgatttagttggggaggatactattattattatttttttttgagacggagtcttgctctgtcacccagcctggagtgcagtggctcgatctccgctcactgcaagctccgcctcccgggttcacg

SEQ ID NO: 212378 - DNA, 393 bp, Homo sapiens
ccctcccagctctctctcctcctgccatctcgtcccctgctgggctcctgctgggtgagtccatttgccggagggtccagagccggtgacatctttacccagggtaggtgacaaacgatggggtcagggcctgcagaagcaaatgtgagattacccattatctgagtttcccttctggaatattctgcaaagagtctcctgccacactgacctattctttcctcaacccaagacacagccgggatggaggcctggctgtccctggaatggatggcagatgcactcatacttggaagcttcgggaaagcctgtcaggctgagccaggtgtgagcaacaggccacggtgtctctgccccatcaaaagtggctgctgcttaaatctaagtcattat

SEQ ID NO: 212379 - DNA, 191 bp, Homo sapiens
tcaggccctacaccaccctacactcaagctctacacaactgcttcctgtaattccatgggtctgcatgctttggccacagtgttccctgtcatcttcctcccccactgactttacctggccatactaccctttcttaaaatttagcaaagcattacttacttaaggaagctttcctagattctctcacaca

SEQ ID NO: 212380 - DNA, 859 bp, Homo sapiens
  misc_feature (46)..(46): n is a, c, g, or t
  misc_feature (48)..(48): n is a, c, g, or t
  misc_feature (50)..(50): n is a, c, g, or t
  misc_feature (95)..(95): n is a, c, g, or t
  misc_feature (97)..(97): n is a, c, g, or t
  misc_feature (110)..(110): n is a, c, g, or t
  misc_feature (131)..(131): n is a, c, g, or t
  misc_feature (136)..(136): n is a, c, g, or t
  misc_feature (138)..(138): n is a, c, g, or t
  misc_feature (145)..(145): n is a, c, g, or t
  misc_feature (148)..(148): n is a, c, g, or t
  misc_feature (152)..(152): n is a, c, g, or t
  misc_feature (155)..(155): n is a, c, g, or t
  misc_feature (157)..(157): n is a, c, g, or t
  misc_feature (162)..(162): n is a, c, g, or t
  misc_feature (172)..(172): n is a, c, g, or t
  misc_feature (195)..(195): n is a, c, g, or t
  misc_feature (201)..(201): n is a, c, g, or t
  misc_feature (212)..(212): n is a, c, g, or t
  misc_feature (214)..(214): n is a, c, g, or t
  misc_feature (221)..(221): n is a, c, g, or t
  misc_feature (223)..(223): n is a, c, g, or t
  misc_feature (243)..(244): n is a, c, g, or t
  misc_feature (247)..(247): n is a, c, g, or t
  misc_feature (249)..(249): n is a, c, g, or t
  misc_feature (256)..(256): n is a, c, g, or t
  misc_feature (276)..(276): n is a, c, g, or t
  misc_feature (278)..(278): n is a, c, g, or t
  misc_feature (282)..(283): n is a, c, g, or t
  misc_feature (285)..(285): n is a, c, g, or t
  misc_feature (295)..(295): n is a, c, g, or t
  misc_feature (298)..(298): n is a, c, g, or t
  misc_feature (303)..(303): n is a, c, g, or t
  misc_feature (305)..(305): n is a, c, g, or t
  misc_feature (311)..(311): n is a, c, g, or t
  misc_feature (319)..(319): n is a, c, g, or t
  misc_feature (321)..(321): n is a, c, g, or t
  misc_feature (324)..(324): n is a, c, g, or t
  misc_feature (345)..(345): n is a, c, g, or t
  misc_feature (363)..(363): n is a, c, g, or t
  misc_feature (375)..(375): n is a, c, g, or t
  misc_feature (378)..(378): n is a, c, g, or t
  misc_feature (381)..(382): n is a, c, g, or t
  misc_feature (394)..(394): n is a, c, g, or t
  misc_feature (475)..(475): n is a, c, g, or t
  misc_feature (499)..(499): n is a, c, g, or t
  misc_feature (505)..(505): n is a, c, g, or t
  misc_feature (522)..(522): n is a, c, g, or t
  misc_feature (535)..(535): n is a, c, g, or t
  misc_feature (551)..(551): n is a, c, g, or t
  misc_feature (554)..(554): n is a, c, g, or t
tggcgggggcgcaaccagcgggccgaggcggcggcgccagcggccntntnaaatagcatccagagccggcgcggggcagggagtgggctgcagtnanagccggcggcggnagcggccggtccacggagganaattnancttaaanaantatnaananaaganaatgcaagcncatgaactgttccggtattttcnaatgcnaaaactggttnanttccganantacgtgcgtactcttccgannaanangcttatnggcttcggagcttttgcagnantcannancttctggtangcnacgananccaaanccctgaancngcnatgcgacctctccatgcagtnagtggaagtggcgggtantggtggtgcacnaanatnngcactacttganagcgacgagcccttggtgataatttcaaataaatgaatgtcacaacaattaaacagaaggctttccagaaggggaatacanggtgtcaaaataaatggccccttngtttanggctctcggaaaaccangaccaaaccctantgaactggcgtttcanaanaaacagggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatag

SEQ ID NO: 212381 - DNA, 145 bp, Homo sapiens
ttgcctagtatgaaaatatacccaataccaccttctttattgctgactgggaatgtcctctcaaagctcctaaaattcttgactgtctccttttttgcctttctctagctggactattttgattatacccttctgtcgtcttctc

SEQ ID NO: 212382 - DNA, 656 bp, Homo sapiens
caggaaagtggggatcgcgcagtgcgtactgcatggcactgttgccaggatcaagacaaggtacctaaagctcgaggttcgacgtatgtaagtttggtgacatgtgctaagccaaggagtatgtgaattgtgctcacctgagtgtaaacgcttgcaggcagatgattcacttcggtcactccatgcagccacacatgatggccacacaacaaacgtgtatccccaaatgagatctctaagccatggctctagcagaaggctgtcaggatagaattggtgccctggctctggatggagaatgaatgggcagggaaaagctcagaggccaggagatgagttaaaaggttgctgtcaaatcccttaagagaggatggagcctgaaccaagcaggggtcttggtggcaatggagagagaggacagaggcaatgaagagaagaaggctgatggccccggggaacagctctatgttgggggtggaaggaagagtattcaggaaggctcccaggcttctgtcagggccatgagataggaacccaggtggaggaagagatttgggctggggttgggaaaagaggcttgagatcagcttcagaagggctcaaatggaggtgcctgtggagtatccaggggagatggcccttagtgagctggtgtt

SEQ ID NO: 212383 - DNA, 377 bp, Homo sapiens
gaaagagaagaatctgatttttagagtttctacattatatgaaaatgtccaattgccaaaaaatgtaaaagacgtgagaagacacaagaaagtgtgactcataagagagggaaaaaatagtcaaaagaacctattttatgtatttaagaagtgatggaagccatgtctaaagaactaaacgaaagtgctttttttcctgaataaagaaatcagcaaagagataggaaatatttttaagtaccaaatagaaattctggagttgaaaagtatagtaactgaaatgaaagtaccttcatggactcaacagtatatttgagcaggcaaataaataatcagttaaatttaagatagattcatagagattatccaatctgata

SEQ ID NO: 212384 - DNA, 947 bp, Homo sapiens
ttcatctatttattcctagtgtattcagttaattgggagattgggaggttttttatgtcaagaaactaatggttatgcatattgatatttacagatttgcttatgtatgtatgtatgtatgtatgtatgtatgtatgtatgtatgtatttatttttgagacggattgcccaggctggagtgcagtggcattatctcagatcactgcaacctctgccttccaggttcaagccattctcccacctcagcctcccacgtggttggaactacaggcctgcgccaccaggcccggctaatttttgtgtattctgtagagatggggttttgccacgtttgctggactggtcttgaacttctgacctcaagtgatcctcccaccttggctgagccaccacacctggcccaaatttgctgatttttaaagtgattttgtccaatgcttttaagcctctaaacccagatattcgataaatgcttacttctagatcctttaaaatttgttgataattactaacaatgggataataataatgacaacagataccctttattgaatgactacttggagccagttcctgggatgagtatttgttatacattatatcattgattacacagaaaccttattattagaaactattattatcccaattgtaaggatggaatactgaataggatgcagttctgaatagcgagttgcccaagctcacaaagtatgtgatggagctagagattcaaacccaggcctctctggctccttctttggggtgggcttgctctgggaaaatatgctatttctaaggattgacactgggtacatttaaacttgtcatgcacacaaattcatgtatgattaagaaggaccctttgtcagacccctcactttcacttacgatctagagttactgtcattctacattcaccctggatgccctgtagacagatcagg

SEQ ID NO: 212385 - DNA, 516 bp, Homo sapiens
gctttctcattaggaaatgttcgcatgccctcagaaaaggtgtttggaatagaaagactccccggaatcagattaaaatgccagcagagttgagtatgttcttccccattttgagctagttaaatgagaactcacgccattctccacacagggaacttcttaggtaaaactattaaagccatggaaccatttacttagtgtggttattaaaatcctatggcactctggtgaacagtgctgtggactggcagccagaatatcttttccaattctagcccctatatttcctggatttatagaagcaaagcaactaggaaagctgtaggtcttctcacccattttgtagatatttgttgagtacccaatgttttaggcactggagtacaataataaaccagatctagcacagtccttgccttcacagttcagagtcatgaaggaaacaaaccagtaaaaaggcaattgtaacgtcatacccattagcatggccatgataaaagagagagagagaggagg

SEQ ID NO: 212386 - DNA, 431 bp, Homo sapiens
caggaagtatataatttgtataacacaactaactgttcatctttctgtgaagtgtactcacttcacagtggggacaggcttatggcagtagctgtacaactttgaaaatctgcctttgtctcttatttattttgaaatgggggtctttttaaactccttaaaacttgaagtaagtctcagagaccccaactaaaactaccaattaagtttgcacaggaaattttattttccaaatgtaattacagggcagatatttcaggatgtatatatgtgatagtattttaataatttgttgagccttaaggtacagtatcaaatactgctcattcctaccagtttggaggggaggggtggaaaagatagggaagcagaatggaatgacttattcaactttccaattctttaatatagcattgacctttgtaaaaaaa

SEQ ID NO: 212387 - DNA, 157 bp, Homo sapiens
acacccagccagatttagtgtaattcctaagggccctaggatttctggaatcataaagtcaccagctgcatttagaccctaacaggagagtcagcctgtcctttgaagctttgaagctaggcaatgatttctcctctctagctatgaaaatcctaga

SEQ ID NO: 212388 - DNA, 749 bp, Homo sapiens
catatgggagaatttgctgactattctctttatgttggtaaatgtttgaaaattttcacaactaaaaaaacaaaacaagtccgggcacactggcgcatgcctgtaatcccagcactttgggaggctgaggtgggtggattacctgaggtcagaagctcgagaccagcctggccaagatggagacaccccatgtctactaaaaatataaaaattagccaggcatgatgggtgggtgcctgtaatcccatctacttgggaggctgaggcaggagaatcacttaaaaccaagaggcagaggttgcagtgagccgagattgtgccattgcactccagcctgggcaacaagagcaagactccatctcaataaaacaaacaaacaaacaaaaaaacccctcacaacaatgctataagtataaccatcccatcttacagataatgaagctgaggccagtggaggttatggaacttgcctaaactcaaagtaagtaattggtaagatttgggtttcaggtttgggtctgtctcacttcaaatcctgtgtgtttacccatcaacacaaagaaaataaagaagcacgttatgttcacttctgctagagtagcagaaggaaagcctaaaaccttcctcagcccttttggaatcgacaatttaaggcgagacatggaacacgtataggcaatccccagagctgagccttaggaagcatggctgcagcacacacaggatgacttgaagaggggacaaagaga

SEQ ID NO: 212389 - DNA, 594 bp, Homo sapiens
actatctatgacatgacaagcttgattaatttaactgccctcttggaatctccaccactatcatgcaggggctggcctgtcaatgataggaatatttttacattgtgacacattatcataaatttaatattttagttactttggttaatgggaaagtaatgatgttaaaaaaatctttctaaaatataaaagtctacattcttcggtaaatacagtgtattagatataattaactctctgttcaaagattcaggatatttaattgcctcaggttttttttttaataaatttcacttttcatttgaaatcttttagccataaataatgcaggtgtttaagaattgagactgaatctggccgggtgcagtggctcatgcctgtaatcccagcactttgggaggccgaggcgggcatatcaggaggtcaggagatcaggagatcgagaccatcctggctaacacagtgaaaccccatctctactaaaaaaatatttaaaaattagccaggcatggtggcaggcgcctgtagtcccagctactcgggaggctgaggcaggagaatggcatgaacccggaagttggaggttgaagtgag

SEQ ID NO: 212390 - DNA, 686 bp, Homo sapiens
ctctacactcagtgatcaagcttcatgtatactttgcacttcagcagactttagataatacgattgataatattcataaataaaccatctcctataataactctctggtaaaactttacctctgaattaattcatttcaaaaacaattcatgctcattgctgggggagaaaagaaatgatacagaaacatatcagaaagtgtatttttgtctactaccaatgcttttcccaaatccttattagtgatatactgtggccagtttgatggttttccttacaaatctttatatgtgcatatctgtgtgtgtatttaacgtgctatcttattctgttataaataacatcacactatataactttttttcatacttaataaaccttgggaaaatgtttatgtcagtatatatagagtttacttttgaataactgatgttttttaagttactgtctaaaaatacaagtaataggttgggtggtcagataacacagataatactaaaagtgtttaagaactataaagtctcactcctctgtgataactactgtcaacaaaaagtaccttttgggctaggtgaggcggctcatgcctgtaatcccagcagtttgggaggctgaggcgggtggatggcttgagtccaggagtttgagacctgcctaggcaacacggtgaaactctgcctctacaa

SEQ ID NO: 212391 - DNA, 292 bp, Homo sapiens
ttagcatttgccgtgaatccctggtaaaagcctgtaattagctggtaagctggactttctgaacacttgttttcctgtgtgggaggaggatttgtctgcaattttctatcaggtggtttctgcagctgaagtttaaaaataaaaaatgaaaagaggggtaaaattgcttttcaccgcccaagatagcaacacacagcccagagggcttccaggaaattcaggaaggtttactgaaccaaagtaaagtggagctggccactgaggtgattgggcttttactggatgttgggaa

SEQ ID NO: 212392 - DNA, 461 bp, Homo sapiens
tctgagaattagggttggccaaatcattggagacatttgccaatcacattcagattaatttctggttttcctatttggtttactgttagacagctttcttccaaaaagtcttaattatttatccttacttatatccttgccagcacttggtgttactgtacttaagttttggctaggccaatgggcaaaaatggtatcttcttgtttgaatttacatgctcctgatttcagccatgcatggcatctttttcaatatttattgcccatttgaatctcttctgtaaatttcctgtttcacatattttctgtgtttttctattgagttatttttcttagtgatttatgttaggtatttatttgtatttttgatatctaggccagttagcttagtagacatctcgaaaatattttggttgtgcacccctacaaataaaaagtttttgagtatataccctcaagta

SEQ ID NO: 212393 - DNA, 453 bp, Homo sapiens
taggaggcagaccccaccatcacccccattctgcaaagaacggagccgagaaagagagagaaacggctgcccacggccgggaagagcaggaattggaaccagggtttgggtccagaggaggagctctcaccacagcgctgctggaggcctggggcccccggaactgaggatatatcatgaataatttcaagccccttgggtttatctaggtacagggccatcctgaagacagacgccccactctctagaagccattactcagtggggcaaaggacgtgggctttgatgggagacacacaggcggctgtgagagcccagcagaaacaattccgctcccacggctcccgtccatgccctcccactgctacctcagtggctggctcccatctccttcaaacatcgaataaatgcctccctcactgggggataccacactgcccccttcccttacca

SEQ ID NO: 212394 - DNA, 499 bp, Homo sapiens
tgaccacagttaacaacaatgtattatatatttcaaaatagtcagaacagaggacttagaatgttcccaacatttagaaatgatatacttccatttcatatgaatattatataataaacaatatatatagtaataattaactacttaacagatttctttagagtacctttacataatgtaaatttgtgagcattaaaaacaacctacctaggcaacatagggagactctgtctctacaaatatttaaaaaattagccaggcatggcgcatgcacctgtggtcccagctacttgggctgctgaggcgggaagatcccttcagcctgagagatcaaggctgcagtgagccatggtggtgccacttacactccagccttcatgacagagtgcaatcctacctcaaaaacaaacaaaaaaaatctaccagctaagtataaaaagccaagtcaaatatttcagatgtcaagaaattaatacacaatagccgttagtatttctat

SEQ ID NO: 212395 - DNA, 162 bp, Homo sapiens
ttcagctgcaatccctgaaattgccttcattgctctacttgctctgaacgtaatttaaaaggcctttgggactctctaatactttttgcaatgctctactcatcaggacgtctcacgagccttgtaggtctttggtgtttgtcttagtatacgtgtttgaga

SEQ ID NO: 212396 - DNA, 830 bp, Homo sapiens
ggaggatgaggctgcagtgagctgtgattccaccactgtactctagcctggatgacaaagtgagaccctgtctcaaaaaagaaaagaaaaataaagactacagttttgaatttagatagctaggagaatagtagtgtaattaaagaaattcaggaactcaagtaaaatatgaatacaattttggatccattgcatttgaaatgacaataagacttccaagtgaaaaatacttttgaatatgtgatactgaataaaggtgataatttgtaactattggagcagatgagattcccaaatggtgaaatatgaagacagaaatataattttaaggacagaactttgaagtccttagttagagaatgggaggtgaaaatagagtcagggaataacagaaataaactgttcaaggtggacaatcacctgtagggctttccacgtggagaatgtgccttgctttgtttcccggacttgttcctaaacttagggggaagaattcagtcttttatcattaagtatgttagctgtaggttttttataggtgccctttaaagggttgaagaagtgcccttctattgctagtttactgagggattctgcagtgaatgaatgttataaactgtttttttcttcatcaccgcgttcccacatggacgccttctcagacctcgagtcgcacccaatgacgaatcctagggtcgaccacctcggacaggcaaaaaccccacaagggggggcaaatggaaaaaaatcaccaccaggagaggaacccccggcccccgtaagcggaaacgagcagaacaccgcaaccgggcacgcaccagcgcgaccgc

SEQ ID NO: 212397 - DNA, 524 bp, Homo sapiens
tattttttttgagatggagtctctctcttgccaggctggagtgcagtggtgcaatctcagctcactgccacctctgtctcccgggttaaagtgattctcctgcctcagcctcccgagtagctgggactacaggcatgcgccaccatgcccagataatttttgtatttttagtagagacagggtttcaccatgttggccaggatggtcttgagctcctggccttatgatccacccgcctcggcctcccaaagttgctgggattacaggcgtgaggcaccatgcctggccaaaaaatgtcttttttaggaattagaaaggcagttttgtatggactctattgcaactcatgaaaaatatttgaaaatgcttctgttattagttaactttgtttaatgtttattatctgcaatgcagttaaaactcaatattttaaaaagaaagtaaacatatggtctttatcctcatgtattttatctgtgaaaataagtgtgcttaacttctcaactcaaatattaaactgtagt

SEQ ID NO: 212398 - DNA, 416 bp, Homo sapiens
cacttgttatcatactttggacttcttagcatggttcaggaggtttatttcaagtatcaacctctcctacacacacacacgcacaccacctgatgttcctcacagtgagtgtctatcatggctgtaaacgtgttcctgcccaaggaagaggatctctgtaacccctctcatacttcctattgcccaggacactggacctgcaatgcctcctatgagactacatacagtgggcgtgttatggatggctgaagcacagcacggtactgttgtaacaagaaacagcctcttctgtaagggacaaattgccgagagtgcagcttttggtttgagtaaaacagaaaaggagaaaattgacccacatgtgccaataaaaaagaacatcatttaaataaaagacccgtattaaccatttaaaa

SEQ ID NO: 212399 - DNA, 374 bp, Homo sapiens
aactcccggggattaaggcttgcttgcaaatagtattttaaaatcataaccattctcagtatacaactgtctgcatcattttctcatttaatcatctttcatcctaaagaggtattaacctccttaaaatgcctcactgccctacaaactagagatctagggaggaggggctccctaaacaaatttggaaaatggagttccttaggccttattactcatgaaacagattctaacattcctgcaatgaagaggatgggtatggctttttctttttagtctcactctgtcacccatgctggagagcagtggtgggatcatagcttactgtagccttgaactcccaggcacaggtgatccccccgggaagcctccca

SEQ ID NO: 212400 - DNA, 747 bp, Homo sapiens
catgtacaaatccgcttaacagatcgccttctttaaaatgggacatcttatctttcctgaaatatatatattttttgagacggagtctcgctctgtcacctaggctggagtgcagtggcaccatcttggctcactgcaacctctgcctcccgggttcaagcaattctcctgcctcagcctcctgagtagctgggattacaggcatgcgccaccacacctggctaatttcttatatttttggtagagatggggtttcaccacgttggccaagctggtcttgagtatctgacctcaagtgaggtctgcccgccttggcctcccaactgctgggattacaggcgtgagccatcttgctcggctaagaggaattttcttccatgagagatattatagtatgtttttgttttcaggcttattggcattattcagaggaaatatgagaaatggatgatgtgagagagaaaggagatagttgcctaaatgaagaggttgaaaggagagatcgtttatatattgtgataggaaggcagtcagactataggaacagacacaggtaggaaggtaggtagatatatggtgggcacttgtggcacttttctgtttgttactgcttcctatctgactactgctgtgatcagataggaagcaaaattagggacaatgaagaaaggggagatgggatgaaatagttttttaggagagtggtagagggaatagattagggaagtgtattggcagcaccaaggg

SEQ ID NO: 212401 - DNA, 531 bp, Homo sapiens
caccaggtgatgataatttggactgcaagttcatgcatggcttcattctttacctgagaatatagtcctttggagtctcagtttactgtacacagggagatggtatcttattacactaaactttgggtgggccctaggacctgatttctgatccattcccttatgataccatcagaaccaaagttcatatattcttgtgttggcaaatgttttcagggcaaaaatgacttttgtcttctacttgactgtccgggttcccacttttctttcagttttagcctagggattactttcttggcagcttttcaatgcttttagtgattttttttaaaaaaaacaaactatcattacttagttgctttcattgtagaggttgatctgaataacataactgtttctagaaatagacatcattattaaagaaagtaaattaagattagtaatctggtagaaatgactgtttagagggatgttttgatattttcatatatttgatgactttctcaataaatctctgaaatataatgtaaa

SEQ ID NO: 212402 - DNA, 467 bp, Homo sapiens
acaggatgtccagctgccctcacttatcgtgcccctgggcatttgaggggttcagagagagaaacgcagtaacttattaccctcacatgatatattttcactttcttctcctgattgtcagctcaattagataagggaccttgtgttttattccgttgtaccccgtgcctgacacatggtagctgctggatagagatttcttcgatgattgattataaaacacactaatttagagcttactatgttataagatctccatcttcagtgactcacttattcctcacaagaagcctaggaggtaaggttttccaataaggagagccaggcaccccataatgaacgtgcacggtgtcacattcccagcaagtgccgaagctggggtcagattcaggcaacctggcccagtgccctcacagttcatccggcctccacatggccattttgtccatgaataaatgaataagtga

SEQ ID NO: 212403 - DNA, 467 bp, Homo sapiens
cttaacatataaggttaatatgttaccttacatggcaaaagggactttgcaaatgtgactaaagctatggactttgaagtgggaagattatcctggattatcagaatgggactaatgtaacctaatttaatttctcaattttcttaatttgtttctctagccctaccctgtattgacttcttatactctatgttcaaaggtgacaactcttcatgagatgcatcaactgtgttcctcgaactcaggcaggttgttgaagatcacaaggtactagtggtataagaggatgggaggagagtaaagttaaatcatttattcctctggctcctttcctttctggctatgggtttgcagtggttttgtttttctctggccttctcctgaaccatttgttgaaaagactgctctttcccccattgaattattgtattcaaaatatttgaataaaactttaactctgtagaaaa

SEQ ID NO: 212404 - DNA, 438 bp, Homo sapiens
caggctgatgaccagtttccaaataatcagtgtatactacagtgcaacaaaattacaccaattccaatttatctttgctttgtgattcagaagtgcctcagggcattatattgactttttaattgtgtatggaagttaccattaatagtgttccagtgactgcttggaaacaaagagttcattgtattgatttatttatttttgctaatattctttatggtggtttttacagtgtcaatcacctagacaatctggagacttgttttcttttatatttgatttacttcattagtagtagcagtagttattagtatttgctttttgaccatgtttaaactgctataggagaaactctggtaaaacatactcaagtaataacattattccaaaaaataaagtgctgttagaattcaataaactgacgtttactaaaactaa

SEQ ID NO: 212405 - DNA, 469 bp, Homo sapiens
aaaaaaaaagaaaaggaaattttaatgttaatttaagaaccatggaggtagcagtgtgccaaccagcttcttgctaccttggtctggacctaagaatctataggcagagccctgctggcattctgtaggctgctgttggaattttgtctgaatctccttaattagaattcttctgtagctggttttgtggtacctgacagaaacccagagacctggcaagttaggacaatgcaaaactctctaaccctattacaagaaaaactctcaggagagaatctttctccctcttctgcatatcgaaatatcatcatggaaatcatggctctgacactgtagagaccagaaagtctaaaattctcttatgctttttgatgaccatactttttagaatactgtttttggggaaataaggggaagtaggaagagccatttttagtttattattttattttttaaatcatctctccta

SEQ ID NO: 212406 - DNA, 432 bp, Homo sapiens
tcgttggtgttcttaaattattttcaggtcctctagaaaataagataattatagcaaaaaataaaattgttttgaaattttgataaatatataaatgtatagaacctatttttttcaatgaaagaaaatgggaaacattttttaacattgctagattggcagtgctttcttttattatttcaagttatggaaatttgcacagttgaaaactggggataaattctacaaaagtgcaagaaaacaattcaaattagccagagccctgctaaaacttttaatgtaaaatttatttatttgcactgagctgttttaccttctttaaggccattgggacctctcaatgatgcatatgtttcatacatcttgtattttccaggtagaagtcagacttggttaataccaataaatacttctgtaatcctaaaaaatcag

SEQ ID NO: 212407 - DNA, 366 bp, Homo sapiens
ccttggtgagggtcccagcactgcgggcagccaagagctctggcagtgtgcggtcccagacacccaagaggcctccccacaggcgggtggcacgcccaccacccggattcctagggtcttccacctccgaccacagcccttgtctgccgtccagcaaggagcaggccctgctggtgttcccgggttccccggttgtgcgccccaccccaggcccctttcccatggctgcctgtcccgcggctcagggcagccctccatgtacagtgctgcctgcacagagcctgtggcatgcaggccccaaggccgtggggagagtccggggtcactgcagacccgagccccctttcttccatggagtcaggcctg

SEQ ID NO: 212408 - DNA, 376 bp, Homo sapiens
ctcagcctcagggctgatccaccatcctggcctcactcatcttcccccaaggggagcgttgaatgccgtccacctttgcctgcttgattcctagttttccttgagtctccagctgactggcattccctgtccagccaccaccttctactggtgcctgccacagctaccatctcacttctgtctgtgttacttaaaattcatcctgcttccactgaagctggggatggcgggggcagcagggaccgcatgagaccaaactaactgatgtgaggacgagtgggttcaaacaccagcttccaaccgcgggagccgggcagtctccctcctgccatgtcctcgtttgtaaaataaactgcttcagttgttgtgagatcaa

SEQ ID NO: 212409 - DNA, 401 bp, Homo sapiens
agaggtgagtttttctctttatagtttaagttttaatggctaaaccatactgaattgttccattaagtaagcttattatagtaagctatatttatcatctgcatgttagtacttgagaatttttctatcccttttaatgactgttgaattaatgggaagcaatgcaggttctggtttgtgtcattcttagactaattctatctttaagctgtcagtgaaaattgaaatgttgcagaccttactgcacaaaaagcacattttcatacttaatttgggatttatatgatagtaagggctggacttcattccatttttcagatctcattcacatgttttgctgcagtgcttgttttattcatcaacattacttaaattcactaggagaaggttcatgccatata

SEQ ID NO: 212410 - DNA, 398 bp, Homo sapiens
ataccctggggcctgggcaaagggcagattcctgctcaaaactgctcaaaatgtcagggtgggacctgaggttctgcatttctgacaagctcccaggtgatggtggtgtgcctgggggaaccacattctgccatctactatccagggtggacaaaaccacaaggcaggggagtttcctggtcacccaggggtcaggacgtggggacagagatctagcctggtcagaggctcccaggcccccattcaggctttgaagtctcagagccccagacccgcccatggcactgggagaccagtgtcaaccagaggggctgtcatgagtgctaagacctggggtcatctgtaccaccccagggcagggaagcaccagcccagatataaaatgattccaagacagt

SEQ ID NO: 212411 - DNA, 420 bp, Homo sapiens
acatattttttcccagtgcctccagaaagaacgcagccctactgacaccttggttttggcctggtgagaccaactttggacttttcacttccaaaactgtttaaagaaaaaagtctacagttccagttagtctacttttgtaacaggacctgacaactccactctacttccaatcctgaaagactacaggaaaaactagcccaagcgactgagctggggggtcctagtcatcggtagcatgggtattttgctttggaatattatcaaatagcggggggaccagcacagtggacttagtgtcaagtctaggatttgattcttagctaacaaaacaagtttcctctctgagttgtgacgattaaatgcaataaaatggaaaagtgcccagcagtgatgggctttcaggagatgccatagaca

SEQ ID NO: 212412 - DNA, 454 bp, Homo sapiens
acatattttttcccagtgcctccagaaagaacgcagccctactgacaccttggttttggcctggtgagaccaactttggacttttcacttccaaaactgtttaaagaaaaaagtctacagttccagttagtctacttttgtaacaggacctgacaactccactctacttccaatcctgaaagactacaggaaaaactagcccaagcgactgagctggggggtcctagtcatcggtagcatggaaaacgaagagtgctctggacagtgggtggagaagattcaagtacatcttcgttgctgacaatatgctctcctatcttttgtaagagtacgcaatttaaatttctaaaaattcattacaatacaaagcaaaacaatccctcatagatttataatcaaactaatatgccacttagaaaagatttgaaataaatgcaaatacctaggtacaaaa

SEQ ID NO: 212413 - DNA, 310 bp, Homo sapiens
acatattttttcccagtgcctccagaaagaacgcagccctactgacaccttggttttggcctggtgagaccaactttggacttttcacttccaaaactaaaacgaagagtgctctggacagtgggtggagaagattcaagtacatcttcgttgctgacaatatgctctcctatcttttgtaagagtacgcaatttaaatttctaaaaattcattacaatacaaagcaaaacaatccctcatagatttataatcaaactaatatgccacttagaaaagatttgaaataaatgcaaatacctaggtacaaaa

SEQ ID NO: 212414 - DNA, 1209 bp, Homo sapiens
atttgtaggcatctgtataaaacaaaatacttattgatcatctactaagcattataccaggctttataacttcctcattcttcttctaagtgttcagtgacttgtggctatttctctaattaaattgaaactcctggtgagaaactttaaggctctccaacaagcaatgtatgttccctcactgtaacttctgtcccagccatacaaactccttctcagttcaccttctctcaagtccaggctttcttcagtgttacttgtgtacctaaaatatgcctatagttcacctcacctccatcctacgtcctatcactgatacaaggggaaatatatatatataatacataaagtcttccttatgatgacttcaaaagaccaagggagggtgtatggttttttttcttacctcaatattcaaatccctgaggttgtcacaaacaatatcaaatcatgattaaataatgatttaattttcttttgtaagttcttaaaattagtatattaatgataatctgcttgaaatcaagccttattgctcttcccatggaattcgaatgatgacaataaattataaacccatcactgtattttcttcattctgtaacatgtcaagtatcagcttaataaattctctgggctacatttgaagtttcttggttaaaaatcagagatccaatgtatcttaaagttaaatttttagatatctaaaaaacatagcatactgcatctgtaaaaatggcatgctgaactttcacaaattattcagaaacaaattttatttagagaaatttaagctaaaaatgcagcaaaccagaaatcagttactgaatgcttcacaatccccagaaaatgagaattatgtaagaaaggaataaaggcaaattttacattgaccctcacagagcaaaattacaggagttctgttctctttgattactaactcagaaataatttatttcaagcttttagcactgaagatgttagttcaaaaaccacatgtttattcttatgcctgtgttgataaaactttgctaaatattttatatgtattaaaaatggagaatgaaagagatgtgtttcaagagccttttacagataaatcctaacaatcaaataggaaatagaacattaatgtgaataaaatgctctggcaaggtaggaagaaatgaataactggaagtagagagtccttagcattacaaagtggta

SEQ ID NO: 212415 - DNA, 1084 bp, Homo sapiens
ttcttcattgcaatattgatttaactccggacaaaaaagtactccttttcgtgagttttgtttgcctgagtctctctgaacttgggcaggtttcacttggcaaattacagtggtgcagtgggaggcagaggttggacatgagggaatggaaatttgcaattagacaggcatgcttagggtagttaattttatgaaatggaggcaaaagtaaaagcataatttggtggatcaacggaaagccaagtttgatggttttacgttaaaaagtgataagatgtctgtttttgtccatcaaggctccattttcagctcagacaacaataaagcagttgctagctctacaaaagagggcaaaatagaacccgtgtcctaactggagaacatggggtggccatgtgcggaaagctgcatgtaacctgtggctagagaatagtgtctggcatcaagcaagtacaacaagtaggcaaaagggataaaaagttacaggatgaaccattattagtggggtattttgaaggcaaaatttccttgtactgaagatactcaatgtaccaaaaaaggcaacttatttttaaagaagatagtaataaaggtcccgaatgaaggaactacaaccactgtaggcaagtgtggaacaagcacagtgtggataagggtctctactagtttcttcagtggaactggccctttaataaagcaatgcaacggggtggtctatgcatgtgttgtccaatagccaccagccacctgtggctatttaaatttaaattaattaaaatgagatgaaataaaatattctattcctcaagcatatttaccacattttaagggctcaattactacacgtgcccagggcctagcatactgggcagcacagacaaatcagttccattattgtagaaagttctattagacagcactgaaagagcattgtcttgggagcctgggagtgaatcatgagtctgcaacttagtaatggagtggccactgtttcctcatatttaaaatagggctaggtgatatagtacctacctcctggagctattatgaggattaaataaatgagttatttttaaataagatg

SEQ ID NO: 212416 - DNA, 470 bp, Homo sapiens
acaaattaagagcattgagaagtagggtacgactgtcacctgtggagtcttgaattcagagttgattttcttgtctgccgatttttttcaataccaagataagtgtcacaaatagcaccctttctcagaggatttccaggattcgaataacagacacaaacttaataaaatgacagtagtgcagcataatcaggaagcccacctgccgtcagatcacttgtttgcagtagataccgtgtgatctcaggagcagagtccacatctcttccatttattttctaacataaaattcttggttttttcttaaagcgtagatctggaaaggtgtgcaaaaatcaccttccttgatggactgcattacaagtctcctccaatcttgttaactggatatgcatcctcctagagttgagaacacatggtcagaggaaaatcaaatgtatcattgtttgaattcacttattttttgattc

SEQ ID NO: 212417 - DNA, 511 bp, Homo sapiens
tcaaagaatgagttagggaggatatctctccaccttgatttttttggaatagtttcagtaagattggtatcagctcttctaccaacatctagtaaaatctggctatgaatccttttggttcagggctttttgtggttggtagattttattatgtattcaacgttataactcgttattggtctgttcaggattttgatttcttcctggttcactcttggaaggctgtgtgcttccagatgtttatctatttcctctaaattttctagtttgtgcacataaaaatgtccacagtagtctctaaggatctttgtatttctatggtatccactgtaatgacatctttgccatttttgtgcttatttgaatcttctctcttttcttggttcatctagctggcagtctatcaattttgtttaccctttagaaggacaaacagaactttccgttttgttgattctgtgtgtaattttttggtctcaattctgtttagttctgcacaaatctttgttat

SEQ ID NO: 212418 - DNA, 542 bp, Homo sapiens
gattaaagtgacataactaaatgcattatagcttttatttttccttcaaaaaatatttgatctaagtgcttattttttaagccaattgattagagctttttaaatataaacattatacacataatacatatgactacacagacagacagaagatgcagcagttataagggttttttgtttgtttgtttatcaatctccatattagattaccagcctcagggtgaagcccttaaagagaagggctaggaaatcatgcagtttctagggcctaataaacaggcatacctggtatacaaaaacagattttgagaggaatctatttacctccaattcctggtgttccatgaggaaaatagagatttctcccaaaatggaatccatggcgtcttttcttttttccaaggagtcccaggccattagaagttgtcctagggctttttatgcatgcattaagagtggcaagaaacagtggagaaaagtaatttagttgactgagggaaaaaaaaagaagaaaagaaaacctttccagaaaaacaagatcc

SEQ ID NO: 212419 - DNA, 343 bp, Homo sapiens
cacgtatgtctatatatataattatatatatttacataatatatatctatgtatataatttttttaagtagaaataagcagcgaaacagtgttttaacttctaccgaatggctgtcatttcttagttttaagacttgtagttcggagggaggtggaatgagaaggctgaaaattttacatgagctctgatttaaggatattagaaaagtcatttctaagtgtggcggtccacgcctgtaatcccaaccaacactttgggaggctgaggtggaaagactgcttcagcccaggagttcgagaccaacccaggagttcaagacgatagtcggaccccatctctaca

SEQ ID NO: 212420 - DNA, 678 bp, Homo sapiens
ctctttgtctagcaaattaaaacctaataccttagaccaggattccagtaccaactctccactaagacttctgtaccagacacctactcatctataagattctcaccttctcatttttaaacatccgtattgctcttttccttacttcttcccgtcaaaaaaaatcctaccgtcaaaaaaaatcctaccagttcaaggttattttttgttaagtaagtcagaatagcacttaccccttctttgactaggaaggggcaaaaaggaactctttacaattttggatatcttttgtatcttgacctgagtgggagttagaaggatatgtgtttgaatgtgcatatagacagatatataggtacaaatatatgtaaaaatacattgaggccgggcacagtggctcacgcctgtaatcccagcactttgggaggccgaagcaggtgaactcagtactaggcctttcaaacaccctagaaacaaataagtggtgggaaggctgattcagccctgattctagcctaaaagcagtttatcatttagaaacccatacttgctaatctggcctctcagtgcaactgtttattttactgacctctccagagtcaggctaactccaaaaaatattttgacactgacttagagcccaagtggtagttttcatctctctggaggcaagctttg

SEQ ID NO: 212421 - DNA, 544 bp, Homo sapiens
atacattcaataaatagttgttttttgatcgattgagaaacataccttctgttgctgtgtcttttatgctgaacacccagggggatccatacccttccagactagaagtcctggtgatgttggttttgattgccatagtggaaaaaaactttgaactcaatgattaaccatttgtgtggactttgtcaccatgactcagtgtgtgtctctgtgtgtgtgtgtgtgtgtgtgtgtgtatgttttgggtttacatgcacatagattggtatagttggctttggtgtatatgaatgattctgtatcttattattctgtcacaataatttgtcaaatacatgcattttaatatttagcttatactttgaaaattatttatgcctgttatatttctgaaaaaaatctgtgtaaatgtatctatgattcttgggaaattactgaataactagcttgttaaattctgatgactaatccttatcttttagaattcataacagttaaattatatatcaagacctaagcttacaaaagaaatgtcaagattttg

SEQ ID NO: 212422 - DNA, 393 bp, Homo sapiens
taccccttaaatcttcatcttccatcttcttcacagttttactactctgagtgattttattcatgctcatggctttgtatatggttataatatgaaaccctaaagctgtatcttgaaaaagtggcctagaccacttttctgggccacgagaaccatatgtcccatcccactcttggcatatagactcctcttttaatgtaattagtattctgaacttattcaacgtgagttatcttaacttcattttcccaatcttgaagtttctgataattaaaaaatatattggcaatggacacagacttgtttgatgtttttataatcatcacacactagttatacaacccaaagcaaattatttaacctacttttattagttttctactgctgcataac

SEQ ID NO: 212423 - DNA, 290 bp, Homo sapiens
aaaaagccaaaggcagatagagctaaggcctctgaaattttctaaaataaccaaaaggttattttaaaggggctttaaaattatctggggaacaagaaggacaagaaaaggataaagtctcattggaaccaatagtgctatgtttatagataacagaatgtatatctgttcaggtattatcttgctataatctttatcaaagagtggtttttcatttggaagggtagaaaatgtatttgaatttgtaatagttaaaaagaacacctgaattgataatactaaataataaa

SEQ ID NO: 212424 - DNA, 949 bp, Homo sapiens
taatcctcgtcgtctctccccagttgacccagatttggggctgtaattcagtacagctgactcagaggggctctgggtcccttgagctgaggtctgtggtcaggctccactctggacacactctaagaccttggcaaatctggttgccatggaactcaggatgtcagctcttccctgtccacacacttgatctgtgctgctttcccctcagagctgcttccataccccctcccatcatatcatatccccagacccatccttccagcccaggtcagcccccacacccaccccccatcaccctgcacctaccactttcccaaacaacaagggtcagtcacctgtagagttttcaagtcatttcaacaaaattacagcccacttggtaaaaatgtgtaggtcagaaaacatacatgtgccatgtagagcatttcatgacagcaatctacactataccttatacttatcattggaaggtacaacttcttgctttttttccccaaaatcttattttctggcaaataaggcatttaaaacacacatctaagagacagaaaatagactggtggttgcttagagctagggggatagaggaattagaggatgggacataaagtgtgtagggattcttaggatgatgaaaatgaaaatattctaaagtatattgtggtaattattgaacaactctctgatacactaaaagccattgaattgcatactttaaatgggtgaattgtatggtgtgtgaattatatctcaatagagctgttaccaaacacacacacacacacacacacacgagtgacatcctcctggcctcttctgttgtatgtgtcagcccatagatcacccacaatggcaaaagttgtccttacacagccacttgaccccagactccaatactgttgaaccactttcaacaaatttagagcaacagtttttagaagaaaaa

SEQ ID NO: 212425 - DNA, 329 bp, Homo sapiens
ctacttgcggggctgagatgggtggatcgcttgaacacaggaggttaaggctgcagtgagccgagatcgtgccactgcacactagcctgggcggcgggagtgagaccgtgtctcaaaaacaacaacaacaacaacaacaacaaaaaacaaaaaatggaccgaggttggggtggcaaggctgggctggaatggaggctgaggacaggccctggcagcgcccagggggtagagggcgtgcagcaggaagcaagggccaccctcagggatgggggactgggcctggcagctgccgaggggtaggcaggatgcatgtggagagccacgtgggg

SEQ ID NO: 212426 - DNA, 211 bp, Homo sapiens
ttcactgatcttttgtatggatttttgcatctcaagttcattcaattctgctctgattttggttatttctttccttctgttagttttggggttagtttgttcttgtttttctagttcccctaggtgtgatgttagattgctaatttgagatctttataactttttgagatagatgtttatcactacaaactctactcttattactgctttt

SEQ ID NO: 212427 - DNA, 541 bp, Homo sapiens
ccaggttatttaatggaatcaagcctccaaaggaatgaaaacattagccagaaagtgctctagcaacagggcagccccctctctctactccgacttcccttctttccttagcaccctccatctgcacaacacaacctggctctctctggctcaggaggtctccgtggtgccatctggtctgttctcagacatgaaggactacaagggaccacaggggtctgttctcagacctgacccacttcctgctggtcaggagtgggagcatggatggtgatcagacgccttaagggggacatccagagagaagcgagacaatctaaccactgttagtctatcactggactccagcgccatgccaccctacacccagctccatgccaccctacatccagctgtgttgccagttctcctgcagctctgggagggaggaaacttctcctctggggctgaaagagctgtgtgggtaaattccaggactcttaaaaataatctggtctatataagttttccacttaaatataaactccacgaaggcaggaac

SEQ ID NO: 212428 - DNA, 156 bp, Homo sapiens
gcattcctcagataaagtttcttttctttctcaatttctatacagagatccctcaagttgcaggaaatatggacaggtactcaggccttttgatttccagcacacaagtttctatacccttgccaacagttagctgcctgatcttttctaaaaggg

SEQ ID NO: 212429 - DNA, 1039 bp, Homo sapiens
tgcaaccggagcctcggaccggccacatccaggacaaatcccagccagaggcgcagccccagcaagaggaggtgtcctgacaggctgacgagggggccacactcacgcagtcaccccagaaggccaagtgtgacagccaagtgtccagcctgacccagagatgatgggcaaaccaaactcctactgaggtgtcctggaaaggcctggaaggtgcactgcccagtgggtctgctgaattttaaacaatcgccgttttcagtcccagatcttgctctgccttggggttcaaaggttaaccagaacttttagaccccacaatgacagtatttaatgcttcaagtgctggccttaatttggggtggggtggggggtggagaatgtatagttgcatgcttgatagggttttaactgggttcattccttgagatcacttaagcctcacaacagtgaatgaagcacatagcattcttcagttttgcgcatatgaaaaccgaaggtgtggggagaggccccctcaagtgtctggctgaaggtcatacagctaagaagagaatagagcaaaattttgcacagatgagtctggtgttagaatctctctgctctttttattacattccattgcccgtaactattgcgtcactccacctgcctaaagcagacatgggtgcgcaaatggtcgcaaagcttctttgttgtaaggttaagtagcggcacagcattgacaaagtccctattgagagctttgtttagaagtgcatggctcccaaaatgagaaggctgagtgagccaggattaaaacacacagccccacccgtcctctgtcctctcctccttcccaagctcagtttcaatgctgtaaacttaaagctgacagctcacaataccagccacgctgcctctcggcctaagcatgtagcaaatgctctcactgccctacgcattacatgcttctcgacggagtagggtaaaccaagcctcccaaacaaggcagcccattctccacatgccgtgggtgctggagctcagaagatagcgtggg

SEQ ID NO: 212430 - DNA, 486 bp, Homo sapiens
agcccctcacagcccccaccctgctctgcagcctggcccacacaggtgtctgggatctgctgccacccaccaccatcccttgcaggaagctggtcctaccctggaagactgtgacaatctgtgtcatgagggcaggggtcaaatgcaagtcttttctgcacccccagatcatgcaagagctgtggcagctgactaaacaaacgaacaggactgagacctttaggcacagcagccccagcctcacaatgcccattctgccgagatgggcaggcatgcaaggagccagccactttggggtggcactgcctaccaaatatactacaggtttgtgtgtgttagggggcctaatgcacagggagatgggatgggacacctgcactgctcaacagagacagagacaggccaggggtcaggggcctgccactccttagctacacagccttgaggaatggcgcccactctcagatgggtggtaggctccaacta

SEQ ID NO: 212431 - DNA, 487 bp, Homo sapiens
ctagagaaccaagagtaaaaaagaaaaaaaaaaggccaaagctagcagaagacaagaaataaccaagatcagagcagaactgatgggagaagactgcgccgccctacctccagcattatggattacaagttcaatatgagatttgggcaggtacaaatatccaaactctgtcagtcaatatctagaataaagtgttttaagtgctttgaaagtatttacagtgtacagtatggagaagaattggacagaagcaggagtggttgcacatgggagctcatgcccataataccattgctttgagaggcagagacaggaggattgcttgaggccaagagttcaaaaccagcctgggaagcatagcaagacctcatttctacaaaaataaaaaaatcaaaaattagccaggcctgtggtgtgcacctgtagtcctaatgaggagggtgaggtggaaggatctcttgagcccaggagctcaaggttacagtga

SEQ ID NO: 212432 - DNA, 444 bp, Homo sapiens
aaaaaataatacagtatatccatcctatagatctttctgctgatgggagcaattgccgccctacctccagcattatggattacaagttcaatatgagatttgggcaggtacaaatatccaaactctgtcagtcaatatctagaataaagtgttttaagtgctttgaaagtatttacagtgtacagtatggagaagaattggacagaagcaggagtggttgcacatgggagctcatgcccataataccattgctttgagaggcagagacaggaggattgcttgaggccaagagttcaaaaccagcctgggaagcatagcaagacctcatttctacaaaaataaaaaaatcaaaaattagccaggcctgtggtgtgcacctgtagtcctaatgaggagggtgaggtggaaggatctcttgagcccaggagctcaaggttacagtga

SEQ ID NO: 212433 - DNA, 448 bp, Homo sapiens
tgctagtgaggaagcaggaaacgcaatcattcgtacattgctgatgggacacagtcttgccgccctacctccagcattatggattacaagttcaatatgagatttgggcaggtacaaatatccaaactctgtcagtcaatatctagaataaagtgttttaagtgctttgaaagtatttacagtgtacagtatggagaagaattggacagaagcaggagtggttgcacatgggagctcatgcccataataccattgctttgagaggcagagacaggaggattgcttgaggccaagagttcaaaaccagcctgggaagcatagcaagacctcatttctacaaaaataaaaaaatcaaaaattagccaggcctgtggtgtgcacctgtagtcctaatgaggagggtgaggtggaaggatctcttgagcccaggagctcaaggttacagtga

SEQ ID NO: 212434 - DNA, 296 bp, Homo sapiens
atcagcaggatcgtaagcttggtcaggaggaagactgggacaggaatggatagatggatggaacagaagaggaagcacatacatatactataagtataaattttgcatatgattatgtcatacattggaatgtaaagaaagttatttttttaaatggtgctggaaatagttaaatagttacatggagaaatgccacatattacgtactatcctataaatacaattgagtggatttgaacataaacgataaaaccataaaactgaagaaaatattggtgaatggttctatctgacca

SEQ ID NO: 212435 - DNA, 504 bp, Homo sapiens
taagggtagtgtacatataaagcttctaagtcgtagagataaagtaggaatccatttcatgccaacaatgactggcagctgtcataagacacaaaggatagaatcaaagttaaccatcatagatcaactgtatttggaaggatttttaaaaagctcttcctgctccccaagtttctaagaaagggtcaagatctaaggatgttcataaatcaaattgcgtggctatcctggacaccacagaagtatgctggacagacatcaaagagatgagacatttgttgtttcccagagtcctttgaacttcttggtgtaatgccgcccagtggactcctggttccaagacccacctctaccacttacaatctttttgatcttagaaaaatcacctaaacttttcagcttagtttgtttaccttaaaattgataatatctttattgataatatctcaaaagttttaatatctgattatcaggtagacttaaaagaatctttataaagcacct

SEQ ID NO: 212436 - DNA, 855 bp, Homo sapiens
ggcaaggaagacgggatgggccccaatcgggaagcacgcgccaccagctctggagagaaccgtctgaggagacgcgggggagagtttgggtcacaggagcaggaaggaactggcaggtgtctgtcaccttatcatcccggacaccatgtttacattgtaattggcttctttacagagagggagggaccaggttcccagtgtgagtgatgtttagaggttttctgagaagcacaaggactggactttgacaggaagcaacgaggcaagagggaagctcgagaacaggttttgctgaggattccccccaagaaaagtgctccccgggaggccgttcctggcaccaagactggcggagccaccacacccgttaaagggatccacctggacagcgatcaggccacctccaaggatcacgtaggaccagcagaagcagcgtaaagtattggaactttgaatctgacatcagaaagacctgcactcagccgggcacggtggctcacgattgtaatcccaggccgaggcggtggatcacttgagattcactgattctaggtaaatcagaggaacaagcaacatgaacagaaaaaatgtagaaaatgcaattatgctgaagtacaattgttgtttcagaagtccagcatctggtgtacttaacaatagagaatatattaaatttttccaaaataaaagaaaacaagtaggagactcgctagtgaaaattcaatggcatatgcaaagtctttaatacagcatttggtacatgagagggactccgtaaaatctcgtaacttatgattacataggttagactagtgactgcccccagtccatagatccgctatctgaggcttatct

SEQ ID NO: 212437 - DNA, 454 bp, Homo sapiens
ctccttttcacatttagaagtaggagactttcacagtgtcatattttcacccccatcaatattattgatgcttgctcattttctaatgtgggacctgaaatttaccaggtgcttaaagaatctttttgtttttcagattcactgattctaggtaaatcagaggaacaagcaacatgaacagaaaaaatgtagaaaatgcaattatgctgaagtacaattgttgtttcagaagtccagcatctggtgtacttaacaatagagaatatattaaatttttccaaaataaaagaaaacaagtaggagactcgctagtgaaaattcaatggcatatgcaaagtctttaatacagcatttggtacatgagagggactccgtaaaatctcgtaacttatgattacataggttagactagtgactgcccccagtccatagatccgctatctgaggcttatct

SEQ ID NO: 212438 - DNA, 393 bp, Homo sapiens
aagtcaaatgtcaagaccccatattttcttcctggaaaatagctgaaaaatgatatacatgaatactaccataagagttactcatagggatagacgaagggcatgaaaggaagaaaataggtcagtaacagaatatgtgacacgggaaaggggcacacttagatttttccactcacatcaagagttctctctactatccctctcaatgggcttaggaaatctccttgtaagaaacttctagataaacccatacgcaactcaaatatctgctctgccactttttagatagctaatttggggcagatttcttaactcctgtgagccccagtttcaacagtttgcatggagatatctactttacagggttgctttgacgattaaattgactaacgt

SEQ ID NO: 212439 - DNA, 466 bp, Homo sapiens
catctcctttgcttctttgaacatactagatccagagaaactactatttccacctcagctcactgcctttcctatactcatggttataaacaagagatctgcacgctgcttttgtaccttagatcgtgacatttgccctcataaaattaatttttttcaaagacttttgagatctcccagcaatgagtcttcttattgctaagacttctctgttcagttttttgtctcctctttgttcatcgaaatgctgcttggtctcagctggatttggcagccctttcacataaattagagtctggtgattaaaactgccctgtagtttcaataaaaagtgaaatttacagacttttatttttctccttgttgcttttcaatgctttcctggaggaaagggagagaatgttgctttatacagccacataaatgaagtcttttccaattgttaaatagttatgatagatttaaa

SEQ ID NO: 212440 - DNA, 360 bp, Homo sapiens
cacacacacacacatatatatggtttgtagagctctgaagtctggaggctagacttcctaagagaaagccaagaatatagagcacattgcaggagttaagaatggcctttggaacctattatatattcctacagtggagcaactgtcaaatattccacattgtctcatttttctccattttagtaatgtaatgaactaagataaagaaaaaatatagtataactgcatcagtgacaagaagactcaaaaaacaaacagaagtgccaatccatgtctgaattttcaagttccctattggatgaccagactggcaaccatttcaaatcctgtttaatcggtttaaataaaatctatttcatt

SEQ ID NO: 212441 - DNA, 444 bp, Homo sapiens
cattctccttgcctcagcctcctgagtagctgggactacaggcgcccgccaccacgcccggctaattttttgtagagacgggatttcaccatgttagcctgacctcgtgacccgcctgcctcggcctcccaaagtgctgggattacaggcgtgagccaccaagcccggccaaataattttctttttttttaaaggaacaaggaagatgaaggctgtaatgctacccatttttgattctttggagagtggcaagattctcttaacaatacaacatgtacaacagggcaaatgcacattacaatgaaaaaaactctgccttcaactcagttactcccagtataaccttctattgcccaggctgagtgcagcggcacaattttggctcactacaacctctgcctcctgggttcaagcgattctcctgcctcagccacctgagtagct

SEQ ID NO: 212442 - DNA, 339 bp, Homo sapiens
ttgtattctcattagtctcacattaaagatgaaggaacagagacataaaaacggtgattaccccaacgtaagaagtgagagagccaggattcacaacccagcagtccaattcaagagtccacactcttcacagttctgcagcactgcctctgtgggggacaggcactttataaatttcaccttgcttcacacattcattcattgtcacagaagtaaaaaatgtggttccttcccaccttcatcctcaaagatttaaaagagagaaaaatagaatgtcttctgaaagttaaattctaaatctacacttcaagaaacaaagcaaagatattcagagtaatt

SEQ ID NO: 212443 - DNA, 231 bp, Homo sapiens
accatgcctggataatttaaaaaaaaattgatggggtcttgctatgttacccaggctggtctccaactcctggtctcaagcgatcttcctgccttggcctcccaagtagctgggataacaggcatgagccaccatgcctggtttaaaaaaatttaaattgctgggcgcggtggcttgtgtttgtaattccagcatgctgggaggcttacgcaggtggatggcttgagccca

SEQ ID NO: 212444 - DNA, 562 bp, Homo sapiens
atatatagtcatgaacttttacgtacccataaaatacagaaaacaaaaacttgaaaataaaaggagaaacaggaagaaaaaaatcagttacaataggagacttaagcatactttccagaaatggacagaacatgaggataaaaaacacacagtaataagggacttgaaaaacacaattaaccagtttgatgtatttttatatgtacttataaaacaatacacatcttttcaaaaatccatggaacaattacaaactgatcatgtgacaggccacaaaaaaaacctcaataacctttttaaaataagaaattatacaggccatattccctgaccacaaagcaataaaactaaacaaaagccacaaaaagtttaaccacttggaaatgtaacctaaaggttatttggaggagtatttttttttttgagaaattaaaaagtgcagactatttaaaaatgaacaatgagagcactatatagcaaaacccatgggatatttccaaagcagtcactcaaaaaagaaatgaactgagaagaataaaatcaaaataagccaaaagaaagc

SEQ ID NO: 212445 - DNA, 141 bp, Homo sapiens
tacggtggagctggagtcttactatattacccaagctggttttgaactcctggctaaagagatcctccctcctaggcttcccagagagctggggttacaggcatgagccaccacatccaacccccttctgtcgtctttgac

SEQ ID NO: 212446 - DNA, 482 bp, Homo sapiens
tgttaagttcttaaacagacctcaccggtaagaaggtaagcaagcatttattagtgaggttattcacttaatatatatattgagcatctgctatgtacagatgtagctacagtaaatattgtggggattatttttttaaaaaaacattaaacatgagccttttaaaagaaatttctaatctagtaagaaatagctaaactgagcttgaaactaatgacatcattcaaagacttagttttttttctctgagattttatcaagtggagcaatagtccgtgcattctagtctacagttgtaaactaaaattatctaacaattttatggtgagatgtatgaccacatgcaatatgaaaaagaataattcaggcctaaagtacatgttaaactgaatcatgtattcaaggaagacagttatgtgtgttgttagatttaataaaattttactctacctgatgggtatagtcttaataaaaaaaaaaaa

SEQ ID NO: 212447 - DNA, 398 bp, Homo sapiens
accatcacctactccaagtgaccatccctgactgctccatctgaatgttgtttcatctgtatctctgccttaccactccacagcatttatcatgatctgcagctatcttttatttctatttgatttcttgtttcttgtctgtctcttcccctagaatgtggatttcaccccctaagggcaggaattcttgtctgttttttttcccacttcttgattcctagcccctaaaatagtacctgacaataaatgttgaaagacagaggggcagaaggaaacaaagaaatacaggctaaatgactgagggaataaatgaatgaatgaatatatacatgtaaggctaaataaataaaatgggataaatgaataaaagggactttgggggaaagggaccccattcc

SEQ ID NO: 212448 - DNA, 266 bp, Homo sapiens
tcatttcaggcttctctgtgacctcttcccgggtcggttttcagtggggacagcgtgcaaggtgggctgagttgcagagggccaacaggtagcaaagtggaggagacacagcactagaaaagagaaaaaccagtttgcagagatgattcctgggtgttgaggtcagttccacccttagaggtcaccagatcccagaggtcctcactatgtatccagctttgaagttgtggtgactgatgtgcaagggcccagaaaagcagatggaa

SEQ ID NO: 212449 - DNA, 277 bp, Homo sapiens
tgccatgagccctattttccagatgaggaaaactgaggcttagaaacagttaagtggcccgtcccagatcacatggccagtaagtgacttgtgcccaatttgaaccctaatctgtttgaatctttgacttcggtatttacaaatatgtcttgccagctgggagaggcaggaaatgggcaagtgtttcttcaggaatcaagaaccagaatcttccgtgccctttatctcatcgaagcgccacggcagcacttcaaagtagatgttttatttgttttga

SEQ ID NO: 212450 - DNA, 485 bp, Homo sapiens
  misc_feature (12)..(13): n is a, c, g, or t
tacgcatattgnntggacgaccatagcactcctttaaaaatgctcttaaatttattgcctggctttagccatgccgagtggccaatattcctggattttaaactcacaggtgaaacctgcaagcctcaactaaggttataacttaaccacaagtatacaagatatcttcaaagtggtggtaagcagtttttataaaatctagaatctttagaagtagctcagaggaaggaagatttaagaagagaacttggaagttgtttgtggaaggggaagagaatcagcaaataataaaggtcgcacagacattaaccagatagttttcattccctaagccaggattgaacctgggctgctgtggtaagagcacagaccaagagaaagtactgccacgtggttacaatgtcatgctcccaaggacatgactgaccagtttgctgggccatcttgaacagcgggcttatggggacctaggctcacattctatc

SEQ ID NO: 212451 - DNA, 195 bp, Homo sapiens
ctagctcggcttcctttcaaacagtttttttcaacagtgagagctttctgagaaatgcatttatataggtacaaagcatgtgtctctgtggcagcaggagtccttatttgcatcagattttctttaacacctgtttgtttcagagggcactgccttcctaggaaacactccagaaaaggaattacataaagaaag

SEQ ID NO: 212452 - DNA, 471 bp, Homo sapiens
tctccccaccatcaccctgttgccctgccacactccgcctcaccaagagagtaaaaatgatgatcgctgaatactgagggaactcagagaccggcgccggtgaaggtcctcacatgctgaatgtgccaggcccctgggcccactattctttctctatactttttctctgtgtctaatttcttttctcagtctctcgtctccacctgatgagagatacccataggtatggaggggcaggcccccttcaaacaggattttgctttgttgctcaggctaatctctaactcttggcctcaaatgatccttctgacttggcctcccaaactggtggaattacaggagctagccaccataccagtcagggcgcatatcttaaggatactcctgaggtggagctgggctttccctgcagaaccgcctctgggaattgtgccctttaccctccttgttacctagggaactacattaccc

SEQ ID NO: 212453 - DNA, 534 bp, Homo sapiens
acgtgcacagacatgaacgcatacacatgtgcccgcaggcactcatccacatactcagaccacatcacactgcaaggggcattcgcatgtacacacacatgggcacagagctgtacctgtcagccgccccccacccccgccgccaagtgtctagacagaggtcagagcagtggcatgcttcacgctggctgtgtggggtgggggggcggtacccatgtgcgggtggatttgtcttcccagctgaaccgcagggttcgtcctcatctctgcatgctcaggtgctggtcctcatgccacagggctagcgtgtcctgcacgcatcccagtctgcacaccacagggccagtgctcatctctgcacgcactggtgctgaccacacctggtacacagcaggcacttactaatggcagcccctcaaagggatgtggcacgtacactacaacagacactggggggagtgggcacagatagggccccaggccccaccctacccccaagcagtggagaaagggaagaaaacgtctcaaaaaaaa

SEQ ID NO: 212454 - DNA, 523 bp, Homo sapiens
caatatcctcaaatttcagttatcatagtttagttaaataacaccaattacccaatgacacaattcaaatttcagttaccactgtatactaattgtgagtagctgaatatagtacaaacttcactgctacatcttaagtccacaaatcagtatacaaataacagaagtacatcaccatcagtgaccaaccaggtcacttctttcactgtctgttgatgatcagtcacagtgaacctggtaccagttattcagttcatgtacagaaagcaaagcatgtagttgagttgcctccttgtctcctggtgataaacttatgtgccatgttacaaaattgagtaacagaaggagagaattggccaagaatgatgtaagggtagcagagaaacaaaaatgtataatgttggaagtgaaattccaatcaaacataaacagaattatagaagaaatagctaaccataagaatgctgacgctactgccattcaagggactctaaatatgtagtctgaggggctgggtgcagtg

SEQ ID NO: 212455 - DNA, 445 bp, Homo sapiens
gggctcccagggttggctggacttagggagcatcctggatgaggcaggagatgagcagagcgaggcctgcaaaaggagctcagtgctgaggtcgggaatcaaccagcatcaacccaaggtccctgagaagtcacgctgggcacaagatgctgaacaccaagctgccccaagacaatcccattctgaaacctgcatccacccagacaatttggcccctcctatgttcactcataccgttgaggcctcagcaagcggaggaacaactgaccacctttaatagagcctatgcagttaaaagtatctgtggagtttcagaataaagggaggggagaggtgtttttaaaccggtacagtttactccctcctttggccccaggagtgatgtgactgactgctggtgtcagtttggggctggtgtcagaaaggccaaaagtgaggaacaaag

SEQ ID NO: 212456 - DNA, 573 bp, Homo sapiens
gaattacacaaataaatgtcagatgacaacagtggtaaatgtcacaaaggagaggtagagaatgccaccaggagcctaaggagggggtcccaggtaggctgccctgatgaagtgatgtctgcattgacgcaatgaagagtagatgaaggtgagtgaggagggagaagaatattccagactggtgataacatttgaaatgagaatacttggcacacaggaggcacccagtgagtgagagggaatatgtattagttagttatagctatgtaacaaatcagccccaatggcccctgagttaaaattcagtgtatggtgatcttctttcctctggtaaattacaagaggaatgaaggtcgaagtcctgtttacaccgatttttcacaaccatctcttatgtgcctggtacttctgagtgcctttttctgtctcctcaagtttcctggtcattttcttcccattgactcatacttgggatgctgggaggtgcacgcagtagcactgacttctttccgacttgacaggggaagtgaaaattgatgaaccagagtgaggaagggcagaagggagtttgtg

SEQ ID NO: 212457 - DNA, 499 bp, Homo sapiens
gatccttggataagggggtcactacacagaggtatagattcataatgatgtgtataagccccaggaagctttaatttgccttccatttactctaaaccctctggaaaagaatgagaaaaatataacaatgaagaagaggttagagttacaatctctcaccactccggctgcctctacatgccaaagatgagaaaaaggaggtgcatcttgcgggagcatcaaggcttgggaagctggattcttttcgtttgggcccacagagatcaaaaacttcagtccctgggaccagcagggaaacgagaactacatggaccaagaccagtcctgttgccttagtctgaggcaacctcagcaccattcattctaacaagcccggtgatgggtctgattgtatcagaagtgacctggccagcaccactcaccttagggctacctcatagaaagagattaggctgtccagtggaaactaaatattcagaagactggagctctcttcaaa

SEQ ID NO: 212458 - DNA, 514 bp, Homo sapiens
atgcacttggggagggaatgagacaggggacattcagaatggctgtttgggctcacagttgagtgggaaaaagatgggagctgcatcccaaggagtcatgaggtctcccccggcacctgtttcaggaaaggggagaagtgttgcttttctcccctgctgacagattagtctgtcatgagagtggatttttgcaggttgtgggggaggggtaccaagaccgtggggagtgggagatgcctggctggcttcccgggtcacctcatgtgcagagttgacggcttgggccagagccttggattcctgagaagcttaccacctgctcactcttgctgctacccagagtcactgagatttctggaaacttagagattgctattttatgtttttgttctgtgggatttggggtcagattgcttcctttcctccttcacttttgttaaggtttcagatctggctctcaactctgtgttcaggaatcttgacagtagtcacataaaagaattgtaggagtgcc

SEQ ID NO: 212459 - DNA, 338 bp, Homo sapiens
caggagcaaaagatgaaaaaaagaactataagtgcttgacttgagtgttgattatatttttgtggacttattagacattttattttatataaatggtgtttcaaaaattaattcatttttatatattgtcgagttatttgttataagtagaaaacactatctgtagttttgactagaaataatacaaaagtgcatttctgaacctgtggttcaataattgccaatgatttataaaagtgtttcaggtgtcattcagtgtggtaatgcagttccatttcacttttttaaaattccataaggtaaaagaaaaagagcaataaaaggaaccagaagaaagt

SEQ ID NO: 212460 - DNA, 431 bp, Homo sapiens
ctctttccccctagtgtgtctagatctcattacctagaagcaatcttcattaatattttggtatcttttctttgcgaatattgtctatccttattgctcttgcctgggctttctctagactgaggacgcatggtgggaagagctctggcaccatccactgtggatccacaccttcctgtctgtgtgaccccaggcaagttacttaaccttagggtgcttctgttttctcttatgttagaaatgggacctattgggccagacgcagtggctcacacttgtaatcccggcactttgggagaccgaagcaggtggaccactggaagtcaggagtttgagaccagcctggccaacatggcaaaaccccatctctactaaaaatacaaaaattagccgggtgtgatggcacatgcctgtagtcccagcaactcagg

SEQ ID NO: 212461 - DNA, 478 bp, Homo sapiens
tcagtcttttttggactcttctagtgcatactcatggcgtcagtcaagttttcatccatgcacgtctggctgtcagactctgttctacatagatggagataacgtgtgcaaatgtaaaagataaaatatacctctgttttagttaacgggactaaaacatagctgttaccatggagatctgggagctggggataatggaaaaaaccatgtttagattctcacttagaactgtgatgtaaagagactttgttcccttgctcattgtttaagtaatattgaataattgcctgagatgagctaagcaatctgttaaccagtggaatgtgcaacagtgaataaaacaagtaattttgcctttgagactcgccctgttaactataccacagtggccaccaatccataagagagagagagaatgtgtgtgtgtgggttggcgggggaggggccaagttcccctgccccacccccagaaattacg

SEQ ID NO: 212462 - DNA, 646 bp, Homo sapiens
atgcctgttgatcaagtgtgtgctgttcactctgagtttacagcatgagtggcttctcctcctctggtggtgggtgctgttggattctaaggacaggaatgccaagagaagatgaggaaatgaaaacagtaactcttaaataggaaatggccataccaagtgggtgaaatcccagcatgagtaatgtaaatgtgggtccaaggaaaagaaatattattttaaattacattactaaaccttttatctaagactttataagccctgtgtgctgtgcatactataatgaccttaggatatgcagttttatttaaatatccatcagggctcagctgcttctgtccatggagtgatcaaccccagtgtgtggctcagcctctctcttcactgactgctgctgcagctgttatgccacccctgcctcttatgtgggaagttacaggggttctttactgtctttggaatcaatcaccaaatcttgtagattcaagcagcttaatatcgtttgtatgtatcccttttctgaataattattataattatttaatttattgaacacatgttatgtatcattcatttacttttctaagtgcttcacatgtattaactcaattatcttcacacatgtgtgagtgcatgtgcacacaca

SEQ ID NO: 212463 - DNA, 925 bp, Homo sapiens
tcctaagaaatccctactcccccaaaattgacaatgcagccttctttatatgaaaccttgtttataggccacaattctcccgacagatttacaagtgtctgtggagttttaaaagacgattgcttaacaggcattaagtgagacacataggactgtgtaaatattttagctggaataggatttttttaaatgtctgagccaaatattgcattaaatctgaagacagtggcaaactgattagcagtggctgccagctccatgctttgccagtgattctggagccaagactagataccagaattcatccaccagattaggttgtgtgttttaaaaataactttccatcctttttttttttccctctcttctctttatgcctttctgtcatttctcctttattccctcatggttcatttagatgtaaacactttccagagtagaaaattacagttaatgtgactaaccagcgagggctgaaacgggaacatgggctcagaggtcagagaaaccgtggaagacttgcagctgtcctggtggagcaatgtggggacaggttgctttttactaataggccttgtgtatcttaatcactggcctctttgtagccagctgttgcactgctggaaggggactagtcctaagaccagcattgctgttacctcttcctcttactgagttccttgattcataaagaggctcaggcctgtggccttcaagacgtgtatgtgtgagagaatcctcaattctagtaaaaattgccacaaaatatgcattttgacttcagaggacatatttagtatttaagcattcctataggagtactattttcctgattagagcagtggataagatgtgttgctataattttgggaggagtgaggcgttctagctaacaactttgctctgcctttgctgacttttaacc

SEQ ID NO: 212464 - DNA, 508 bp, Homo sapiens
agtggctgcctgaaagtgcaaggtatgatgtgctgtcagggaaccaggaaaaggcaatcgccaccttaaagaggatagcaactgaaaacggagctcccatgccgctggggaaactcatcatctccagacaggaagaccgaggcaaaatgagggaccttttcacaccccattttagatggacaactttgctgctgtggtttatatggtaagagctgtttgttgaccactttgacccctttccactccctgtgccctgttttgggttttgttttaatgcaatggacagatagcactttgatttcaggcagcgtttgcaaatttcagtagttcgaacatcatcctcctgatttccgtcatatccaggttatcatctgtacgtactatcatttccttcatctttttctttaacttgactgcttttaatcaccgtgcaggctggagtgcagtggcgctctcctagcttactgcagccttgaactcctgaactcaagcaatcctccctcctcag

SEQ ID NO: 212465 - DNA, 497 bp, Homo sapiens
gcttcgaccctgaaatgttagtgttctgggacatttatgggaacaatgggacagagggttgggatcagaattatcctaagaatactaaatagtggtttactttccccagctcagctggcccctggctcaattcctgctccaccctcagccaaattcctgtctgagctttccactatttatatcacttctccctaatcttgtgcccatcctgggcaccacaggtgttcccatctctcagcctgttactttgaggaatgattaacttacaaaagcaggactgtcaagatgatactgaaatatgtgtgcctgcatgtctgtatcaatgagcatcggggaggggtaacctttgccaattgctagggcattgatactgcctgggaagataggactatgctgaaacaagcagacagaaaaaaatgccatcatctgcctttatcctcctcctagaaatgtgctcactctgttactcttcattgcaagagcgtttatttctggag

SEQ ID NO: 212466 - DNA, 2537 bp, Homo sapiens
  misc_feature (1111)..(1111): n is a, c, g, or t
  misc_feature (1125)..(1125): n is a, c, g, or t
  misc_feature (1136)..(1136): n is a, c, g, or t
  misc_feature (1139)..(1139): n is a, c, g, or t
  misc_feature (1144)..(1144): n is a, c, g, or t
  misc_feature (1158)..(1158): n is a, c, g, or t
  misc_feature (1166)..(1166): n is a, c, g, or t
  misc_feature (1168)..(1169): n is a, c, g, or t
  misc_feature (1174)..(1174): n is a, c, g, or t
  misc_feature (1179)..(1179): n is a, c, g, or t
  misc_feature (1181)..(1181): n is a, c, g, or t
  misc_feature (1185)..(1185): n is a, c, g, or t
  misc_feature (1191)..(1191): n is a, c, g, or t
  misc_feature (1194)..(1194): n is a, c, g, or t
  misc_feature (1196)..(1196): n is a, c, g, or t
  misc_feature (1205)..(1205): n is a, c, g, or t
  misc_feature (1209)..(1209): n is a, c, g, or t
  misc_feature (1214)..(1214): n is a, c, g, or t
  misc_feature (1219)..(1219): n is a, c, g, or t
  misc_feature (1226)..(1226): n is a, c, g, or t
  misc_feature (1237)..(1238): n is a, c, g, or t
  misc_feature (1240)..(1241): n is a, c, g, or t
agtggctgcctgaaagtgcaaggtatgatgtgctgtcagggaaccaggaaaaggcaatcgccaccttaaagaggatagcaactgaaaacggagctcccatgccgctggggaaactcatcatctccagacaggaagaccgaggcaaaatgagggaccttttcacaccccattttagatggacaactttgctgctgtggtttatatggttttccaatgcattctcttactacgggttagttctactcaccacagaactcttccaggcaggagatgtctgcggcatctccagtcggaagaaggctgtagaggcaaaatgcagcctggcctgcgagtacctgagtgaggaggattacatggacttgctgtggaccaccctctctgagtttccaggtgtccttgtgactctgtggattattgaccgcctggggcgcaagaagaccatggccctgtgctttgtcatcttctccttctgcagcctcctgctgtttatctgtgttggaagaaatgtgctcactctgttactcttcattgcaagagcgtttatttctggaggctttcaagcggcatatgtttacacacctgaggtctaccccacggcaacgcgggccctcggcctgggcacctgcagcggcatggcaagagtgggtgctctcatcactccgttcatcgcccaggtgatgctggaatcctctgtgtacctgactctggcagtttacagtggctgctgcctcctggctgccctggcctcctgctttttgcccattgagaccaaaggccgaggactgcaggagtccagccaccgggagtggggccaggagatggtcggccgaggaatgcacggtgcaggtgttaccaggtcgaactctggctctcaggaatagtgaccgatgggggactgagctggtctttgaggctgcagagcttggggggctggcaggccccaactggggcactgattgtcactgccgacatcaagaactcacccaagagtatgacctggaccaacagggttttgtgtcttgactcagtttgctcatcttcattgaggtccacccagggatgggggagatgtttgctctatgggggttctctgtatatgtggtgaaagctntgttcataacctgnggatctacatnggnagacnacccatattagganggtctggnanngccancaacnantcanacccancanantcacccggncaanccctngtgancaacaanatacttctgtnnannccgccaggctcaggcccatgtgacacctgctgtccacccaccggacctgttcagtaggtttctcccacacccacagccccaggctttcttctttgaaattgcaggcgatctaggtgtggtctgagcagctatttcctggcaggggccccccggtttgcctccctagagcctgaccagtggattctctggcagatggacatggtgcattcaaactggagccacatgcccccacccagccccctctggagttgccgttgttggcaccaagagatccagatgtgtccctggggacagctggtcttgcaccaggtgacaacctcagaacgccgttaccccctgggaactgaggactgaggccaaagtgaatcaagctgaagtcagagcacgggcctccccttctgaagcagcgaaggccacggttccgacttctttcctggccccctccttggtcaggctgaatggtgacttttattgttttttgagacggagtcttgatctgtcgcccaggctggagtgcagtagcgtgatctcggctcactgcaactctgcctcccgggttcaagcaattctcctgtctcagcctcccgagtagctgggattacaggtgcccacctgtactttttagtagagacagggtttcaccatgttggccaggctggtctcgaactcctgacctcaagtgatccacccgcctcggcctcccacagtgctgagattacaggtgggagccactgcacccggcctgaatgatgactcttgaggggaaaaagtttactcaggtttgcaggtacaaaatccaaaatccagggctttgggttttgtgcatgggtagacagctgaatgggcagagaaaccagaaggatgctacacccaccatctcatcccatggggatcaggggaccaggattccctgatgcgaagctgctcctctgtccagggacgtcttgatcattacacaaaggcagcccctggagttccattcatggagcctgccgtggagtggagaggggtgggaggactcaggtgtgtgaaatgtatatgttttcaaaggaagcagtgggaggccagttggttttgagttggtctccgcaggcaacatcacttctgggatttggtttactggagccttttttcccatggtgaaggcaggggacatagacaaggagggaggaagctggcagatcccatcaaaggccagagcagacagacctactgcttgaagtaaacattgcaaggaagccaatttgtgcgttcatctcttattaaaacatgtcagtgatggacattgcaagagcc

SEQ ID NO: 212467 - DNA, 1179 bp, Homo sapiens
  misc_feature (1129)..(1130): n is a, c, g, or t
  misc_feature (1133)..(1133): n is a, c, g, or t
catctgagacagccatatccagaaggaagaggagccgcgttccgtggctcacacctgtaaccccaccagtttgggaggccgaggcgggcggatcacctgaggctgaggccgggggtttgagaccagcctgaccaatatggagaaaccccgtctctactaaaaatacaaaattagccgggagtggtggcgcatgcctgtaattccagctactcgggaggctgaggcaggagagtcgcttgaacccgggaggcggaggttgcggtgagccgagatcgcgccattgcactctagcctgggcaacaagagggaaaactccgtctaaaaagaataagagggttacaagtagcctgaattttcctctcttcaaatagggacttctcaaagaaggtgaatctataatagtggtgtagattcagatataaggacacgtatttggcgtaaaggagaggcaaagttagaggaaccagaaagaatgctacacaaaagatggccggcttctcgcgtgaaggaagattcggatacgggggcctgatggatttagttgtaggcggtttgcctgcagcgagtaaattattcaaacgttcggacttcacaagactaaacttactggggataaaaattgagatttggccgggcgcgatggctcacgcctgtaatccctacactttgggaggccgaggcgggtggatgatctgagatcaggagttcgagaccagcctggccgaaatggcgaaaccccgtctctattaaaaatacaaaaattagccgggagtggtagcgtccgcctgtaatcccagctactcaggaggctgaagcaggagaatcggtggaacctgagaggcagaggctgtagtgagccgagatcgcgccactgcactccagcctgggcgacagagcaagactccgtctaaaaaaaaaaagaaaaaaaaaattgagatttggtcccatgcagtaagagggaatggagaacaggagccacccaactttggacattaaagttggagcaggcaaagatgaggccagctgtgtcgcgaagcctgggacatgggcagctcttattgcccaggctggagtagctcttattgcccaggctggagtagctcttattgcccaggctggagtagctctnntgnccaggctggagtagctcttaatgcccaggcaagagtggaccgagct

SEQ ID NO: 212468 - DNA, 1056 bp, Homo sapiens
  misc_feature (1006)..(1007): n is a, c, g, or t
  misc_feature (1010)..(1010): n is a, c, g, or t
tcccgggtcgactactactactaaattcgcggccgcgtcgaccaaaattagccgggagtggtggcgcatgcctgtaattccagctactcgggaggctgaggcaggagagtcgcttgaacccgggaggcggaggttgcggtgagccgagatcgcgccattgcactctagcctgggcaacaagagggaaaactccgtctaaaaagaataagagggttacaagtagcctgaattttcctctcttcaaatagggacttctcaaagaaggtgaatctataatagtggtgtagattcagatataaggacacgtatttggcgtaaaggagaggcaaagttagaggaaccagaaagaatgctacacaaaagatggccggcttctcgcgtgaaggaagattcggatacgggggcctgatggatttagttgtaggcggtttgcctgcagcgagtaaattattcaaacgttcggacttcacaagactaaacttactggggataaaaattgagatttggccgggcgcgatggctcacgcctgtaatccctacactttgggaggccgaggcgggtggatgatctgagatcaggagttcgagaccagcctggccgaaatggcgaaaccccgtctctattaaaaatacaaaaattagccgggagtggtagcgtccgcctgtaatcccagctactcaggaggctgaagcaggagaatcggtggaacctgagaggcagaggctgtagtgagccgagatcgcgccactgcactccagcctgggcgacagagcaagactccgtctaaaaaaaaaaagaaaaaaaaaattgagatttggtcccatgcagtaagagggaatggagaacaggagccacccaactttggacattaaagttggagcaggcaaagatgaggccagctgtgtcgcgaagcctgggacatgggcagctcttattgcccaggctggagtagctcttattgcccaggctggagtagctcttattgcccaggctggagtagctctnntgnccaggctggagtagctcttaatgcccaggcaagagtggaccgagct

SEQ ID NO: 212469 - DNA, 805 bp, Homo sapiens
gggacttctcaaagaaggtgaatctataatagtggtgtagattcagatataaggacacgtatttggcgtaaaggagaggcaaagttagaggaaccagaaagaatgctacacaaaagatggccggcttctcgcgtgaaggaagattcggatacgggggcctgatggatttagttgtaggcggtttgcctgcagcgagtaaattattcaaacgttcggacttcacaagactaaacttactggggataaaaattgagatttggccgggcgcgatggctcacgcctgtaatccctacactttgggaggccgaggcgggtggatgatctgagatcaggagttcgagaccagcctggccgaaatggcgaaaccccgtctctattaaaaatacaaaaattagccgggagtggtagcgtccgcctgtaatcccagctactcaggaggctgaagcaggagaatcggtggaacctgagaggcagaggctgtagtgagccgagatcgcgccactgcactccagcctgggcgacagagcaagactccgtctaaaaaaaaaaagaaaaaaaaaattgagatttggtcccatgcagtaagagggaatggagaacaggagccacccaactttggacattaaagttggagcaggcaaagatgaggccagctgtgtcgcgaagcctgggacatgggcagctcttgagtacaccgggttcgaggccaggggaaaccctcaaggtagagatggggttataaagcaaaccaataaaaaccggtgtatgagtcaaggagaggccttagtttagccatctgcccata

SEQ ID NO: 212470 - DNA, 208 bp, Homo sapiens
ctgtcacccctgaacctccctcctcctacagtggaatctgcctgtcctctggtggaagacattaaatttctatagaattcaattttggtgctagaaattcaattccagaccactctatcatttattttacttccctggactgttgaagaattgaaacaaagtatgtattttgtttttcccctaaatatgaaggccccaaaaattggca

SEQ ID NO: 212471 - DNA, 616 bp, Homo sapiens
catctctgcttgtaggtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttcttgttaataaaatgacccaagtttgtattcctccccacaagagaggaggcctatcttacctgggccttagaaagagccctgaaatagaattcagttcttggtggcttatcaaaagcacacaggggcctggcaggaagtgtaaaagcttgatgttaatcatactgggactaagaggatagagaatggtaggagctgggatacccctaaacattcacattaaaacaaaaaaaacccaaagctaaaaaacaactgggcaggagctaaataaaaatctaattttgagaggctgtatctggctcaggcctcctactttgtaacccatggaatatgtgaa

SEQ ID NO: 212472 - DNA, 575 bp, Homo sapiens
tagcaagaataatagttgctaaccttttctagttcttaataaatgtatgaagctggtaagattatcttatacttactgaccaattgaattttctctgcaacctatgaggcaggtactattatcttcacttgacagatgaggaaaatggagttctttgcaaaataaagtaacatgttcaggtcattctgctagtgcactttcagatccaggccatgagctgctaactattgtgacatatcactttctttgcatttattttatgtcattgttctcctttgaccctcataaaaaactattttgtgagttgcattatttatcattttaaaaataaagaaatataaaatgccaatattctttctttaaattaaaaaaatcctactaaataaaaactatttgttctaggtcagaggctggcagaatttttctgtaaagagtctgatagtaaatatttaaggctttatgggccttatgttttctgttgcagctccttcaactttgctatttagcatgaaagcggctatggacaatatttgaacaagtgggtgcaactgtgttccaataaaactttatttaca

SEQ ID NO: 212473 - DNA, 319 bp, Homo sapiens
gccaggtgcagtggctcatgcctgtaatcccagcactttgggaggctgaggcgggtggatcacctgaggtcaggagttcgagaccaccctggccaacatggtgaaaccccatctctactaaaaatacaaaaattatgctgggattacaggtgtgagccacggtgcctggccttaattttcataattaaaaaaaaattggggaaggggcagcaactttaatgtataaactaaatatgtagcaggaggtccagtgtggtggctcatgcctataatcccagcactttgggcagctgacatgggaggatcacctgagtctggg

SEQ ID NO: 212474 - DNA, 177 bp, Homo sapiens
tacctccaaaccaagaccagctacaaaatcttcatatgcttgacttcctcctgtattggtgagaatggagtgtttgtcttcttgtccttcagcaacataaaatactgcaatcttgtgtgtctctcggcactgccttgaatccaagttcctaagttctctaagtagcttttcattttt

SEQ ID NO: 212475 - DNA, 443 bp, Homo sapiens
cttggtgtgtgtatgcatgtgtttgaaggcatgtgcatttgaggggtgtgtgcacttgtgtggggatagattgcttgaggggcataggcaggtttgtgtgtgtgtgcatgtgcgcacacgtacctgtctgaagggcgagtctatgctggtgtgtctgggatgatgtggggtagggtaacactgggatgctgtgttagctggaaggaaagttgattggtgggaaagaatagactccccactgtcatcaggtgggttaggatttcatttggaggcccctaggagaggccatatctctacttttggggtctgcttttgccctgaactgggattatttcattacaaacgcacatatgtatgtacatacatacacatgtgaattttatatggatgacttcgctgtacgagcctgtggaatgcatctcacccaagccaccccattgtag

SEQ ID NO: 212476 - DNA, 627 bp, Homo sapiens
ccagcatctccatgtggttaacagcttctaaaatttatctcatgtgtttaaggttttttgtataaatttaagggacttcacatttctaaccagtgtgttaacacttagattaagaccacacttacacacccttttcttacttaagagcaattaaatggtgtactaacaagaagaaagttactttatttacagtgttgatggaaaaatattggcaatgtgataactattactataaaaatatgattttttaatacttctaaactaacctttgaaaaaggctgtgtcttttttctttttttcaaggcaaggttcttggaaccacttggtgagtctatatcgaatattttactttcttttttctgtgagacagcaaaaagttcatccaaatagaaccatgcttctaccacataaatcactcagaaaatctggtaactttccatgtgattcagttaaatcctttaaatcccacaggagaatttacttgcttttggcatatttcaccatattaggaggaaaaccagtctccagggacgtggtggttaacgtgaatgggccaaaggcagatgtcctaaactcagttttgttagcttaggcattttcagatggtgtttctcttggtcaaagttc

SEQ ID NO: 212477 - DNA, 89 bp, Homo sapiens
cagttcatataagttgaatccctgatgcagtgagcactcacatctgccattaaattaaatcaaattaaagcactttaatttgagtggtc

SEQ ID NO: 212478 - DNA, 438 bp, Homo sapiens
aaaatatatctaaaaactcaactcctgtggtcatctctttcaagtatttaaacctcagaattttctccagcaagcatataggccccatagagtccataagcttgcaatgtcttggccatgtgtacccatgtggtacattcaaccaccaaactggaatacgatattgcatttcctgggcaggattaagagtgagctctcttaggctcagatgacccccacaatcaaaggtaagagggctgtaactgaaatatcactcaacagtcatgccaggaataatggacactgaaacgactaccatgccttgtggtgagtgccctcctttggggattagcaagatggtaggggatgtgcagaagactgcaatgggtctcttaacccttccttccttcagtatataatccaggttattttagaaatagaacaccagtgatgtgtttg

SEQ ID NO: 212479 - DNA, 430 bp, Homo sapiens
tactcaagggtataggtaaaagatggtaacaatatactgtttagtaagataatagattaacatctctagtgattttttttttttgccagtggctttcaactgcaaataagttaaagaatattgtttctgtaggtaaatttttattctgtttttaatcatttaaatttattttaattttggtggctgcatgagtatctatttatgcaatatatggcatgttttaatacaggaatacaatatataataataatatcagcattaagtgaggcatccttcacctgtagcatttatcctatgttttacaatccaattctacacttttttttaaatttaaaatgtacaattaaattgttattgactacagggttatttttatggtcgtaataaaaattatatatgagtataaataaaattcattgttaaattctta

SEQ ID NO: 212480 - DNA, 423 bp, Homo sapiens
tcatctaccttcccactctccaaacccaggtgttccttatggggaataaacaaagaatccatgaaaaatagataactgcattaaaaattcagggatagagccttaataacacatatatactaggtcctaggtattacccatttcagactttttttttccagtttttgttttgaatctaaaattaactcctttttccatgtatgctgacacagaaagaaacagaaaagtgaggcaataattgagaaaactaaagcaaaatgaggaattgtctctaaaataaaatttaggaacaacttactcaggtttgtttatttagtctgtttcttctttaacccactgggttatttctccattttctacttttttgcaaacaatacctaacatacaataacttttataggttttcttcatccagaacactaa

SEQ ID NO: 212481 - DNA, 450 bp, Homo sapiens
cgttttgatgtgagagactatctcaggcccatcttctggacccgcactggtcaatatggtcaccattcgttatacattttatatcacccaaatcccagcatgtaatcaatataaaagttattgagtacttaacacttttttttttcacctcaagtctgaaatctggtgaatgtttgacatttacaacttgtctctgtatggactggccacatttcaaacgcagtaacgaatggtgaccatattggcgttttgatgtgagagagctgggatggcccatctggagacagaaaacgagagtggtttctgcagatcacagggcggcagagcccactgtggacagcaggagtcaggctgaggcagcgcagcttctcacgggggctcgggggaacccttgccagatgtggaagcaccagggctacggggccagccaaggcgggtgactctaggagc

SEQ ID NO: 212482 - DNA, 490 bp, Homo sapiens
gggaggggtgtggctgaggtgcttccctcgtgggctgctttgcccaccaggggatctcccccaagtactcacgggactctccaggggaccccctgtagaaccaggaccacccttaccaggcctaggaccctccaggactcctcatctgtgggactgggcctggctggtccccatgactgaattgagtggtgaagccaccttctcctggctccaggaatctcatggacccgggatcttgggtgttcacccctaaatcctccctaaggcccctcaggccaccctgccctgccaggagcccaccctaaaggtgagtgagaggcctccaggcagaggagacagccaggcagggccatgagcagggccggggaggaagctacgtggtgagcccggaaaggccggctctttgctttgggactcaatgttactgacctcattttttatgtatccgaagtgatcgtttcaaagaacaagccataaaactggactctgc

SEQ ID NO: 212483 - DNA, 615 bp, Homo sapiens
ccaggctggtctcgaactcctgacctcaggtgatctgccctccttggcctcccaaagtgctgggattacaggtgtgagccactgtgcccggccctctattcctaatacatgctggtcagcaaataattgattctaacagccacaacagaggcagcacagtgtgcttatccctgaaaaacctgagataaaaggcaagagagaaaggaaaaaagggaaaagataaggaaaaaaaccaaaaagatcatgagaagaaaaataaagacgggaaaaggagaagaggtggttatacatgccataaaggagcattagtactccatgttgatgggtctatgtttctttccatttgttatgctcccaccactgactggccaatcttctctctaccaatacctgttatagatcaacagatcaccatttgcttctctgaaggcctccagatgatttctggatgaaccttccactgtctattctaaaggcccacgttttccattctcccacactgcactgatccccatgacactttatgtccagaatgctactctctggccattcctgtcatccccaaacatttttgtttttaattccaacataacattttcaccttccaaaaacctt

SEQ ID NO: 212484 - DNA, 457 bp, Homo sapiens
tgagagtacccaccttctcccatcagctaaggtcagaagtatgactgggcttaatgaggaactctattagataaatctaagttgtctctccttcaggcagattaagctttttgtgtaaatactgcgtgttcactgaaaactgtgacttacatttgaccaatcctgggatcaagtccaatttcaatttgtagtaatacatgaaaaggttaggaagtatagggaaatgtatatctggatgatgggagcaagactggcgctcttctcccatcagtgaaggagaaaatatcaatgttctgccatgttgagcctgaacaagtgatctgtgtccacggtgtctcatccatctaccgagtccccttgttgttagaggagcaaggggtcgtagattattttcttcgaagacttgaccttcctattgagaggcagccaagaaaaatgctgatgggagcaagactgg

SEQ ID NO: 212485 - DNA, 384 bp, Homo sapiens
tgagagtacccaccttctcccatcagctaaggtcagaagtatgactgggcttaatgaggaactctattagataaatctaagttgtctctccttcaggcagattaagctttttgtgtaaatactgcgtgttcactgaaaactgtgacttacatttgaccaatcctgggatcaagtccaatttcaatttgtagtaatacatgaaaaggttaggaagtatagggaaatgtatatctggatggagccaagcgagcaaacctgcagggggtttggaagtggacttggtcaccgcagaagcgtgtgcgctgatcgcatcttctcccatcagaccttagaagtagctgcaatcttgtctgtcagatccctggaacacgagtcttcatacac

SEQ ID NO: 212486 - DNA, 488 bp, Homo sapiens
ccccaccctgcaaaaactgttaaacagaagagctactatgggtgaaccaggttgactcagaggctcttggttaggcctgtggacatgtacagccctggagggaaccttcctaactagatttgcagctgcataaacagtcagatccgagtagtgttgattggagggtcttctgccctggcatgccatgggggctctgcttttgttcttttcgtggtcagctatttcgtaataattatttttaatagttatatgttactaaaactttaaaaaaataaaagcttagacagtataaagaatgtctttttcctattctgctcaccttcagtttcctcctccaaggcccactgttgtgtttcttgcggttctttcaaagatattcttggaatatacaagcgtatgtatatatattccttgaaaaaacacacacatgtgtatgcacacaaactcacaaatgatagcacaattatacattgttctgcactttttcg

SEQ ID NO: 212487 - DNA, 894 bp, Homo sapiens
atggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatgcacccacagtgccccctcaggaggccacacttgttgcactggtgagcagcctgctagtggtgtttaccctggccttcctggggctcttcttcctctactgcaagcagttcttcaacagacattgccagcgtggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaa

SEQ ID NO: 212488 - DNA, 939 bp, Homo sapiens
atggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatgcacccacagtgccccctcaggaggccacacttgttgcactggtgagcagcctgctagtggtgtttaccctggccttcctggggctcttcttcctctactgcaagcagttcttcaacagacattgccagcgtggtaagggtggctgcttcatgtttcacatgaatcaggaacaaggctcttattggcagaagagagggatgttctggggttgagagacaatgggccttttctaccatgcttgaaaaccccatgaatagtcttctgttggcctggggaactatctggggctgcaatggaaagcatgggacttaagagattactgaagccaaccctgagagtttagaagacctggttcattatgtttcaggggattttaaaggaatgtggcacggtgggaaacccctcaggaaaggaatcgggagacctaggttctatgtctacctctaaatcaccgtgtaaccttagacaagtcatctagcctcttcagacctctttcttcctaatctttaagataagagataggattggatttgttgatttctgggttcttttcc

SEQ ID NO: 212489 - DNA, 90 bp, Homo sapiens
gcataatttgttgacggaatatatattcttgggcatgcaaattacatgaactgctgataagattcgagaaactcccttcttccccttgga

SEQ ID NO: 212490 - DNA, 1078 bp, Homo sapiens
aaaggagcctggaggagttggtcagcgctgcggggcaggattgcgcggaagtggacgccatcctgagggagatttccgagcgctgcgatgaagcccttcagagccgcgatcccaagcggccccgactgctgccagagcccgcgaatactgacaccaggcccgggaacctgcatggcgccttccgggggctgcgcacagactgcagccggagcgcgttgaacctgagccacagtgagctggaggagggcggctccttcagcacccgcatccgcagccacagcaccatccgcaccctcgccttcccccagggcaatgccttcaccatcagaacagccaacgggggttacaagttccgctgggtccccagttgagctgtgatgtggtcccccaaaacactgccctgtgtttccactgaagtgcctgggggcttcccagaactttgccttcaggttgaatgccaccctgaaacactttttcaggaacaaaagcatcttgataccgatgcattgtaaatttctgctacaaaacattgtatagcccctccccttgtcacagtgaaactctgtttatatatgtatatgtcacatatgtcacagccaattttaaaagtatttatttttagcagctttgaattatgtatttttagagcagggaaggatttagaaaccatagttacttttataattatgtaatgctctaatattataagaaggaaaagaaggctctaagagattaagtaatttcctgcaatgggaaacactggaacctttcaatcactttaactagtcacttaaggactctaggcccagaagcctggtttctgggtgaatgtttttatacatcactcaacttccctcgtcctaaaaggacacctaattttgttactattgaaaatttttattttggtggccagaatacgaaatcgggagaggtaacccaaacagttgtcttaggaaaaggcagattctcagaggcaatgggctatcaacaaaataggtgctaagcacatttgtttgtaatgatcattcatataatttagaagatttatggtaacagtttatattcattatccatacag

SEQ ID NO: 212491 - DNA, 382 bp, Homo sapiens
ataagaagaaataaactcgctagtaaaaattgcagacacacaaaaggcttgaacaggcacttcacaaaatagattatccaaatgaccaataaatacataagtactcaacatcattagccattagaaaaatgcaagttaaaaccacaatgagataccatttcacactagaatgaataaaattttaaaagactgacaatgctaaatattcccaggatgcagaacaaccaaaaccctcatatattatgggggacatggaaaattgtacaactcctttggaaaacaggtagtttctacagaatttcaatatatacataccatacaactcagccattgcattcctatttacccaacagaaataaaatcatttgtctactgaaaaatt

SEQ ID NO: 212492 - DNA, 1301 bp, Homo sapiens
ctgaggcgccgggagcctgcgccggcgtcctgccggcttcgtctcctcagcggccatgaggcggacaggccccgaggaggaggcctgcggcgtgtggctggacgcggcggcgctgaagaggcggaaagtgcagacacatttaatcaaaccaggcaccaaaatgctaacactccttcctggagaaagaaaggctaatatttattttactcaaagaagagctccatctacaggcattcaccagagaagcattgcttccttcttcaccttgcagccaggaaagacaaatggcagtgaccagaagagtgtttcatctcatacagaaagtcagatcaacaaagagtccaagaaaaatgcgacccagctagaccatttgatcccaggcttagcacacgattgcatggcatcccctttagccacttcaaccactgcagacatccaggaagctggactctctcctcagtccctccagacttctggccaccacagaatgaaaaccccattttcaactgagctatctttgctccagcctgatactccagactgtgctggagatagtcataccccactggctttttccttcaccgaggacttggaaagttcttgtttgctagaccgaaaggaagaaaaaggggattctgccaggaaatgggaatggcttcatgagtctaagaagaactatcagagtatggagaaacacaccaaactacctggggacaaatgctgtcagcccttaggcaagactaaattggaaagaaaggtgtctgccaaagaaaacaggcaggcccctgtcctccttcaaacatacagggaatcctggaatggagaaaacatagaatcagtgaaacaaagccgtagtccagtttctgtgttttcctgggacaatgaaaagaatgacaaggactcctggagtcaacttttcactgaagattctcaaggccagcgggtcattgcccacaacactagagctccttttcaagatgtaaccaataactggaattgggacttagggccgtttcctaacagtccttgggctcagtgccaggaggatgggccaactcaaaatctgaagcctgatttgctctttacccaggactctgaaggtaatcaagttatcagacaccaattctaaatgtttgaagctttgtttctaaaagtaccttgaaatgatagagatgtaggaaaatatagttgtgggtggagagaggagtgagtttgtttaggtgggaaggtggcatgggatgaagttgtcattactgagcatcttctctgtgtaaataaagggcagtaccattgttaagaca

SEQ ID NO: 212493 - DNA, 1353 bp, Homo sapiens
ttctttgcatatttccttcattctaaagtgttccctggccgggagcgtggctttcgcctgtaatcccaacacttcgggaggccaggtgggcagatcacctgaggtcaggagttcgagaccagcttggccaacatggtgaaacctcatctctactaaaaatacaaaaattacgattctcctgcctcagcctcccgaatagcagggactacaggcatgcgccaccacgcccagctaattttttttggatttttagtagagacgaggtttcaccatattagccaggatggtctccatctcctgacctcctgatccgcccacctcagcctcccaaagtgctgagattacaggcataagccaccgcgcccagccagatgtgtgagcttttaatctctggctgatcttaacccacatcagcctaagcttgggatgattactcttgacccttttttttcagtgattagcaaatctccccacaacccaggtgtggagagaagagaggtagaatggtgctagtttcctattttatttttgtggtaactgtacagcactttaaagttatatactctatgtttaaatatctcccttaaaaagcctgagctgtacaacaatctggatgtgactctgttacccttttcccacaagataggagggaatcccctttgtaaaactatgaatccaaataaatgtttacaaagtggctcttgtgataattggtaattaaaccattaccaattttatttttgaaaaggcaacactgtaatagtatatgctgtcattgccctgagcctgatctgaaccagagtctagtttgacctgtcttctacccaaggcattattccttgttgttgatgtggtatctaagaggcttaaacaacctctaagggacaaacttgcaaggttataagagaactgcttctttttttttttttaacttaaattttatttttttgagacacggtctcgctctcttgcccaggctggagtgtggtggcatgaacacggttcactgcagcctggacctcctgggcgcaagtgattctcccacctcagcctcccgagtagctgaactataggcacatgccaccatgcccagctaattatttttaaaatattttgtagagatgaggtcttgctttgttgcccaggctgatcttgaactcccaaagtgctgtgattagaggtgtgagccactgtgcctggcctaatttaaatgttaaattctacttttatcgtgtatgtcatctctccagtcattttcctggaagacctgcttttaagaatgtatggggcttagtgcggtggctcatgtctgtaatctcaacgctctgggaggctgaggtgggaggtttgctt

SEQ ID NO: 212494 - DNA, 1124 bp, Homo sapiens
ctgaggcgccgggagcctgcgccggcgtcctgccggcttcgtctcctcagcggccatgaggcggacaggccccgaggaggaggcctgcggcgtgtggctggacgcggcggcgctgaagaggcggaaagtgcagacacatttaatcaaaccaggcaccaaaatgctaacactccttcctggagaaagaaaggctaatatttattttactcaaagaagagctccatctacaggcattcaccagagaagcattgcttccttcttcaccttgcagccaggaaagacaaatggcagtgaccagaagagtgtttcatctcatacagaaagtcagatcaacaaagagtccaagaaaaatgcgacccagctagaccatttgatcccaggcttagcacacgattgcatggcatcccctttagccacttcaaccactgcagacatccaggaagctggactctctcctcagtccctccagacttctggccaccacagaatgaaaaccccattttcaactgagctatctttgctccagcctgatactccagactgtgctggagatagtcataccccactggctttttccttcaccgaggacttggaaagttcttgtttgctagaccgaaaggaagaaaaaggggattctgccaggaaatgggaatggcttcatgagtctaagaagaactatcagagtatggagaaacacaccaaactacctggggacaaatgctgtcagcccttaggcaagactaaattggaaagaaaggtgtctgccaaagaaaacaggcaggcccctgtcctctttcaagatgtaaccaataactggaattgggacttagggccgtttcctaacagtccttgggctcagtgccaggaggatgggccaactcaaaatctgaagcctgatttgctctttacccaggactctgaaggtaatcaagttatcagacaccaattctaaatgtttgaagctttgtttctaaaagtaccttgaaatgatagagatgtaggaaaatatagttgtgggtggagagaggagtgagtttgtttaggtgggaaggtggcatgggatgaagttgtcattactgagcatcttctctgtgtaaataaagggcagtaccattgttaagaca

SEQ ID NO: 212495 - DNA, 2772 bp, Homo sapiens
ctgaggcgccgggagcctgcgccggcgtcctgccggcttcgtctcctcagcggccatgaggcggacaggccccgaggaggaggcctgcggcgtgtggctggacgcggcggcgctgaagaggcggaaagtgcagacacatttaatcaaaccaggcaccaaaatgctaacactccttcctggagaaagaaaggctaatatttattttactcaaagaagagctccatctacaggcattcaccagagaagcattgcttccttcttcaccttgcagccaggaaagacaaatggcagtgaccagaagagtgtttcatctcatacagaaagtcagatcaacaaagagtccaagaaaaatgcgacccagctagaccatttgatcccaggcttagcacacgattgcatggcatcccctttagccacttcaaccactgcagacatccaggaagctggactctctcctcagtccctccagacttctggccaccacagaatgaaaaccccattttcaactgagctatctttgctccagcctgatactccagactgtgctggagatagtcataccccactggctttttccttcaccgaggacttggaaagttcttgtttgctagaccgaaaggaagaaaaaggggattctgccaggaaatgggaatggcttcatgagtctaagaagaactatcagagtatggagaaacacaccaaactacctggggacaaatgctgtcagcccttaggcaagactaaattggaaagaaaggtgtctgccaaagaaaacaggcaggcccctgtcctccttcaaacatacagggaatcctggaatggagaaaacatagaatcagtgaaacaaagccgtagtccagtttctgtgttttcctgggacaatgaaaagaatgacaaggactcctggagtcaacttttcactgaagattctcaaggccagcgggtcattgcccacaacactagagctccttttcaagatgtaaccaataactggaattgggacttagggccgtttcctaacagtccttgggctcagtgccaggaggatgggccaactcaaaatctgaagcctgatttgctctttacccaggactctgaaggtaatcaagttatcagacaccaattctaaatgtttgaagctttgtttctaaaagtaccttgaaatgatagagatgtaggaaaatatagttgtgggtggagagaggagtgagtttgtttaggtgggaaggtggcatgggatgaagttgtcattactgagcatcttctctgtgtaaataaagggcagtaccattgttaagacagtgggattggcatcatggctttccctcaggaaggtggtggctggtaaattccctgaatgagtctatgatgaacactgaggcagcacagtgggtatttatctctatgaaagtgccttttactcagcctgcacagagccatctctttgcccttccagatgtctgactgggaccttgcttatggatgtgtttttttttttttttttttgagatggagtctcgctctgtcgccaggctggagtgcagtggtgcgacctcagctcactgcaccctctgtgtcccggattcaagcgattctcctgcctcagcctcccgaatagcagggactacaggcatgcgccaccacgcccagctaattttttttggatttttagtagagacgaggtttcaccatattagccaggatggtctccatctcctgacctcctgatccgcccacctcagcctcccaaagtgctgagattacaggcataagccaccgcgcccagccagatgtgtgagcttttaatctctggctgatcttaacccacatcagcctaagcttgggatgattactcttgacccttttttttcagtgattagcaaatctccccacaacccaggtgtggagagaagagaggtagaatggtgctagtttcctattttatttttgtggtaactgtacagcactttaaagttatatactctatgtttaaatatctcccttaaaaagcctgagctgtacaacaatctggatgtgactctgttacccttttcccacaagataggagggaatcccctttgtaaaactatgaatccaaataaatgtttacaaagtggctcttgtgataattggtaattaaaccattaccaattttatttttgaaaaggcaacactgtaatagtatatgctgtcattgccctgagcctgatctgaaccagagtctagtttgacctgtcttctacccaaggcattattccttgttgttgatgtggtatctaagaggcttaaacaacctctaagggacaaacttgcaaggttataagagaactgcttctttttttttttttaacttaaattttatttttttgagacacggtctcgctctcttgcccaggctggagtgtggtggcatgaacacggttcactgcagcctggacctcctgggcgcaagtgattctcccacctcagcctcccgagtagctgaactataggcacatgccaccatgcccagctaattatttttaaaatattttgtagagatgaggtcttgctttgttgcccaggctgatcttgaactcccaaagtgctgtgattagaggtgtgagccactgtgcctggcctaatttaaatgttaaattctacttttatcgtgtatgtcatctctccagtcattttcctggaagacctgcttttaagaatgtatggggcttagtgcggtggctcatgtctgtaatctcaacgctctgggaggctgaggtgggaggtttgctt

SEQ ID NO: 212496 - DNA, 1257 bp, Homo sapiens
ctgaggcgccgggagcctgcgccggcgtcctgccggcttcgtctcctcagcggccatgaggcggacaggccccgaggaggaggcctgcggcgtgtggctggacgcggcggcgctgaagaggcggaaagtgcagacacatttaatcaaaccaggcaccaaaatgctaacactccttcctggagaaagaaaggctaatatttattttactcaaagaagagctccatctacaggcattcaccagagaagcattgcttccttcttcaccttgcagccagatgtgtgagcttttaatctctggctgatcttaacccacatcagcctaagcttgggatgattactcttgacccttttttttcagtgattagcaaatctccccacaacccaggtgtggagagaagagaggtagaatggtgctagtttcctattttatttttgtggtaactgtacagcactttaaagttatatactctatgtttaaatatctcccttaaaaagcctgagctgtacaacaatctggatgtgactctgttacccttttcccacaagataggagggaatcccctttgtaaaactatgaatccaaataaatgtttacaaagtggctcttgtgataattggtaattaaaccattaccaattttatttttgaaaaggcaacactgtaatagtatatgctgtcattgccctgagcctgatctgaaccagagtctagtttgacctgtcttctacccaaggcattattccttgttgttgatgtggtatctaagaggcttaaacaacctctaagggacaaacttgcaaggttataagagaactgcttctttttttttttttaacttaaattttatttttttgagacacggtctcgctctcttgcccaggctggagtgtggtggcatgaacacggttcactgcagcctggacctcctgggcgcaagtgattctcccacctcagcctcccgagtagctgaactataggcacatgccaccatgcccagctaattatttttaaaatattttgtagagatgaggtcttgctttgttgcccaggctgatcttgaactcccaaagtgctgtgattagaggtgtgagccactgtgcctggcctaatttaaatgttaaattctacttttatcgtgtatgtcatctctccagtcattttcctggaagacctgcttttaagaatgtatggggcttagtgcggtggctcatgtctgtaatctcaacgctctgggaggctgaggtgggaggtttgctt

SEQ ID NO: 212497 - DNA, 787 bp, Homo sapiens
tgtggctttgaacaagttatgtcttttccattttgtcatttccataatgaatataaagctaacttataaactagaatattttgataattagtgattataaaacaaaggactagagatacaacttttattataatagtgaaaagtgaaaatggaactggctatataggaagaagccattaatcttgatgacagaaactttgggtcagattcccacaacagattcttcacaggatctaacagaatcatccagtaaggaatggggagcatgtccttttgctcccatgcctccataggctcagtccagtctgacctcagaaacaggctcttgccctgggcaggaggaatgtaaagattccctccacccaaattccgagctcaaaattaaattccatttttttgctgttggtgacagcatctgctgtacacacaagatgttgcctgatctctctggtgtccgtttctggcttttggttggccaaacccacaagtctccaaattcttagttggagtcctcatgcctactgcctgaccattctctcctcactgcttgtctccttgagcttacttccttgcctgaacatcactgtctcagccagcttccatcttgcagcctctgatatgcagaagacattaactcccaccctaccccagcctccttggcagcccacctggtttgtcactgaccttccagatccaagcatgacagtttaatctccatatccaatcctcccctgacctgattaattttgcacttaagcaacttccatgataagttatactttttttc

SEQ ID NO: 212498 - DNA, 505 bp, Homo sapiens
aggctccattcccttcagttagaactattactatatatagattgaagcctctcaaaagcccttggtctttctgtgctctatttctagctgaattcctcagtcctttcgttctttctttccttttgaaatatgccatacatatagaaaaacttaattattattgttcatatgtttttttaaaagatcatccatgtaataaatcacccagcataagaaatcggtcactgacagcacccagaggctactctccttccagaggcaaccaccatcctgtcctatgtgatgattaagaaaagataaaaatgttactacatgtatttgcatctctaatcaatgtagtttagtttttacttgtttaaactttatataactggaagtatagcctatgtattttttgtgacttacttcctttactcaagattgctttagcgccatccacagagaacagtactctgttcatttttattgatgtatatagttcattgaataaatgcaccaatctgtg

SEQ ID NO: 212499 - DNA, 1448 bp, Homo sapiens
aagtgagaagagttagtttctattccaaacttgaccaagaatttggtttgactgagaacgttttcctctcagtttttgtacatttatttagagcagtggttctcagtggaggtcagttttgatcgccaggggacatctggcaatgttgagacattttggttgtcacagcttgggggtgggttcaggggagggttgctactggtgtctagtagttagaagccagagatgtttctaaacatcttataatgcacaggacagcacccctccactgtaaagaattattggttcaaaaatatcggtactgccaaggttgagaaactctgatatagaaggagtgataaatattgttttcacccaaaggaatacttttaaaggatgaagcttactaaacatatatgatggaagtattattcagataacattaatattctgctgaataattttttctagtttaatcatactagaaaaagaaaaaaaatctacaaattgtcctataaaataaggacaaacatgcaaataatttaactctcagaaagtactaattcattctgattatctttcatacctctgtgctcctctgcactgacgaagacataatatgattatacctatgaactagtgcacagccttttctggcaagaaaatagtttgtagcagatacgtggttgctctttggatttttttctattgttgaacatgctgggactagctagaatgcacattcctacttcctttaccaaacgtttgcatgcttcctgcaaagcacttaccaagtgatttctcttgaaccatcggatataattttgtatgtacatgtttgaggaaaaaaatgtaaagcaaaaccttttactgaacagtgttctatagaattatgacactaaaacaaaattgtttgtggaagccctgaaagctttatagtcctggacatcaaaaattttatttgagatgatgaatgttttgttttcatcttttcttatattaccacaattgagatattttagtaattgaaggaacatacacagatatttggcagaagtcgagtaaggaggggaaaaaaagagtccgtgagtttcagtcattttcactgctcttttcaaaaagattgtgttgagctggtagaagactaaagatgtcactgaagacatcacagatactatatttatcttttggctttgtgtacattagagaatgttgattatttttatacaaaaatacagcgggtaatttttttaatctttagatgcctcttgtttgaatgtatgctttgtggaattctttgtgtagtaatgttttaaaaaaagatgtttactgatagttacatgtaggattagaatatgtaatataatataaggctcatgttccagacctacgatagcttgtagtctatgttacgtatttctttatatcacatttttaatcattggattaaagtatcaaggaaagctaaa

SEQ ID NO: 212500 - DNA, 861 bp, Homo sapiens
tgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaagtaagcatcatgtgtaatattgtcccgtttcttcttattgttcccctgtttcttcccgtagggctcgaattgacagactccacccagaatggcaaaatcacttgccttaatgccaagtgacgtagattcaaagttatgagctatatta

SEQ ID NO: 212501 - DNA, 5691 bp, Homo sapiens
tgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaaaaaaaaaaaaaatagcattcctgcacatctgtacccacgccttcttcaaagccatactatttatgtgctccggatccatcatccacaaccttaacaatgaacaagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgagccctatctattactctcatcgctacctccctgacaagcgcctatagcactcgaataattcttctcaccctaacaggtcaacctcgcttcccc

SEQ ID NO: 212502 - DNA, 4328 bp, Homo sapiens
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgttcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttatttgagagcttcatgaagacacttgtaacatattcaacgtcctgtactccagttttgactacgagatcagattttggaggtgtaagtaatcttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagacaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaaaaaaaaaaaaaatagcattcctgcacatctgtacccacgccttcttcaaagccatactatttatgtgctccggatccatcatccacaaccttaacaatgaacaagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgagccctatctattactctcatcgctacctccctgacaagcgcctatagcactcgaataattcttctcaccctaacaggtcaacctcgcttcccc

SEQ ID NO: 212503 - DNA, 3296 bp, Homo sapiens
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaaaaaaaaaaaaaatagcattcctgcacatctgtacccacgccttcttcaaagccatactatttatgtgctccggatccatcatccacaaccttaacaatgaacaagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgagccctatctattactctcatcgctacctccctgacaagcgcctatagcactcgaataattcttctcaccctaacaggtcaacctcgcttcccc

SEQ ID NO: 212504 - DNA, 4770 bp, Homo sapiens
tgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccactcttgagctggcccttctatgggcttcctaggccttctttgtcgggaccgtagacttaatccttatcttgttccgcgtgtctatcttaggaccgtctccccatgaaaaagcgggacaaatttctaccgggcccactaccggactaatg

SEQ ID NO: 212505 - DNA, 3897 bp, Homo sapiens
tgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcaggtaacctcatcaactgcattttctattaaatattaggagttggttttgtaaggggaacagctcaccattccataagcccttatcaggtttagttgaaaattaaataaactctgatgtttttta

SEQ ID NO: 212506 - DNA, 839 bp, Homo sapiens
ggatggagataatggaagcagtggggaaggagagaaaatacccttcctatcacacacactcacacactcacactacacactatttctacagtcacaactacccaactgttattgatcctttataactgcaattgagtacagatgtaggaagattgagagggaactgggatctggcgcctggattgctcaagagaggtcagggaaacccctcagaactcctgagacccagagattgagggaggggttgaggcggagtctgcaatgggggctgtccagcagtagcaagcagcgggccgatcctggtggagggttgggaggctgctgtcattttatgggtcggcagccagagtgagagtgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaaggtaggggagctcctccacccctttttcccagcggtccgggcggca

SEQ ID NO: 212507 - DNA, 790 bp, Homo sapiens
ggatggatggactgtgaagcaatgtgaaataattctttctttaagaagatctgaaagcaaatggataaaggaaaaatattaccatgattattatttttttaattttactttaagttcaggggtacatcagaaaatataccttaaaaattagatgtattttaaataaatgttaaagcacttctggatggttaatactaccacaaagaacttacaagatatttgatcctggttattttttagcccttacctcgtgatgagaaagccaacaattgttaacttttcctgattatctacttctattttgtacacataattttgttgggtaggagtacataaagatacacagtgtagacccatccctagttttattgatttgaatgccgtatttgagttttgttatttggaagactgtaaaaatactgaactcttatttattattctttaatggtacctttagtttagaggtgtaattgaacttgacaaaaggagggaacatttaaaacacctaattttttttcattaatcgacttgtctatacccagggcctttccaggtgtctattcatgtatcttctcttttttatatatgatttagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtaagtaacaaagagatcattttacacttactgg

SEQ ID NO: 212508 - DNA, 5607 bp, Homo sapiens
tgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaaaaaaaaaaaaaatagcattcctgcacatctgtacccacgccttcttcaaagccatactatttatgtgctccggatccatcatccacaaccttaacaatgaacaagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgagccctatctattactctcatcgctacctccctgacaagcgcctatagcactcgaataattcttctcaccctaacaggtcaacctcgcttcccc

SEQ ID NO: 212509 - DNA, 4412 bp, Homo sapiens
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgttcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttatttgagagcttcatgaagacacttgtaacatattcaacgtcctgtactccagttttgactacgagatcagattttggaggtgtaagtaatcttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagacaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaaaaaaaaaaaaaatagcattcctgcacatctgtacccacgccttcttcaaagccatactatttatgtgctccggatccatcatccacaaccttaacaatgaacaagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgagccctatctattactctcatcgctacctccctgacaagcgcctatagcactcgaataattcttctcaccctaacaggtcaacctcgcttcccc

SEQ ID NO: 212510 - DNA, 3380 bp, Homo sapiens
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaaaaaaaaaaaaaatagcattcctgcacatctgtacccacgccttcttcaaagccatactatttatgtgctccggatccatcatccacaaccttaacaatgaacaagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgagccctatctattactctcatcgctacctccctgacaagcgcctatagcactcgaataattcttctcaccctaacaggtcaacctcgcttcccc

SEQ ID NO: 212511 - DNA, 6274 bp, Homo sapiens
tgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgttcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttatttgagagcttcatgaagacacttgtaacatattcaacgtcctgtactccagttttgactacgagatcagattttggaggtgagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaaaaaaaaaaaaaatagcattcctgcacatctgtacccacgccttcttcaaagccatactatttatgtgctccggatccatcatccacaaccttaacaatgaacaagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgagccctatctattactctcatcgctacctccctgacaagcgcctatagcactcgaataattcttctcaccctaacaggtcaacctcgcttcccc

SEQ ID NO: 212512 - DNA, 5349 bp, Homo sapiens
tgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgttcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttatttgagagcttcatgaagacacttgtaacatattcaacgtcctgtactccagttttgactacgagatcagattttggaggtgtaagtaatcttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagacaaacaaatttgctgtgtgtgtgtgagtgtgaatgtgtgtatgtctctttctctctctccctctcctctaccccaacacagatggtggtgccacagataggaggactctgggtccctgaatcaccacttggggcagggatatctggtagcattggcccattatgtgatcaagaaatagatttctattgcattgtcactgaaacttggtcattgtcagttacagcaatcaacctgcccttaactaatatggcagcacaaggataacctttacaacaatgttccgtctaagttacaataggaagttttcagagcaatggtgtgtgactgcccagtaaaattcccagaagacagttaaagatgaagcagtgcagagcaaagtaaacccacaatgcaaaacaagggttcaggaaaggccacaaaagcaataatggttcctttaataaataaactttttaacagaaataaaaaaaatctt

SEQ ID NO: 212513 - DNA, 2256 bp, Homo sapiens
tgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtggtaatcttcccttaaccaactgtcagtctttcctatgggaacaggcaaacctttatgtaccaaatgtgtctttaagaaattatctataaatttgattattttgtaaatacaca

SEQ ID NO: 212514 - DNA, 787 bp, Homo sapiens
gatctgaagagcccatcccagaaaatgctctatgccaacagtaaagacatatgcacaaaaaagactttgttcccaagaactaatttctttccaagataccttttcaattcctctaaattacagaaagtgacatacttctacttagtgctaagctcgacttatcaccgtggagttgctgacagtctccaaccagccagcgttcctaccttcccttctacaagaggggtgtgccctattccttgagctagggtacgggcactcagcagcagaaaggtggcccatgacagacttgaaagcgcacaccaggaattgtctgaaactcagagaatgctggaattaactttcttcctgtgacctttaacctagctgaattttcttccatttccagtactaatcgtactttcttctcacttgcagaattccctgttctgtcctgcctgacacgttctcttcttggttcttttcacctgaaccttattctgatctgttacttcctcctgtccaagacctaagcactgaacatacctcacatatttaaatgttacctccttcaactgagtgaaacggtattcattgctcctatacaactgctctttagccggccgggcgcagtggctcacgcctgtaatcccagcactgtgggaggccaaggcgggcggatcacgaggtcaggagatcaagactatcctggctaacacggtgaaaccccgtctctactaaaaatacaaaaaattagccaggcgtggtggtgggcgcctgtagtcccagctactcgggaggctgagcc

SEQ ID NO: 212515 - DNA, 524 bp, Homo sapiens
gacacagttcagagaaaccagaacccagcggctgcaaaggcagagcaagccaaactcctcagagacatcagggcttagcagcagaacatgaaacgaccggcaatcctaccatgtgctaaatatttgaatcttcccaaagcaatgccactttgtgctcagacatctacagtgactctgtgtggctgatagccaacagtcctacccccttgtcctggttcaggggctccatatcaagccctaggtcagcattccaatattactctctacttcattctgctgaaatgctccattgaggtctgacccatctactactcatttgcaccagagttgaataactcctacctccagggtccaggcaggtagtgaaatagatgacacattcatgggtagcaatagggaacagtagggactgtggcaaactagagtgtccacaccctataaaaggggcagtttccacctgaggtcagcagttcgaagccagcctggccaacaaggcaaaaccccgcctctactaaaaaaaaaaa

SEQ ID NO: 212516 - DNA, 329 bp, Homo sapiens
tctcacacctgggtgtcagatacccttaaagagtcttattcaggtgcagcgcagctgttgacactcggaaggctgaggtgggaggatcacttgaggccaggagttcaagactgcagtgagctatggtcgtatcactgcattccagtctgggtgatagagcgaggccccctctctaaaaaagagtcctctcattttgatgagagaatgcttttatatccatgggagctttggactgtgtgacttgttccctgaatttcaatctcatcattgttatcttcttggcttctctccatgatatcctggatattaaatattaaaatccaatttaa

SEQ ID NO: 212517 - DNA, 704 bp, Homo sapiens
agatagtttttgtaaaattcttactgtcattttgggtacaaaacagacacataaaaatgacggtttttattatgctaggcagaggaaacatcattttcctattctggaatgcacacctgacaaacttctactcattatgtaagtcttaattcaaatgttatatttatttattctattaacatttcttaagaaactaatataatgctctttgctattataaggtacttggagaaaaaagttataaacttaagatctctgatctcaagggatgcacattttttttttttttagagggcgttttgctcttgtcatccagactggagtgcagtggcacgattttggcacaccacaacctcccactccaaggttcaagcaattctcctgcttcaacctcctgagtagctgggattacaggtgcccaccaccacacctgctaatttttttttttttccgttttagtagagacgggtcttcgccatgttggccaggctggtcttgaactcctgacctcagatgatctgcccatgtcggcctcccagagtgctgggattataggtgtgagccactgtgcccggctgggatgtcctctttaatggacaggttaacagaccattatgtgaagtgtggtaagtgtccaaagaaagcgatgtccagtgggctttgcaggccagaggacaggctacaaggagagtcagataaggcca

SEQ ID NO: 212518 - DNA, 154 bp, Homo sapiens
gttttgaccaatgtcatttgaatagaaggaatttttacaaggccttcccatggtcccttatgagctgtattagcatgagtggtgacagagtttttatcagctgtcttcctaaatgactgtctccttgtaaacttattatagagactgaattggt

SEQ ID NO: 212519 - DNA, 314 bp, Homo sapiens
ttgaatctctgagtatgattaaaacccttcagtcatttgttggtatgattgaactacgggttctcccacggctagtttcaaagaattatatttctgtctagtgtcagaatgaccctattttttttaatgtgttatgaatcttcagttgtgcatacagaatttcatattaatttagaatgccatgctaataagcgtacactcagagatggccataatttaaagctagcagtagtatctcatggagaaatgaactctactcctcccataatgtgctacaaacaaatgagaaccatgctctttgtctttgtctctga

SEQ ID NO: 212520 - DNA, 172 bp, Homo sapiens
ctgtgttcatatcattggtcaggcactattttaagataactgggtggtctgattatatgctaaagcatacaaaaatgacagtagcatgccaccaaattatttgcttttatctgaaattcaaattttaatgggcagtcaggcatttacattaaacattacttggtaatcttct

SEQ ID NO: 212521 - DNA, 176 bp, Homo sapiens
cttcaaaatataatatgttttatagatagaactgggtttttaagtagctggtggtagatgcttttatgatttatgttttgtaagtttcaattctttgaccaatctctgtttgtccatctctaatttctggttggctgtgtctgttctatgatgatactgagaaaagttacaaagag

SEQ ID NO: 212522 - DNA, 525 bp, Homo sapiens
tcactgcaaccttgacctcctgggctcaagtgattctcccacctcagccttccaagtagctgggaccacagatgtgtgccaacatgctcagataattattttactttttacagagacagggtcttcctgtgttgcccaggctggtctcgaacttctgggctcaagtcaccctcctgccttggactcccaacatgctgggattacaggcatgagccactgagcctgacctcctctttctttaacactggctttgaggagggcacaatggtagtgaattgagtatccctgagaaagcttcaagctggaggtacacatcagagaatcctggttactgctctaacctgtcctcactgcccccactccctgtgagctgggaccatactctgcctttccctgggccttgaaagtctcacagcggagccaggtggaaatggaatcacatgatttgggagtaagaaggactcacccactctaagacacccttccacggcatcaggcacccactacatcattcctgatcagcag

SEQ ID NO: 212523 - DNA, 1281 bp, Homo sapiens
agagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccaggtcccccatgccctcatactggccagatgggcctttgttcattcagacctatctatccaccctggggctttgtgtcgggtcacttatctggcccaccacttcccgtatctcatagcgaatttggcctttttcacactcccgtccgcccacttgggtatctctcgacccgcttacacctccaacgggctcctcaacaagttcgcacctgttccacttatcctcctctacctctctcgtacacctctcacctgactatcccctcctttacctctcctcttctctcctcttctttccgcgggtcacctgcacgccctcgaccaccccctgtactttcatctcctccttcactgcttcattcccgacttcgtctccttcttctcttctatcgcactaccaccctcctcgctctgtcacgctctttacactccgtcacacctgccgtctatctcatctctcgcggcgctctactgccatctttccctctcctcagcctatgcttcgctctctgctctccccc

SEQ ID NO: 212524 - DNA, 410 bp, Homo sapiens
cagaatctgtgaatagaaattgaccatagcagaaaatgacccgaccgcttctggaatgcagaaatctcttccaaaacagctctgacattgttatttctattatttatcaaacattgtatttggccattcttgcatggctgtaaacacctgactcacgccggtaatcccagcattctgggaagctgtggcaggcagatcgcttgaacccaggggtttgagaccagcctgggcaacatggtgaaatcccatctctacaaaaaatacagaaattagctggccttggtggtgcatgcctgtagtcctagctaccgggaggctaaggtgggaggagcctaggaggttggggctgcagtgagctgagattgcgtcactgcactacagcctgggagactgaatgagatcctgtcttt

SEQ ID NO: 212525 - DNA, 578 bp, Homo sapiens
ctgtcgcctcacctccttatgctcatccctcctcatgctcatccctccttatgctaatcccttgaggcagcaaaccaggggagacctcagctttgaggtgggctggggtttgaccctaggttagaagatggaggaacgtcaccctggttaggaatgcattgtggccagaagcatgttagttgacagatttgccgtaaattagactaaatgtggccacagagatgctttcctccaccacaaggcattttgtttagcaaaaatggcctgtgggtgtttaagctaggtttccatccagatggatgaggctggattagaaatagctgacacctgggatagactattgttgagttgttggtgcatagcccaaaactaattaagggattagtctgtgatggtggaatatcaccatcttggggcgtgtcatcagggtccgcgctgccagggtgctaaggttgagggtggacaccttcctgtgatgggagagtgtgtcatagaacagctctgtactccgtccttgaaagaggaacaactttcataggttgccggtgacagaatgcgttgtcagactttaagaaggg

SEQ ID NO: 212526 - DNA, 293 bp, Homo sapiens
agcttgtattagcattctttgttagttttggagagaaggatttggatctataaaatctaagttgattgcaaaaaattgtcaggccactttatacccatttttaagattgacaagtgaaaatttgttttagtgacttaccagatgaaataagaatagaccagaaagatctctaagatcttttgtagtttttacgatctacaagtttctacacccagtgtaatattaattacttaataagaaaagtttttgagatgactagtgtaactgttactctgatcccttcataactagaa

SEQ ID NO: 212527 - DNA, 477 bp, Homo sapiens
ccaaaatagcatttggttgaaaaaactcaaatgcctatcaaaggatgaataaataaaatgtgctacatgcatgtacacatgaatacataaatggtcagttatacaaatgaatgaagtactgatgacatgttgcatgaatgagccccaaaaaacatactgagtgaaagaagccaaatgcaaattccacattttatactttcatttatatcaaatactctgaataggtaaatctatagagaaataaagcaaattagtggttattgggcactagaggggaagggagaatgcaatctatctgcgtagtatgtatggggttttcttttagaatgatgaaaatgtttttgaactagatagagatggtggttgcataatattgtgaatgtgctaaacttcactgaattgtacactctaaaattgttaatatttgaatttttacatgaagaaaaatatatttaaaaagaaaaatattgcatgaac

SEQ ID NO: 212528 - DNA, 384 bp, Homo sapiens
ctcactacagcaaatatgagcttctctctataattactcttttacctgaattctgaaaagtgaacagtaattccacaagcattttgtttttaaggagctttgaaaaaatatagaaagaacacaaatactgacaatgatgttcttgagtccctaaggttatgaagtatcttcttaattgccaatgaaatattagttatgttctttaaagttgtattttttaatatcttaatttttgacacttgataattgttgatatacttggtaatgtttttaaccagaatcttttcccctattaaaaaaatgttatgcttatggcatttggatttacaaacttaaagtatatgttttgtttgaaaattagaaattaagagggaagtcaaaaca

SEQ ID NO: 212529 - DNA, 644 bp, Homo sapiens
gaaattggattcaggtctaaagaaacaattattttacaaacttacaataaaagaaacattcaattttaaaaatggccaataatccaaatagacacttcttcaaagaagacaaacaaatgtccggtaagcacatgaaagatgctcaacatcatgagtcactagagaaatgcatatcaaagacacaagatatcacttcccacccaccaggatagcaaggatgtagagaaatcaaagttcttcaaatgattaaatacagttatcatatgactcagcaacttctctcctagatatatatccacgaggaatgaaaacatatatctacattaaaatttgtacatgaatgttcatagcaatattacttataatagccaaaaggcagaaacaacccactgttaacaacagattttcactctatgtaatttttttttaagaagaagaagaactaatcttgaacaatattccacctaagttctcctccatccctaggcacatataatgatacgattgtatgatcctttttagaacatgccctggtaatcactaattaggatcatgatttctacatatatgggaaaaataagccctcagataaatcctctcaataaacattagaaaatgaaggtgaagaatgaaggaaatgaatc

SEQ ID NO: 212530 - DNA, 482 bp, Homo sapiens
aaatactcagattgttcatggtagtgaggactccagacactgaaattagagtgaaaaaggaaatctacaaacccttgagtcaaaatcacagttctctgaatttgtcacatctgcccaggtccaatgtcatgagaataggatcagggcgccacaggtatggcctgagactaggaagagagtcttgctcactgacccatttcatgtctaggcttccagctgagactacagtttcattacaacctatatgcgcccataggtcctgcctgcggcaatgacatctctcgggtcagtaagggccacttggaataggaatatcacccctatctggaagaccaggtggaggcttatcaccttcatagtaaggtactcactgtccacgtcaagagccaagccaaggtactgttcctccaatgagtaaacagcactgctgtagggctggcctaagtcaggcagttcaagataacctgaaggagtcgaataac

SEQ ID NO: 212531 - DNA, 341 bp, Homo sapiens
cagcctgggcaacatgatgaaacgctgtatctacaaaaaatacaaaaattatctgggcatggtgatgtgcacccatagtcccagctatgtggcagactgagatgggacgatcacctgagcctgggaggttgaggctgcagtgagctgtggtcacaccattgtactccagactgggtgatagagaccctgtctcagaaccaaccaaacaaacaaaatgcccaaacatatagttgggtcttatttctttatccattcagccactctgtgccttgtaactggagtattcagtccatttacattcagtgtcattgttgataagtaaggacttactactgccattt

SEQ ID NO: 212532 - DNA, 432 bp, Homo sapiens
ggaccgaaggccgacgccgggaggatctgcctccgggaggagccgcctccgggtctgaaccgccggggccccgtccgaaatgttcacctaagtgggggctcctgtggctgcgagggtcataagcaggagcgaggtcggagcctccggggaggcttcccccacgcgggtggagcgctccggaggcggggccctcaaggcccgggtgtcttaaccccgccgcgcccgggccgagttcgagagccgctggtgcttcccaggccgtcgcgctcctggccgcgcacccagccagggacccagaggccctcagccccgggctctgcgcgtacactgagggcgcggcgcagcaggacagcaagataaggaagcagagactgaagggaggaatccccgctttccggggatgatggcgttcgagttgggtctgtgagggat

SEQ ID NO: 212533 - DNA, 141 bp, Homo sapiens
atatcaggacagaatgcttagtcatgtttaataaagaatttaacgcaaactttttacattacagattatactactattacttgatttaagggtaatatatgactgtactctacatgggaaaagtggaaaacatagagtaaa

SEQ ID NO: 212534 - DNA, 127 bp, Homo sapiens
cttttgttccttcctcttgcccttttcctctctccctcaattaattaatgtttataacacatgtattgcatgaattcattctcttggagggaggaatccccaaaccctcttgagtggatagagtgca

SEQ ID NO: 212535 - DNA, 246 bp, Homo sapiens
tggggcttccccgggctggacccttggggcttaagtaattttattagattctctctctctctctctctctttctctctctctctctctctctgtctgtctccttgtctctgtcctcctctctctttactagattctttctctctttctctttttattagattccctctctctgtctctgtctctgcctctctttctttattagattctctctctccctctctttccccctttctcccccactccct

SEQ ID NO: 212536 - DNA, 849 bp, Homo sapiens
tgtagcctccaactcctcagctcaagcaatcttccctcatcagactcctaagtagctataggcatgcgccatcacacccagctaatctttaaatttttgtagagatgggggtcttggtatgttgcccaagcttgtctcaaattcctggcctcaagcaatcctcctgcctgggcttctcaaagtattgggattacaggtatgagccactgcacctggcctgacacttggttctcaaaaccccctttctggtttttgaggtcaggccaaggttcctcccaagcaacagtgccaaggagcatgcagtagaagaagcaagagctcccctccccctgcatacattcccccacctgtgggaacgcacacaccctatgagcagatgagcctgtacacttgggcacaaacaggttgagtgtggcctgactgaggcagaaggcagaaatgtctgctaggtatgtaggcgggctcacctggcatgcaaaggagtgaacagactgcttgtggatgtatgtaccagcttgggccactctggggccaggacctggctcctgtgttctgctcaagaagagcttgttgtgcgtatgtacaccctgcatgtgcagaatggcctgtgtgtttgtgcctcgtgggggctacttggaccctgtgggtatctcactcctaggagagcttatctgggtgttgcacaggtgcctgtgtcctgctcccagggagagcagcagcccctgtggctgcccattcaggccacagagacctggccagccattcctttccctctaggatttctttccagcatggagctatccttacacccataaacagggccagaactgccaagcacctgcaaatacc

SEQ ID NO: 212537 - DNA, 284 bp, Homo sapiens
ccttaaccaaagcaatggaataatatgttgatcttggattttacgtgtttaaacatctgtgataatccaacatttaaaataactggagcaaataccttagagcttagcactgtacctaataccacaatgcagttgctcagtacacatttgcttaattaaatgcctagaactatgttagatactttgggcggcacgctaatttcaattagggaaaaaaaatgctctaagggcttgcttttattttttaatttttaaaaaataatcttgtattgctataaagggct

SEQ ID NO: 212538 - DNA, 886 bp, Homo sapiens
atataaggtcagagttgtgtgcatgctcaggaaagacctgagaaggtcctaagctcacctctggctaaacttggggctctgcacaagcaaaaggcaaaggctaaggtagaattgtaaactgcctggctgagtaccacattatgcaggtagaggtccagtaaagaccaggagactttttagttcagtcatttaaggacatctctgtccagtcagtagctgagggaagagaaaattcagtggccatgtgggacaaagattacagactttatagaattagcttggaaaagtcactaaataaacaaccacaacaataaacagcaacaacaacaacaacaaactgggaaagaggaggatttgatttttagagaagctacattatttaaaatgtccagttttcaacaaaaaaaaagaaagacatgcagataaacaataaagggtgacctatgtacctaggaaaaaaagcagtcaatagagactatccctgaggaagccaaaacattggacttactagacaaagactttaactagctattttaaatatattaaaggaaaccatatataaagaactaaaggaaagtatgagaacaatgtttctccaggtagagaatattaataaatagaaattataaaaaagacaaccaggcacggtgggtcttgaactcctgaccttgtgatctgcctgcctcggcctcccaaagtgctgggattacaggcgtgagctgtcacacccggcctggtcacttgttttaaatgaataaatgttggacatggtggctcatgcccataatcccagcactttgtgaggccaaggcaggaggatagcttgaagccaggagtttgagaccagcctgggcaacaaagcgagaccctagtttctaccaaaaaa

SEQ ID NO: 212539 - DNA, 409 bp, Homo sapiens
tgagcattttctcatttacaactaagtgaataaccctgactgggaaatagaagtcggagcccagtgactctaagccaaggccaatcttgagcctgcaaaacaaggtcattgaagacccggttagttcttactggggagcctcccctgcaggtgtcccagcctgcacaccccaacatgaaaggagcactttatactgagaggagctatagagccctagagagctgggatccacaggcagatgctgttggggtcggagtctggaggctctttctgaggatggaattgttattgttctggggctgtttctagactttgtcaaataaaacaaattcacatttagataagaagttacttacttcaaaggagtattacaacagagggaaagcaccaactatatcttccaggatct

SEQ ID NO: 212540 - DNA, 564 bp, Homo sapiens
  misc_feature (543)..(545): n is a, c, g, or t
  misc_feature (559)..(559): n is a, c, g, or t
attttgaagatttatttttctgtaacaatcactatagataatatatcatcagtggaagataattgaagtattgtgtggctttttataatgcacatgtgtgtgtacatgtcatataaaaataaatactttttaaaataattttgataatacctattaaatagtccaaattataagagaagtaggaatacaaacatgaactgaataatgatttcaagcccagggccctttctgctataacatactgttcccatatcgtattactagttttgaaattactgagatgttttctattaacacatataagacaaataaggtatacaaaccatagaactgttttacagttgtattcttccaatcactattaattatgatcaccataattaaattaaacttggttaaaaatggcttatccaattaaataaatgaaatataacagaggagaaattttaacattctgtgttattttaatgatatagccaggtgtatatgtggctatttagctttttcactgatttgagagcaccaccaatacagggtccgagnnngaattcgtaacggnttcaa

SEQ ID NO: 212541 - DNA, 725 bp, Homo sapiens
attttgaagatttatttttctgtaacaatcactatagataatatatcatcagtggaagataattgaagtattgtgtggctttttataatgcacatgtgtgtgtacatgtcatataaaaataaatactttttaaaataattttgataatacctattaaatagtccaaattataagagaagtaggaatacaaacatgaactgaataatgatttcaagcccagggccctttctgctataacatactgttcccatatcgtattactagttttgaaattactgagatgttttctattaacacatataagacaaataaggtatacaaaccatagaactgttttacagttgtattcttccaatcactattaattatgatcaccataattaaattaaacttggttaaaaatggcttatccaattaaataaatgaaatataacagaggagaaattttaacattctgtgttattttaatgatatagccaggtgtatatgtggctatttagctttttcactgatttgaaatcactcacaagtaaataagagagtagaagtacaaggactttgcctacagtaaagcactgtaaaaatactctacataggctgggcggggtggctcgtgcctgtaatcccagcactttgggaggccgagtcgggcggatcacgaggtcaggagttcgagaccagtctggccaacatagtgaaaccccgtctctacgaaaaatacaaaa

SEQ ID NO: 212542 - DNA, 536 bp, Homo sapiens
agtctgtctgtgtcaattcttattttgtgtatatttcataaagtagaattacagcttaaagagctcgagggcatatcaaggtggttacattgttttcactttttaaaatgaaagcttactgttaacgctgtatctcttcattcgtggcttcaagatctaagttaagtagatgagtaaagtgttggaaacaggaggatttcaaggggtagggtacagtttactttattggcttagcactaatttgaatgcctgctatgtgtcactcaactcactgggatattcaagggtgtagaatggaattgttcgcagggatgaggacttgggtcatatgaaactaggaagtttgggaagtgggaaataaattggtaactgccctttggacagaagcaaagtttagaggaaaattctaggagcataactcctgggtcttagaagaaagaaggctagtaattttgaattgctacctatttggggttcagataatagtttacctctttgcaaataaacttcagcaagtcttaagggactactctgtg

SEQ ID NO: 212543 - DNA, 337 bp, Homo sapiens
tctctacttaaaataattaattaatttatttatttaattaaaataagaagtcccatctctctcagaaaaccacccaccagtaaatgataatacccatacaaggcagatgaacaggagctttcagctgttcagctgtgttattccacacaaatcctccttcattcagttcattcagtaggagacttttgcagttgcaaggataaggaaatggtcagcttgtgcaagaatcccctgtatgagaaagaaaagacacaatactagaatttgaattttccatctgagtcagatctctttcttacctctctgacacatttaactgagtaacggtcccgaagca

SEQ ID NO: 212544 - DNA, 399 bp, Homo sapiens
tgcatccactgtccgacaagccccagtgagatgaacccggtacctcagctggaaatgcagaagtcacccgtcttctgcttctctcatgctagtagctgtagactggagctgttcctattcggctatgttggaaccctcccagtcccagtaaaatttttcatttggaaaatagaagatgggaaaaaaacacagaagtcactgatccattgcaatagtggaattctgtaggtcagatattataaagattttgttgtgtccatgtacaaagttcttcgttctgaccctggttccactctctgaggaactgccttgttttttgttttgttttgttttttgagacggagtctcgctttgttgccaggctggagtgcagtggcacaatttcggctcactgcaacc

SEQ ID NO: 212545 - DNA, 182 bp, Homo sapiens
taatcaaaacagtgtggtaactggcataaagacacacatgtaggccaatggaatagaatagagaatccagaaataaaccctcccatatatggtcagatgtttttcaacagggtgccaatacctggggaaaagacagtctcttcaacaaatagtattggaagaattggatattgtcatgccaa

SEQ ID NO: 212546 - DNA, 398 bp, Homo sapiens
ccgcgcccggccgatccagaatgtttgacccatcacacagcatgggtgtgatgtctaagcttggtttgactgatgtaggcccctccctctctgctccacatgcagctttccttaagctgggcttttcatcagagaggaaagagtgccaaaggtgcattgttgcttgtgctttcttgccaaagctcccagataaactcacaaggttcagttgcctgaagagagtcaagctgcatctgttttgcccatcatcctcaaacaagtcttgcaagtacacacctctgggaaagaggcaaatggtgacaaaattgctactttctgggatagaaataatttctgataggcattggaataattttttaaattattattatctctcctccacccttcttcatagcccc

SEQ ID NO: 212547 - DNA, 300 bp, Homo sapiens
tgacattgcaccacgcactccagcctgggcagcagagtgagactccttctcaaaaaaaaaaaaaaaaaaaaaacagagatggggtctcccagcctgagaacatggtcaacctccatctctatgaaacaaacaaacaaaaaaacagaaattagctgagtgcagtggtgtgtgcctgtagtcccagctacttggaggctgaggtggaaggatcccttgtgctcaggaggcagagattgtggtgaacggggatcgtgccactgcactccatcctaggtgacagagtgagactcagtctaaagg

SEQ ID NO: 212548 - DNA, 630 bp, Homo sapiens
ctcagctgcttggatccttgccaacacttggtattgtcagttttatttcttcattaaagccatacctacaggggtgccatggtgtctcactgtggttttatcgtgcatttccctgtgactagtgatgctgagagtcttttcatgtgcttatttgtcatccctatgtcttatttggtgaaatatcttttcaaatccttcacctttttattgagttgttttctgattattcagttttaagagttctttatatattctgcttataatttctttgtcagatagttactttttctctcaacttctactactaattggccaaagtttaagacatatttaaaccgagacctggaaagtaactctgcacttcccattgttatttagattatactcaagtatttttcattttccaggtggtaaaatgtgtttatttttcacctactaatattcatgatttctggccggacgtgatggctcacgcctgtaatcccagcactttgggaggccgaggcgggcggatcatgaggtcaggagattgagaccatcctggctaacatggtgaaaccctgtctctactaaaaatacaaaaaattagccaggcgatgtggcgggcgcctgtagtcccagctactcagg

SEQ ID NO: 212549 - DNA, 525 bp, Homo sapiens
ttcccagagaaggggctcagctgtgaggggcagatcgagtggcctggatgtggctcggcctgtgggccagtgcccttcttgggctggcccagttccacctgcccccatccctgctgagacgcgccaccccccgccgcccctgcccccgccctgccgagctcctgctcccaggcctactcctggcggaacctgccctctccagctcacgctggacgtgctctactctctcgctgcccctgctgctgtccctcttacggcccaagtcatggcactactgtcttcccaatggctcaagttcaccctctcctttccctgcctgacacacgcacgccacatcaaggcttgctggcattgacgatcccctcaaggcccatgcgggcatggcgggcagaaggatggcagtgtccccatcatgggcgtcagcactgccacagtaacactgatgaggtacatgtgacctctccccactcgtttcctcccagacaccccccacctggtgggcctggagccccatttcccagatga

SEQ ID NO: 212550 - DNA, 768 bp, Homo sapiens
ttttattaagagggacagagatgagctggaagagttaagtcacttccccaaaatgagcatttcgttttcagaggttggattggtcttttgtgaatattacatgccgacttatgtgatgagatgaagagacttgacagatcattgctagaagtttaagtcagccatccccaaactttttggcaccaggggctggtttcatagaaggcgatttttccacaaactggggtagggggagtggttttgggatgaaacttcagatcatcaagtattagttagagtctcagatcatcaggtattagttagattctcataagaagcatgcaacctagatccttcatatgcgcagttcacaaaagggttcacgctcctatgaggatctaatgctgctgctgatctgacaggaggtggagctcaggcctgccccttacctcctgctgtgcagctgggttcctaacagggcacagaccagtatggggctggggacccctgatttaagtgactttatgtgttacaaatcaagtcaataggagagcgggcccattgtcaataaggcctctgaacacttgcccagtgctttcttcctgagttgtgtggtttctcgtgttctgtgtattcaggttcaaacccttgggaactgtagccaagttcttattttttgctgtctgttatgactttgcctaagcaaggggatgcagcacgatgctgctgcacagccagcatgctttcttccttcacctctctgctaaatgaatgtgatcaaaatgtgcc

SEQ ID NO: 212551 - DNA, 849 bp, Homo sapiens
aggtcctggcatctagtgagagccttcttgctccgtcctcacatggcagaaggcaaaaggggtaagaaagcaaaacagagcttcctttaacctcaactcattttctttttttttctttttttgagacagagtcttgctcttgttgcccaggttggagtgcaatggcacgatcttggctcactgcaacttccacttcctgggttcaagcaattctcctgcctcagcctcctgagtagctgggattacaggtgcccaccaccacgccaggctaatttttgtgttttcagtagagatggggttttgccatgttggccaggctggtcccgaactcctgacctcgtgatctgcctgcctcagcctcccaaagtgctgggattccaggcgtgagccaccgtgcccagccaacctcaagtacttttataagggtcctaatcccatacatggcctcacctcttaatattgtcacattagggattaggttttaacctaggaattttggagggaacacaaacattcaaaccatatccctgagataattttaaaattttcccatgatttcctcctgttatgtttttgctttcatttttttcctttaattttttttgtgtgtacaaatccaactttacccctctacagttacctagtttccaatgatcatttacaaataattcaacatttgccacatatttgaaatgtcacctttaacatatacctaattactacatgtatttgggtacattcatgtatttcctattctgttgcaataatttgttcaagtctactgtctgcttgtttcttgagagaagagttttgaaatctctgctataattatgaatttgtccatttctc

SEQ ID NO: 212552 - DNA, 1228 bp, Homo sapiens
tcatgaaattgacaacaatcttcttaactattcctccgtgttagttgacaaaggatcttcattatctgattttgggtagtagaatgactctgttcagggcacagagaatcagtgatccacggaaacagagtttgaagatccttattttaatctgcaaaagattgtcttaattttgaaagaaaatttatgcagaatagagtccagtttttctggctctatttcatcacccccaagctcctatcttgcaatgctcccatgtcttaagaaacttgttagtgatcttcaaagattgccaaaatttgtggaagttcttttagtttaggaaaataatctcactggtttcttaaccttatgtaggtacttataatgtatcatctgggctgggcatggtggctaatgcctgttatcccagcactttgggaggccagggtgggagggttgcttgagcacaggagtttgagaccagcctgggcaagatgacgaatcctgtctcttcaaaaaatgggaaaattagctggacgtggtggtgtgcacctgtagtcccaactacttgggaggctgaggtgggaggatcacctgagctccgaggtcgatgctgcagggatctgtgatcacgccattgcactccagcctgggtgacagagtgagaccctgtctcaaagaaaaaaaaaaaatctgattccttaagtcaattacataactaactgtaactttaaaattaacctatttccagttttctcttgaggcttggcagggaacccacttgtgtttgaattgagtgagtacagattttcatttggtggtactttgtttttatcagttcttcaatcttcctaacctctactcccagctccctgggctggtgttgattacatggggttacatgttgattacttgggctgctcttggtgccctgtggaagtggtatgacccagcttcataatccattatttgaagaacgtgagcccctttaaattttcaggcccaagagaggcattggaatgaaacaggagtcatatcactccccttgagctaaataattacctcttgaagccacttgctatttgagtgctatgctgactgctgccgagaagccataaaatgccgtatacctatagttcaacaatgtatagccaataatcaatgttatttttgtaagacaatgagaattcctggtgaacaatgattgtaattgtcccctctcctgattcttgcttttttaaaaaaa

SEQ ID NO: 212553 - DNA, 967 bp, Homo sapiens
tcatgaaattgacaacaatcttcttaactattcctccgtgttagttgacaaaggatcttcattatctgattttgggtagtagaatgactctgttcagggcacagagaatcagtgatccacggaaacagagtttgaagatccttattttaatctgcaaaagattgtcttaattttgaaagaaaatttatgcagaatagagtccagtttttctggctctatttcatcacccccaagctcctatcttgcaatgctcccatgtcttaagaaacttgttagtgatcttcaaagattgccaaaatttgtggaagttcttttagtttaggaaaataatctcactggtttcttaaccttatgtaggtacttataatgtatcatctgggctgggcatggtggctaatgcctgttatcccagcactttgggaggccagggtgggagggttgcttgagcacaggagtttgagaccagcctgggcaagatgacgaatcctgtctcttcaaaaaatgggaaaattagctggacgtggtggtgtgcacctgtagtcccaactacttgggaggctgaggtgggaggatcacctgagctccgaggtcgatgctgcagggatctgtgatcacgccattgcactccagcctgggtgacagagtgagaccctgtctcaaagaaaaaaaaaaaaaaaaacttcaggggggtgccggtaccccatttggcctattgtgaggcgattacaattcaattggccgcggtttacaccggtctgactgggaaaaccttgcgttcccaacttaatcgccttgcaagaccatccccttttcgcagttgccttaataccaaaaggccccgaccggtcgcccttccaaaaattgggcaaccttgatggcaaatggcaaaatgaagctttaaaatttgttaaaattccgttaaaattttgtaaaacaactaatttttaacccacttggcgcaaatggg

SEQ ID NO: 212554 - DNA, 412 bp, Homo sapiens
aatacgtctggaagcctgagagagcttatgttagagaaacatactaaggtacagctggggtaaggcatatacagggtagagaatgggcaggtgtaaagcctgagtcctgtccttgcagttgggatgtcaggtgaaagttaggactggttaaacaggtctcttcttgccacctgtgtataatgaaatattaaggctcagtggttaagggcccagattttgggttcacactgttgctcagtaactttgtgacaatgttaagaatcaggttttttttttttttttttccgtatggaaaaaatcttatgttataacagtatctattggtatgtggttgctttgcatatcaagtggaatttatttaaatactgcatagcacagtggctgcatgcagcaaacacccaaaaaatgataa

SEQ ID NO: 212555 - DNA, 198 bp, Homo sapiens
gaaaagccaccattccctgagcacttcttatacactaagcaccatgctattgttgctcgtgaatggatcccttattaatccttatgaatcctatgagataagtatccttatcctcattgtgtagctgaggaaatgggtttggagtggattgtgacttgtccctggttgccatgattataattcaagtcagctttacca

SEQ ID NO: 212556 - DNA, 622 bp, Homo sapiens
acatgggccttaggttagttctccttaaggacctaggatggctgccttctgtaaataatgcatccgtcatccttgtttgtatctatcaggaaaaaagagagaaggacgtctctttcccagaagccaaaaccaagcaagttaacttcttgtgtctcattgggccacattggcttggacctgccaatcctagggtatggagtcaccataaatgggctgggtgctgtggttcacttctgtaatcccagcacttcaggaggctgagatgggaggattgcttgagcccagaaattcaagaccagtcagggcaatacagcaagacaccatctctccaaaaaaaatttttttaattagctgggcatggtggtatgcacctgtgggctcagctacttgggaggctgaggtggaaggatcacttgagcccaggagatcgaggctgcagtgagccatgattgtgccactgcacttctgcctgagcaacagagcaagatcttgtctcatatctactccataggaagtgtggatgtatatgtttttacaagatacataagtgtacacagtgtacaactaagtttgaggacggctacacttcccagtttaagacttaaaaataggggaaggccag

SEQ ID NO: 212557 - DNA, 678 bp, Homo sapiens
cgcagtagctcatgcctgtaatcccagcgctttgggaggccaaggtgggcaaaccacctgaggtcaggagttcaagaccagtctggccaacatggtgaaaccccgtctctactaaaaatacaaaaattatccaggcatggtggtgggcacctataatcccagctactcaggtggctgaggcaggagattcgcttaaacctgggagacggaagctacagtgagcagcgatcgcaccactacactccagcctgggcaacagaatgagactctgtctcaaaaaataaaaataaaataaaaaataaaaaaactattggttatcaggctgagtggaaacataagctcaatgtgactatttagtaacttcccaacagttctaaactaccacccgtagctctaaatgaaaacttcattttttaaccactttgggcatggctgggatgtaggaatcaatgtgttgatgcaaaaatgctgcaaggcagttcttttctctgtctttcctgagcatcattagacctccagggagtgaggcactgtgtaactgaaggtccaaacaacatatccaaggcactaagaggatcacaatgcataaaacacgatgtgcataaatgctgatggataacggggaaaaagtaaaaaagaaaagaaaaaaaaggaaagaaaaccacagagtctcctaag

SEQ ID NO: 212558 - DNA, 320 bp, Homo sapiens
cttcataaaagttattctaataaattataatcatatgattttagaaaacttggttttttagatccaaaattttcaaatgttgacatcgtatttatgtttaataatgtagttgattaaccagtttcatcttactttctaaactgttaagttgagtttggactaatgataattccatttctggactgaaatttgccatcaccaaagtattgttttaagatgtattttcagacaatgtgggcagttcagcccaataatcgctacttctaaaaaattgttcaaggaacaagccgatggcctttcagcagtgagctaatgcatac

SEQ ID NO: 212559 - DNA, 225 bp, Homo sapiens
gcactgaggctgggacagtcccagacccactgggatggtgagtcccctccctgtacagaagcccatgtggtgtagacccctcaccaattctactcagctacataaaggctgtgccatgatgtcccaggccgggggaatcactcactgagtagatttggtgcacccataggagctgtttcttttttctttagcagaaaagcgcttttcagtttagtttctttggct

SEQ ID NO: 212560 - DNA, 412 bp, Homo sapiens
tctatatacaattagcataagctagtcaatacaacaaaaatatatacagcaaattagattgggtttgcatcattctatagattaggagaatattgaacattataaaaatagtgaatattccaattcatgaactcaatatatttattcatttactaagacattcttgatttcttattcagcattcgtaggtaacatgcaaatcctgtatctatttttgttaactttgtacctacatattttgtttttcctgatgctattgtaactattactttaaaatttaatttccatgtgcctatagtcccaacttcttgggagactgaggcaaaagactcagttgggcccaggagggagtttgagtctagtctgggcaacacagaaccccacctctaaaaattaaattaagttaaaatta

SEQ ID NO: 212561 - DNA, 298 bp, Homo sapiens
acaattcaatatgagatttggtggggagacagatctaaactgtattacagggtctcactttgtgcacaggctggtcttcaactcctgcctcagtgagccactgtgccccaccccaacatgttttgtgtgttttttgagactgtcttgctctgtcatccaggctggagtgcagtggtacactcttggcttactgcagcctctgcctcccaggttcaagcaattctgcctcagcctcccaagtagctgggattacaggcatgcgccaccagtcccggctaatttttgtatttttagtaga

SEQ ID NO: 212562 - DNA, 345 bp, Homo sapiens
ccatttaccctcttccttatcagcactgctcacctcttgctcctctttcctctgaatctcttgtccccttcttgaacctacatctctagtctccccccaggtacccttttccccagcttgagagccccccagtctatgtgtgagggtcctacacaacctcccagtgatgggcctctgttctgtatctctgggcctctcctgggactgctttctggtggggaggctattttagcagctcacctgctgctacctattcatgaccctgatgcagaaaatgcttgtgaggtgccactagccaagaagcagaccaaggctggaagtggagtcctcatttgttttgcagac

SEQ ID NO: 212563 - DNA, 459 bp, Homo sapiens
gtgcccaagtatttcatgttcattgtaaagaggaaaaatacagatttctctataatgtcaccacttatttctaatgccacttttcatcttgtggaaatgccatgttttgattcagtcttctgaatttgaacattattcaggttatttccaattgctgggaatatccttactgctaaaataaattcttagcattggaattgctaggtcaaagattatgcatgctttttaagggcttttgaaatgtattgccagtctgtggcctgccaccctccctgaacatgcctggtcttgcttaaaatgtattgccaaatagtccttgggaagtttatgttgtctttaacaatgtgaaatagtactactattcacgttccttttgtctgacaatttgataagtgaataattgtatcccaccattttgtagtattggtttttaacatggaaattttagtcaatacctgg

SEQ ID NO: 212564 - DNA, 1797 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212565 - DNA, 902 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataag

SEQ ID NO: 212566 - DNA, 564 bp, Homo sapiens
  misc_feature (11)..(11): n is a, c, g, or t
  misc_feature (15)..(15): n is a, c, g, or t
gcctcggcggngaancggaaacgccgaggaacccggctgaggcggcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggggacatcagcagccaccagcatggtggggtctttgttggggagtgggggagtcttttgtaaatcaaacaaagccaaaggccaactgtccggtggccatccctgccctatttagtacattagtaacatcccgcgtggcatcagggtagtgtcggctgtattttgacccactggggactcaggaagga

SEQ ID NO: 212567 - DNA, 430 bp, Homo sapiens
gcggcgcctactactactactactgctcgaattcaagcttctaacgatgtacggggacatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212568 - DNA, 982 bp, Homo sapiens
agcggggggtgcagggggcggggctcggcctggccgcagccattttggtgcgagagaaacaataggacggaaacgccgaggaacccggctgaggcggcaggtaaagctcgcgtcctatggccctagtgcccgaggagctttgagggagattttttcaggctactgggaaacgggatctctgatcattggagtctcccaggttatttgggaaagacttcttccgtggtcattgtgggggaaatctcccggggtccctgtggattcgatttccctgggtcatttgggaggagggtttttcttctgatcattgggggagggatttccgtggttttgggggtccagcatcctccccggtcattggagggggtctcccgggtttgggggagggcaggatctttcctggtcattgagatctccccgggtcttgggaagcgcaagatctacggtgtcattgaggggtctccccaggtcattggcggccacgatctccccagatatttggcgggtggaggggtcttcccggatctttggatagggagtcagctcagcgcctcaggtactgttacctggggtcggcagatgtgcagccattttgagtgttgaatgccatttgggcccgtcagatggtgttcgatgagggaatctacacacttaaccttattatagaaaaaatgcctttaaatggataagaggacacctttatagtgatatttccactctttacgtttgattacagaccgcttttgtcttttgcatcctaatggcttatttcattttaggattgtattcgttctcatatatcaactaagctacactagcagaaaagtgagtgaaaataaaatgtagaaaccagtaaaatccagtgctcttaaataccagggaaaacagaactagtcactgcttggaattaaacatttccgtagcagaatgtacacagaacaaaaaatcatcttgaatagttttaagaaaaagtactggcact

SEQ ID NO: 212569 - DNA, 477 bp, Homo sapiens
acatcagctcggtaccgatttcgcttcctaggtgacagacaggtacactgtatgctagccctgtatctgtctgagcagtggaatgtgccaggaaagaaggagcaaccactgactgatgaacctttgccagtctcccttccaagagggatgccagagccttctgtaagctcctgagatgtcactggtatctaggcaacagggatgagcctgaacctccctgaggccagcttactgaggtgaaaattttccattgtttggctcataaagaggatgcactggggaagaattttccctttaagtgaagttatttcacctagtgggataatcttgggtaacaaattgaacacactcttatacattagaaagtaagcagatgattattctcatgttattacattttaaagcatgtttttgtttttttaaattatgtttttgcctatttgtgtaccatataataaaagtaataagaagtagttg

SEQ ID NO: 212570 - DNA, 3491 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212571 - DNA, 3654 bp, Homo sapiens
  misc_feature (11)..(11): n is a, c, g, or t
  misc_feature (15)..(15): n is a, c, g, or t
gcctcggcggngaancggaaacgccgaggaacccggctgaggcggcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212572 - DNA, 2858 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212573 - DNA, 3654 bp, Homo sapiens
agcggggggtgcagggggcggggctcggcctggccgcagccattttggtgcgagagaaacaataggacggaaacgccgaggaacccggctgaggcggcagcttcctaggtgacagacaggtacactgtatgctagccctgtatctgtctgagcagtggaatgtgccaggaaagaaggagcaaccactgactgatgaacctttgccagtctcccttccaagagggatgccagagccttctgtaagctcctgagatgtcactggtatctaggcaacagggatgagcctgaacctccctgaggccagcttactgagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaagtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212574 - DNA, 3709 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaatctgtgtggtgtgtgtgtgcggggtgtgggtggg

SEQ ID NO: 212575 - DNA, 3143 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212576 - DNA, 3271 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaagtctcttgatcacagtaacccatagtcccccactggggggacggtgggggaagactttgggaggattttacccagaatacttgccgcctgctttttgtcctccaggaaaccagaagcccgggtaattaggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212577 - DNA, 3125 bp, Homo sapiens
agcggggggtgcagggggcggggctcggcctggccgcagccattttggtgcgagagaaacaataggacggaaacgccgaggaacccggctgaggcggcagcttcctaggtgacagacaggtacactgtatgctagccctgtatctgtctgagcagtggaatgtgccaggaaagaaggagcaaccactgactgatgaacctttgccagtctcccttccaagagggatgccagagccttctcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaagtctcttgatcacagtaacccatagtcccccactggggggacggtgggggaagactttgggaggattttacccagaatacttgccgcctgctttttgtcctccaggaaaccagaagcccgggtaattaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212578 - DNA, 2997 bp, Homo sapiens
agcggggggtgcagggggcggggctcggcctggccgcagccattttggtgcgagagaaacaataggacggaaacgccgaggaacccggctgaggcggcagcttcctaggtgacagacaggtacactgtatgctagccctgtatctgtctgagcagtggaatgtgccaggaaagaaggagcaaccactgactgatgaacctttgccagtctcccttccaagagggatgccagagccttctcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212579 - DNA, 3088 bp, Homo sapiens
  misc_feature (11)..(11): n is a, c, g, or t
  misc_feature (15)..(15): n is a, c, g, or t
gcctcggcggngaancggaaacgccgaggaacccggctgaggcggcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212580 - DNA, 3053 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaagtctcttgatcacagtaacccatagtcccccactggggggacggtgggggaagactttgggaggattttacccagaatacttgccgcctgctttttgtcctccaggaaaccagaagcccgggtaattaggggacatcagcagccaccagcatggtggggtctttgttggggagtgggggagtcttttgtaaatcaagacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212581 - DNA, 2824 bp, Homo sapiens
atccttaattaaattaattttccccccccccccgggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212582 - DNA, 3073 bp, Homo sapiens
atggacgtgaaacgccgagtgaacctcggcttgatggcggcagcagacggcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaatggggaaacatttcaggttctaactgatgaaccacttacccattgccttgaggaattgccgcaagatttcagcttccccccaagataacaaaggggtgttctccttagattccacaaggtaagccacaagtaagttcccccccacgtgtggcgtgtgcacgtgtgtgtgtggcacacgaaccttttgggcgaagggattttacccagaatacttgccgcctgctttttgtcctccaggaaaccagaagcccgggtaattaggggacatcagcagccaccagcatggtggggtctttgttggggagtgggggagtcttttgtaaatcaagacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212583 - DNA, 3583 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgggactggctcaggctggggctcacagaggccactgcacatcagctccaggctgcaggagccaccacctggccatactggcttcctccctgacgcagcacaggtcgac

SEQ ID NO: 212584 - DNA, 3086 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgggaccctaccccttcccaacaccac

SEQ ID NO: 212585 - DNA, 3125 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttaacgtgtgcgctcttgaggaagagacacta

SEQ ID NO: 212586 - DNA, 1325 bp, Homo sapiens
ggtacccgcccaaaccagcttctccacttcttcgcatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212587 - DNA, 1227 bp, Homo sapiens
tactttctgtttctaagacatgatgtttttgtttgttgtcccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212588 - DNA, 1141 bp, Homo sapiens
gcccccttcaggcttggagcaggatacggactgtcgtgagtgtgagagcggctccttcaccgcttcacaaaaccacctcagacactgcctcagctgcctaacaggccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212589 - DNA, 756 bp, Homo sapiens
  misc_feature (402)..(402): n is a, c, g, or t
  misc_feature (407)..(407): n is a, c, g, or t
  misc_feature (409)..(410): n is a, c, g, or t
  misc_feature (416)..(416): n is a, c, g, or t
  misc_feature (418)..(418): n is a, c, g, or t
  misc_feature (420)..(424): n is a, c, g, or t
  misc_feature (428)..(431): n is a, c, g, or t
  misc_feature (443)..(443): n is a, c, g, or t
  misc_feature (445)..(449): n is a, c, g, or t
  misc_feature (454)..(454): n is a, c, g, or t
  misc_feature (462)..(468): n is a, c, g, or t
  misc_feature (477)..(477): n is a, c, g, or t
  misc_feature (489)..(490): n is a, c, g, or t
  misc_feature (497)..(497): n is a, c, g, or t
  misc_feature (500)..(500): n is a, c, g, or t
  misc_feature (505)..(505): n is a, c, g, or t
  misc_feature (507)..(507): n is a, c, g, or t
  misc_feature (509)..(509): n is a, c, g, or t
  misc_feature (512)..(512): n is a, c, g, or t
  misc_feature (515)..(515): n is a, c, g, or t
  misc_feature (518)..(518): n is a, c, g, or t
  misc_feature (520)..(523): n is a, c, g, or t
  misc_feature (525)..(525): n is a, c, g, or t
  misc_feature (530)..(530): n is a, c, g, or t
  misc_feature (535)..(535): n is a, c, g, or t
  misc_feature (538)..(539): n is a, c, g, or t
  misc_feature (545)..(545): n is a, c, g, or t
  misc_feature (547)..(547): n is a, c, g, or t
  misc_feature (553)..(553): n is a, c, g, or t
  misc_feature (556)..(556): n is a, c, g, or t
  misc_feature (560)..(560): n is a, c, g, or t
  misc_feature (566)..(566): n is a, c, g, or t
  misc_feature (580)..(580): n is a, c, g, or t
  misc_feature (584)..(584): n is a, c, g, or t
  misc_feature (590)..(590): n is a, c, g, or t
  misc_feature (594)..(594): n is a, c, g, or t
  misc_feature (598)..(601): n is a, c, g, or t
  misc_feature (603)..(604): n is a, c, g, or t
  misc_feature (606)..(606): n is a, c, g, or t
  misc_feature (613)..(617): n is a, c, g, or t
  misc_feature (619)..(619): n is a, c, g, or t
  misc_feature (623)..(623): n is a, c, g, or t
  misc_feature (627)..(630): n is a, c, g, or t
  misc_feature (632)..(632): n is a, c, g, or t
  misc_feature (635)..(635): n is a, c, g, or t
  misc_feature (638)..(638): n is a, c, g, or t
  misc_feature (640)..(640): n is a, c, g, or t
  misc_feature (644)..(644): n is a, c, g, or t
  misc_feature (662)..(664): n is a, c, g, or t
  misc_feature (667)..(667): n is a, c, g, or t
  misc_feature (669)..(669): n is a, c, g, or t
  misc_feature (671)..(672): n is a, c, g, or t
  misc_feature (675)..(676): n is a, c, g, or t
  misc_feature (678)..(678): n is a, c, g, or t
  misc_feature (693)..(693): n is a, c, g, or t
  misc_feature (733)..(733): n is a, c, g, or t
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctnctatngnncccttncnannnnnttcnnnntttttatgtttntnnnnntccanggatcttnnnnnnntttttttanttttttttaatnntattttnttntttanangntantcnttngnnnnanagaanttttnatnnctcccnanacctgngtnttcnttcttngcccaagcccatgnggtntttctntatnactnnnntnnancattttnnnnntngaantttnnnntnatntgnancttnccttttattggtacctcnnnaananannatnntnttgcgggctctgttntttggcggtgcaccttttgcagtgtgtgttctgcgtacanagggatgctgctaatcttcgctc

SEQ ID NO: 212590 - DNA, 493 bp, Homo sapiens
tacaggcatgagccaccatgcccggccttctgaattctgataagacatactgatttattggtccttatctctttatagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacagtatcctttgttcacgggcatctctgcatttgagggtaagaggagaggaaatgaggaagtcccttggagcttggagagagaagttaggtttttatagtcatggttgagttctcctacctgggttattccaggacctgtatgataattatgggcaaataatcacttccctcagggcagctactggcctaggagtgcagatgatgaggagtggggtataatgggtttctgggaggtgaggg

SEQ ID NO: 212591 - DNA, 1187 bp, Homo sapiens
atccttaattaaattaattttccccccccccccgggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatgga

SEQ ID NO: 212592 - DNA, 1221 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatgga

SEQ ID NO: 212593 - DNA, 1030 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaagtctcttgatcacagtaacccatagtcccccactggggggacggtgggggaagactttgggaggattttacccagaatacttgccgcctgctttttgtcctccaggaaaccagaagcccgggtaattaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataag

SEQ ID NO: 212594 - DNA, 3709 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212595 - DNA, 3848 bp, Homo sapiens
agcggggggtgcagggggcggggctcggcctggccgcagccattttggtgcgagagaaacaataggacggaaacgccgaggaacccggctgaggcggcagcttcctaggtgacagacaggtacactgtatgctagccctgtatctgtctgagcagtggaatgtgccaggaaagaaggagcaaccactgactgatgaacctttgccagtctcccttccaagagggatgccagagccttctcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212596 - DNA, 2986 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaagtctcttgatcacagtaacccatagtcccccactggggggacggtgggggaagactttgggaggattttacccagaatacttgccgcctgctttttgtcctccaggaaaccagaagcccgggtaattaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212597 - DNA, 2925 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggggacatcagcagccaccagcatggtggggtctttgttggggagtgggggagtcttttgtaaatcaagacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212598 - DNA, 3655 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgagtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212599 - DNA, 2072 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatgga

SEQ ID NO: 212600 - DNA, 1753 bp, Homo sapiens
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataag

SEQ ID NO: 212601 - DNA, 1743 bp, Homo sapiens
  misc_feature (1721)..(1721): n is a, c, g, or t
agcggggggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattagaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgganccgggggatactctagagcgag

SEQ ID NO: 212602 - DNA, 1037 bp, Homo sapiens
gatcgagtcggtacccggtcccatgcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaagctcct

SEQ ID NO: 212603 - DNA, 282 bp, Homo sapiens
ttagtgaggaagcaaatcaatagaaacgcatctaggccaatgggaatgtaaatcagtgcaaccacttgggaaaaagctttgcattatctagtggagttgaacacccgcaaagttctatgatcacaggcgtgagtcaccacgcactggccaggtctagctttttaagagtctgaccaataactgctttctaattggaatgtttagcacgtttaaatgtaatgcaataaatgaatatggtgggattataaacctattatacgaattggcctaaatagaggggat

SEQ ID NO: 212604 - DNA, 352 bp, Homo sapiens
ttagtgaggaagcaaatcaatagaaacgcatctaggccaatgggaatgtaaatcagtgcaaccacttgggaaaaagctttgcattatctagtggagttgaacacccgcaaagttctatgactctgcaattctttactttgttatgtatcctagagaaacacacatgagcactggaaaatatgtacaagaatgttcatagggcattatttgaatttgcaacactctgaaaacgacccacgaggttaatcaacagtaaaataagttattatatattcataaaataatacactatttaccaatgaaaacaagtgaactacaactgtgtagtacatataaatatggatgaatctca

SEQ ID NO: 212605 - DNA, 851 bp, Homo sapiens
gcagtggatttaattggacaattcaagacatccattttattgtcccaaaatattacataaaagtgtacagtttttagcctaaatgcaaacaaagttgcttgaaaatggcatgggtaaaattcttacggaaacctggtggcaatcttggaaaagtttatcagcctggaagtatgctatcactagcccctaccaaaggcttgttaaatgaaccaggacaaaacagctgctttcttaatagcgctgtacaggtgagaccataattacttattacattaaaaaaaatacttttcagaaaatcctttgtttaatgcttctttagctcataaattaaaaataaagttactatagactagaatgactttttaatataactttaaatgggagcaaaagtgttttggctggtcattttggtttttataataaatgaaaatggtttttttcaacagactgatgtatcactatgatataaataatcttatttaaaaggtttatttagtaaattaaggacatttttctaacatacacaaatgttttggttttaatcagctaacacccctccctttgaaaaaacatccagtatatggatccctgtagatagaataaaaagacataagctgcttgtattgagataagaatgcagagtttttgatttcagtactcaaactcccttcacctcccactgtggtgtttaaattacctctgcggaatcatcatttgggctccactgttttggttaaattgaaggataatccattttgcctcaatccttgttgaaaatcttaattaacctgcttttctgccttagataactatactttcttatgcttaataaagtttttattcagcagtta

SEQ ID NO: 212606 - DNA, 492 bp, Homo sapiens
gcagtggatttaattggacaattcaagacatccattttattgtcccaaaatattacataaaagtgtacagtttttagcctaaatgcaaacaaagttgcttgaaaatggcatgggtaaaattcttacggaaacctggtggcaatcttggaaaagtttatcagcctggaagtatgctatcactagcccctaccaaaggcttgttaaatgaaccaggacaaaacagctgctttcttaatagcgctgtacaggttttatggcaattggatatattccgacgaagcttgcgggttttgactggacatgtttgtcagggagatgcctgtatattttgtgcattgaagacgatatttgcacagttccaacacagtcgagaaaaagcacttccctcagataacataaggcatgctcttgcagaaagtttcaaagatgagcagcgatttcaacttggccttatggatgatgctgcggagtgctttgtaagtgtttctgata

SEQ ID NO: 212607 - DNA, 1116 bp, Homo sapiens
atatctctgccaaggatagactgaagtgttgaaggtgtttatgtgccatacgtggcagttaggaactggtatcagggactcatatctctgaagcaagcactttagctacctgttcataggtaacagctcattgatagggaaagaaggtagaattaagcttatcaaaggctagaactgtgtctgattcatcttggggtcctccctacctagcttaggatgctacattgtttaggttttagtgaatgtttgttgagtgaagagatgagttggtgttctctatcagcaaggtctagcggggccaagtggcccaggacagatgggtctgctgctaaagtggtttttatttgaagtgtgtgttgatcgtgggttatcttacaggattttttaatattccatatggctctaaccaggacctgccttagtacctctgaaagaagtcactattcttattttggtccagacagtaccattttctctcccagttacccaggcaggacatttcaacatcatcttgacttctctgtctccttggcgctgatctctaattggtcatcatcctctctgctcacatccagcgtccctcccctctgcctcattctggatactaggccctcatggcctagttcttctctaatctgcccttattgcagttcattcctatgcacgagttctcaagaatctttctcaaatcttgttttctttgtgacacttcagtgactcttcatcaaacctcagtgaatattcatttctaataggtagaaatctaaaatcttcagcctggtgtttaagatctttcatcagggggtcatttcctctcaccagttttgtttcctgcttttttctctccccactcgacaccacctcatttttttttaatcttatagaaatccttaaatcctggattttgttaattgcattattatggtacggcttaacttgttccactattccccttgttgcctatatactgataattagatctaagcttgattcactttttttttttgtcaaggatacttcatagttggggttgtgtaccacctgtaagtcagcattttgcaacttctgttgaaaatcattattttgcaaaccctaaggaagtgatagatccaggca

SEQ ID NO: 212608 - DNA, 217 bp, Homo sapiens
atatctctgccaaggatagactgaagtgttgaaggtgtttatgtgccatacgtggcagttaggaactggtatcagggactcatatctctgaagcaagcactttagctacctgttcataggtaacagctcattgatagggaaagaaggtagaattaagcttatcaaaggctagaactgtgtctgattcatcttggagagcataatcttggcagcagat

SEQ ID NO: 212609 - DNA, 386 bp, Homo sapiens
caagaacaaacaaaacatccatctatcagagagaattttaaattagattacaatggagtaccttttcccttaacgattatgagggggacaccttctgacatcgtaagacactaagaacgtgttgctgagggtaaaaaggactcagaacagcaggtcatggggcaatgctgagccctgatgaagagcacagactccagataaaccgcctggattcaaacatggatccaccatttatgagcaaagtaaactaagttattaatttttatgcctgttgccttctcggttaaacgagggtaagaattgtcaacagcctcatgaaggagaattcaatgattattaatcacagttaattaatcactgatgatctatcaatcatcaacgtatag

SEQ ID NO: 212610 - DNA, 478 bp, Homo sapiens
acatggtctgtaatgttgaaggaataccaataactaatacggggcctggggtggaaccacaggtttacaactaaataccgggcccttgcctaaagcaggtgaagcctggtttgtcttagctataaagctgtctgtacacagtattttgcatttagatgctaatggtatgtttgaaatgatagcgtatgactgactttgttttttagtttttatttgagataattatagagtcacgagttgtaagaaacaatacagagagagtctctatgcctttcatccagttcccccgacaatagcacaatagctaacctaactatagtacaatatcttaaacaaatgacattgataaactcatcagccatattcatattttgccagttttacatgcacacctatttgtgagtggttttatgttttcaaactaatttgtggacctaaagcagtctatggattcaatacaacctctttcaaaatccca

SEQ ID NO: 212611 - DNA, 189 bp, Homo sapiens
aacttacgggatgcattagaagaagtgctcacagggaaattgatcgctgtgcatgcatacattaaagaaaaatgaaaacctcaatgtaataacctagtcatacaccttaaggaactaggaaaagaggagcaaattaaacctcaaaccagcacagggaagaaaataaagattagagtgtagagaagtaaa

SEQ ID NO: 212612 - DNA, 1160 bp, Homo sapiens
agagctctacagcaggtaaagcctgcgatgcaatctccctgtccctgagccacatgaatcagcaactttgatggtgtcacctctatccataatggttgaagctgttatgtggagtctctggcaagatacaaaagcaaaattacagcccgtaaggttctgaaatgccatgattctactgtcaccatgtgcagttgttcatgttgggcactgcacaagaacactacacctaaggaggtgctattcatatcacagacatctttactattttgaaaacaactttttgaaaattattatgtattgtgcatgctattgacggttgcaaaagtgatttacaatttattgcaactatgttccagcagatggcagtaaagtgtcttgttccaagagggttggtagctaccattctacttccatatactaaggagacattggttttgaaatggaaagacgtgttgattttatgtcatttaaaatagtctgtgcttctaaacaatgagctgctcttccacctgatatgcagaacattttgttaaagtccctaatggtgccagcacattgtctgtattcagtatttcatattgcagttcatattttcatctaattatttactctaccagactggaattgttgaattctatgtttaaatctacaagtcctggccaggcacagtggctcacgcctgtaatcccagcactttgggaggccaaggcgggtggatcacctgaggtcaggagttgaaaaccagagtgaccaacatggtgaaaccctgtctctactaaaaataccaaaaattagcccagtgaatgagccgggcgtggtggcagtcgcctgtaatcccagttacagaggctgaggcaggagaatcgcttgaacccgggaggcgaaggttgcagtgagccaagatttcgccattgcactccagcctgggtgacaagaacgaagctctgtcttaaataaataaataaatctacaagtcctttcacttggcacaaatcactgtataataatatccggtcaggtgcagtggctcacacatgtaatcccagcactttgggaggctgaggtgggcagatcacgaggtcaggagttcgagaccagcctgccaacgtggtgaaaccaagtctctactaaaaatgcaaaaattagccgggtgtagtggc

SEQ ID NO: 212613 - DNA, 469 bp, Homo sapiens
tttccagtgtacctaatattaggtaaagaaaatagttgatatatgactggatgtgaggtggccattttaacttgtaggtgacaggatttatctcttgatttcttcgttaattttaaaataaataaacaaaaaacaacataaggaagtttagatccttctttttaatttgtaacacttcaacttctagtattgctttctgtaggggagaatttttcagttgataacatgagttgatttcataagttatagtatttaaaactagagatgttttgtcacaaaaaagttgtccctttaatatatgatttagcacggcaactctttttaaagtaatatgtttaagagaaaaccatgaccttatgataaaaataatactaaaccaattattaataactacagtttgccgtcaaacgtcttagctaaataattaccttattagaacaaaggtattgaaagcacagcaccagaaaca

SEQ ID NO: 212614 - DNA, 570 bp, Homo sapiens
gaaaacattctggtaactgttagatcccttgttgtagctattcatatgttctgtgtggttaaacaaggttcacagtgggccacctggcctttggaacttggctgaagaggctgccttcagttcatcctccccacccccgttttcaaaacatgggtttccatgtgttcgttgtaaattaggaaacataaccatgttttgaggcttcatagaaaacaaacgtctggggtcacacaggttaaaggaggaaccaaattcagcactatcactgttctattcggcaggcaattctggggccttcctgtgtctcaggttctgtactagttgtttcaggactttgggataaacacaaactatccctgccctcagggggattaaggtcaggtgtacaaatgactctaatgcgaggcaaggctggattcagtgctggaagaggagggcatacctaacactacgggaattcaaagaggaaatgatcagaatgaggagggagagatgggtcattccgggagaagcttcagggaaaggcaacatttgaaatgagactttggagagtgagggaggtttgggcag

SEQ ID NO: 212615 - DNA, 398 bp, Homo sapiens
gcgtgattgatgacgcagaagtggccatctgtgcgtgagtagggatgataactgtgtgagtacttggagtcaccaaggaggtggagaaagatgtaacgtgagtgggatgtgtggtctggggccttcctgtgtctcaggttctgtactagttgtttcaggactttgggataaacacaaactatccctgccctcagggggattaaggtcaggtgtacaaatgactctaatgcgaggcaaggctggattcagtgctggaagaggagggcatacctaacactacgggaattcaaagaggaaatgatcagaatgaggagggagagatgggtcattccgggagaagcttcagggaaaggcaacatttgaaatgagactttggagagtgagggaggtttgggcag

SEQ ID NO: 212616 - DNA, 439 bp, Homo sapiens
tagattatccctgacggcttgaatgtttgcaagctaactgcagaattctctctcctgggcctgacagtttcagaatgctaaggcaagcaggggttgaatccagtgtcaagaggattacagagttctcatacattgctggtgggaatgtaaaatggtgccgctgttttggaaagcagtccagcagtttctcaaaatgctaaacatagaattacacagtaactctgagtaacatcccacttcaaggattgaaagagaattgaaagcatatgtctacacaaaaacgtgtacataaatgcccataggagcattattcataatagccaaaaagtggaaacaacctaaatgcccatcgatggacaaatggataaacaaaatgtggtatatgcatatgatggaatattattcagccaaacattcaagccgtcagggtaccgagctc

SEQ ID NO: 212617 - DNA, 443 bp, Homo sapiens
tagctgggcgtgatggtgggcgcctgtaatcccagctactagggaggctgaggcaggagaatcgtttaaactcaggaggcggaggggcggaggttgcagtgagctgagaccgcccccattgcactccagcctgggcaacaagagcaaaactccgtctcaaaaaaggaaaaaaggataacatggctgagtgcagtggctcacgccgaggcgtgaagagtgcttgagttcaggagtttgagaccaggctgagcaacatagcaagacctcgtctctactaaaaatcaaataaatgagctgggcgtggtggcgcgtgcctgtggtcacagctattccggaggctgaggtgggaagatcgcttgagcctgagaggtccaggctgcagtgggctgtggtcttgctactgcaatcctgcctgggcaacagggagacacccagtttccaca

SEQ ID NO: 212618 - DNA, 373 bp, Homo sapiens
attggttggacgaggaatccttggtagctgtcatgaggtgaatggtgacagcggtgcacgggaggcacaagaagggcagccaaagctatacttggggagggtgtgggaagcaagagaagaacattctgttaggggcagagaagaatcccacactcacaagagatgaccaggagtaaacctgcctgcctgccaaaagtaggcaagatttcatgagtcaaagcacaagaccatttctgctcaaagcacagcaaacaatattagcatcagcataatagtgctggttccccagcccatgcccatgggagatgtgctgtgatgggtctagatggtgcctgtgtgcacagccttgtagccgacgatcacagggcccagg

SEQ ID NO: 212619 - DNA, 799 bp, Homo sapiens
cacaccaagaactaaaacaggatcagccaaagataaaaccgaatcagtttgaaccctacagaggagcccagaatgatttctctttgtctcagaggcctgcctttctctctctgtctcagaggtttgcctccacctcccctgaaccttggcccagaagtttgccttctctctcttccttcccccttcttagtggcctctgaacccaagaatctgtcctggaagccaaatggaaattctacacagaagcccgtctaagtcttagcagcaatgttgtactcgttttcttctttaaaattaatgaatacacagccagaggtttattatgccacacacattgtgttcaccactcttcatgattaaaagtctcacttctggggtccaggacaacttcctaaattcatcaccgggaactgcattgcaacattgctgattctggccctatgattaattctacagcttttgaagaaacccaaactggacagacagttactgaatttttgtaatgtccgaggcttccaggaggagtgacacatatctctgctggatgagctcacagttccaatgagaagatacaagctgaaagattgcagcagaactgggaagtgaaagcacggagaggctgtgggacatggaggaggggcggtaagattgagaaagaggtaacagttggggtgactttggacctgagacctgggcaggcataagaagtctcactctctattccattcttggcaggggatgtttctttgtaccaggtagctttgcgcttgttttgttccataaaagtaaatctctgttc

SEQ ID NO: 212620 - DNA, 394 bp, Homo sapiens
acatgtgcaggatgtacaggttacataggtaaatggttgctgtggtggtttgctgcacctatcaactcatcaactaggtatgaagcccagcatgcattagctattttttctgatgctctccctctccctgcccccgacccaacaggcccctgtgtgtgttgttcccttcgtggtgtccatgtgttctcattaacaccaagtttcaataagcagaaaaacaagacctcaaattcctggtggggccaggcgtggtagcccatgcctgtaattccagcactctgggaggctgaggcgggaagatcaccggaggtcaggagttcgagaccagcctggccaatatggtgaaacccccatctctactaaaaatatgaaaattagctaggcatggtggcgg

SEQ ID NO: 212621 - DNA, 663 bp, Homo sapiens
gtcggtcccggcgcgtctccctctccactccctctctgccggagcccctcggcccttcgaagccccccgcggaggctgcagcgcccggagaagccactgagtcaatggggcgagggactggggcgggcgcgcagagcccccaggattgagacgcgcgcaagtgcggccactgcagcgccgcttggctgtttgttctcccgactgttcgcgaattacttacaaggcgcctaggcttctccgaagggtggacggctcgttccctctcgccttgtccgccctcagtctctccaccaccgcccggcacgctttgctgatctaaaatcagaacaattagagagtaatgattttttttggaatagcaactcctacagacactcagatctgccctcgcttcagcgcctcccagccctccttcccagcagccaggcgagagcgcgcagacccctaaaaagcaacttcagtgttaaccgggtctggatcctggaactttataaactaatccgtgtgtgtgtgtgtgtgtgtgtgtgtaaaccgaagagtaagtgcctattatttctgagtacttcggtgtcctaacgaagctttgctcctaaaggacaggatatattttaggagtctttctttccactgagttttttaaatgtttattttctcgagcgatca

SEQ ID NO: 212622 - DNA, 438 bp, Homo sapiens
ttttaaagaaaaaaatttgcaatcttgcagtttaatgcaaccatagtcttagcatttttgtctgtgttctcttttcaatctttgtttataaacatatatgtttctacatagagctgattgtaagaggtatagaattccacactttataaatgccttgttaatttattgttttccatgttgtcacatagacttcaggggtctcctctcaactgactgcaaattactcactgagttggtgccccattatgtcctcggtcatttcccctatcgttgagcatttacaacttttctaatgattgacttttaaatttcttgaaattattgagttaaagggagcagaattttaacaacttttgttatgtgtcactaaatcccttttcaaaagattgtactgatttacaatgccaattaaatgttttacaagtattattttccaaa

SEQ ID NO: 212623 - DNA, 583 bp, Homo sapiens
  misc_feature (535)..(535): n is a, c, g, or t
tcagtcccttgagagatgggagctgatgggaaggaggtagaaacttggtcctttagccaggaggctctgcaggcattcaggcctgatctaccatgtaaggtgatttctttctttttggaaagctcccatttcatggggtggacaggtccaaggactgctctggaccacttggtgatcacatgggccaaagtaggggtagaggaccccaaattgaatgtgtggaggggactctgaagcaggtgtgaatgccaggagaggtgggaggaaggacaagggcggtgcatcaagaccacagaagccggcccggccagccttcccacaaagttacttgaactgagctctccataagtacacatgcacacacacccaagaataaactggacaaatggcagcagaaagagaaagaacagaaaagagagctgatgaatacatccataatcagcactaacacagccctggaaagaaaagcaaaaagaaaaggcaagcgctgtggtgtgcagctcttattgtctaaggaccctgttttgaagctggncttgcagaaaggactgctattatcagatgaggaggtgggtcgaactaa

SEQ ID NO: 212624 - DNA, 337 bp, Homo sapiens
caaagtcagcatatgatgtctaaaattgataaaataggctgggtgccaccgtgcatgcctgcagtcccagcgctgtgggaggccaaggcaggtggattgcttgaacccaggagtttgagaccaacctgggcaacatggctaaacttcctctctacaaaaagtacaaaaaattagccagatgtggcggtgtgtgcccgtagttccaggtacttggaaggctaggatgggaggactgcttgagtccaggatgtggaggttgcagtgagccaagatcacaccactgtgctccatcctgggcaatggagtgagaccgtctcaaaaataaaataaaactggt

SEQ ID NO: 212625 - DNA, 168 bp, Homo sapiens
agtgtgagccatcgcaatctggcccttgtctatctttttaatctttctcatttgattcttataattctattagccaaagaaaaatattgttactattactatttatttatttatttatttgagacggagtctcgctctgtcgcccaggctggagtgcaatggcacgat

SEQ ID NO: 212626 - DNA, 622 bp, Homo sapiens
cagatgggatttgttagaagacagaaggaaagacagccataaattctggctttggggaaaactcatatccccatgaaaaggaagaacaatcacaaataaagtgagagtaatgtaatggagctcttttcactagggtataagtagctgccaatttgtaattcatctgttaaaaaaaatctagattataacaaactgctagcaaaatctgaggaaacataaattcttctgaagaatcataggaagagtagacattttatttataaccaatgatatttcagtatatattttctctcttttaaaaaatatttatcatactctgtatattatttctttttactgcctttattctctcctgtatattggattttgtgattatatttgagtgaataggagaaaacaatatataacacacagagaattaagaaaatgacatttctggggagtggggatatatatttgttgaataacagaacgagtgtaaaattttaacaacggaaagggttaaattaactctttgacatcttcactcaaccttttctcattgctgagttaatctgttgtaattgtagtattgtttttgtaatttaacaataaataagcctgctacatgtaaaaagaacca

SEQ ID NO: 212627 - DNA, 596 bp, Homo sapiens
ccctggattcaaagaaaggctgcaaaatgatcttatttctttcttttatccctgagagtacacatatctaactaatgaaaaccagggatggttttattaccatttagtttaggcatatcatacacatatggcaaagtttaattgcatttaacttttttttctggttgaataattatttaagagatttacaggtttcgatataggcctaaatttttaatggatgaattagaatagtatatataaaagtctaaaatagaatccttaatataaagaaaaattacagcaaggataccttttaaaaataacacggggaccaggcgtggtggctcatgcctgtaatcccagaactttgggaggccgaggcaggcagatcacctgaggtcaggagttcgagaccagcctgaccaacatggtgaaaccccgtctctattaaaaatacaaaaattagccgggcatcgtggtgagtgcctgtaatcctagctactcagggggctgaggcaggggaattgcttcaacccaggaagcggagattgcagtaagccgagatcgcaccaccgcactccagcctgggggacagagcaagagtctgtctcaaa

SEQ ID NO: 212628 - DNA, 389 bp, Homo sapiens
ataaaaggttagtcagagagaactagtctctttaaataggtatgtgaagagtgatagaggaagcgtaaggtgcagaagcaacagacccttccttacacagaatagtttaggctagtagaaatattcctctactaataagcctgtactacacctttctaatccaggatcccatgtactcttaaaattgctcaattttactccctcaagtaaaagtaaatcccctaaaaataaagatttgacatcatcagattgaattgtgagtattaaacatagcacacatacctgaaaatatcacataattttattgcatcctgattggaaaacactgttactataaaaactgctgcatgatatttgacattcgcacttagttgttatgataccgcgaa

SEQ ID NO: 212629 - DNA, 179 bp, Homo sapiens
ggtgacccatctacaaccccagctgagagtcagggtcagccttggctggaggcaggagtgcaaaagggttaaaaatcccccaaaatccccttgtgcagaaaaccaaccatgaacatacatggatgaggcgatgtgacagttaatgataggaactaaagaattattcttaggccgggtgc

SEQ ID NO: 212630 - DNA, 387 bp, Homo sapiens
ctctaatatcactctaaacaataaatctacttagtagaattcaagatttctgcaattcaatgtccttaaaaatatccaactaagggtgcgtaaagtatatttaagtcacttacattcttctttactgaatacattctctgtattttaaattaacagatttttctttcctatttgtaagtttatttctcaagatataacagaacctacaaatgtaaagagcttcaaaattttaacaactattttatcaaaatgattaatgtataagctaaaaagtcaagtaatcctaaaaaaaggttataataaaaaccagtgatttctacctgctccttctgactttcctcctcatcaaaagcactcacttttcacttattttggctgtttcttctg

SEQ ID NO: 212631 - DNA, 417 bp, Homo sapiens
tcccacatctcttctcttttatgtgaaatacagattatttggaaacttaaatttttatttatttaacaagcagatatatagcatttactatgtgctgtaactgttctaagcacttttaaatatttgaaagcaatatttagaacagtgcctgcacacagtaagcactatatgtgccaagtaattaaaagtttgaaacctccaaaacctccaaataatttgcatttcgtgccgctcctttcctatggagactctgaagaagactgtattgtcaatcttttaaacatttttggagacaagtgcttatgctgtggcccaggctggagtgcagtggtgcagtcatagctcactatcacctcaaactcctgggctcaggtgatcctcctgcctcagcctcttgagtagctgggactacaggtg

SEQ ID NO: 212632 - DNA, 109 bp, Homo sapiens
tcataaagtggtgtggtgctccttttaagctggcctggattgtttttcacaccattaagaacgcacattttttgaaagacgggcagggagggtgcttttctgttctagg

SEQ ID NO: 212633 - DNA, 408 bp, Homo sapiens
tgaaaacctgtctgtactaaaaatagaaaaattagctgggcgtggtggtgggtgtctgtagtcccagctacttgggaggctgaggcaggagaattacttgaacccaggaggctggaggttgcagtgagccaagattgcaccactgtactccagcctgggcgacagaacaagactccatttaaaaagaaaaatccaaactgacaatcattaacttttaacaagatagttatatccacttacatttattgtgcttactgatgcttttggatttgatagtgctgtcttattttatgttttcatttgttatgcttttttggtgttttccccctcttttttcctactgctttttgagtcgatagaggcttttcccctcattccatttttttcctctctactaatttagtagtt

SEQ ID NO: 212634 - DNA, 554 bp, Homo sapiens
aatggtatgctttaaatgaataaagtgtatgagatgtgaattagacttcaataaagttatttttaaaaatcactcagaggtcatgcagaaaaaaaggtatgagaacaacttacagaggggaaaaaaaaggtttcttctagctaatgtgctccaatagcaatgagcagaggtgttagtggtatttaggctctcagaattcacactatatactttcactttcaagagtaccatttttgggacaaggatgttttatgaagctgaaatgctgaaaatatcagtacctatgttcaccacttgtctaggtgaggctaaccaactgagctaacctctctgatctgagtggggcacatgaaaagagaaccatgttcttttctgcaggttagaaagaagtttaaaacagaagagcacaattccctaaatagaagaaaagcaaatcacagagaaagctgctaaaactacaaccagtcacttcgcatttgcaaggaaaggactgcattgttataagggtacaaagggctgtggcattctctaggggttctcacagaaacctatgg

SEQ ID NO: 212635 - DNA, 340 bp, Homo sapiens
ggactccaggctggtattggggagtgtctgcagaaaaagcatttgccctaggctagaagtcttcctgctaagaaagcaagcagggctttcaggccttgcccttccatgcctgcagtggcttctgttctcatatctgtactttccattggccccctattcccgccggccccctattcccacctcctcccccaccccccacccagattctgcccaggaaaatttgcattcagtcaaaattatgacagcgttcagctagaagtctttctcactgtggtacttccctagttccactgactgccttccccaaggaccactgtgagatgaaagtaaaaaaaaaaaa

SEQ ID NO: 212636 - DNA, 438 bp, Homo sapiens
aggataccccggggaggggcctttcctcaggccacgaggatcgcctggggggatgaactgtgtggtgcgtgctgagatgccaagtagcttttaaaatcggcttttacgagagataatttgggtcatatttttccccttgttggattaaggataaatggaaagatgttctgagcttctgcccatggcaaagcatggggaggtgcttttgttggtcaccaggtgtctttcctacagtgttggggtttttgagttgttgttaggttctgactgaaggtaaaaggttatgtttaataaatgtgagaaaatactatttgaagcctacttttgaaaactcactttttttttttaacctaggcattaatcctttggttgcgagctactagtctgatttttacttaccagattatctttctgtctgtcttactctctgggtatctt

SEQ ID NO: 212637 - DNA, 524 bp, Homo sapiens
cccatgaccttaacatttgtcttttagacacaatctttaatggttcttttccacaacatacatgcaccctttgtttgtttattattgttaattttttctatttgtttacagtattcatttgttcaagaagtttcaagaaagggcaattctaagttagtagagtagggactctcatattcctaaatgagactagaagctacaaaatgaaaagatctgcatgaacctaactggagaatgatgggaaggcgtctgggctgggaggaggctgggaggcctttaagactgtcgtcattggaagccagcgtgggagagaagggattacaactggcagtgctttcaggtccgacataagagagaacaccaaaaagtgttcttacctctgagctactagtagccttcagtgtctttttttgttgttttgttttgagacagagtctcactcttgttgcccaggcggaggttacagtgagctgagattgtgccactatactccagcctgggcgacagaactagacaccttctca

SEQ ID NO: 212638 - DNA, 477 bp, Homo sapiens
aaaggtcccgtctccaaataccattacactgggggtcagaacttcattgtatgaattttggggggacacattctttccatgagatggaatgaacttcaatagtatattttactggcctggcacagtggctcatgccggtaatcccagcactttgggaggctgaggtgggaggatcacgaggtcaagagatcgagaccatcctggccaacgtggtgaaatgcgtctctactgaaaatacaaaaattagctgggtgtggtggcacacgcctgtagtcccagctgcgccagaggctgaggcaggggaatcgcatgaacccgggaggtagaggttgcagtgagccgagatcatgtcactgcactgcagcctggtgacagagtgaggctccgtctcaaaaaaaaaagtatatttcactgaatttgatatatacaaagtaatttcagcctgagatcagtattaaaacgagacattttgcattc

SEQ ID NO: 212639 - DNA, 525 bp, Homo sapiens
taggtatgaggtgaaccacatgcttagggtgtatcctgagtttcattataaaacagaggaaacaagattgatggaaacactgatgccataagctacattagtaagaactgattatctccttaaaaagctgggtttctagagggaattctggatgttaagttcagccagtggatagctgcagccacaacgggcttggatttaccatcccactgcccagcagctttccaacagattacagatcatgttgtgagtaaagattgttttacttactcatttagtcttgtctctaaattcataggtaatttaaggttaactagtttttcatgattttcaggacaatgaaatatattaactacattatagcaagttacaaaaattagctgggggtggtagctcatgtctgtagtcccagctactcaggaggctgaggtgggaggactgctttgaccctaggaggtggagattgcagtgagccaatatcatggcactgcactccagcctgggcaacaaagcaaaactgtgtct

SEQ ID NO: 212640 - DNA, 516 bp, Homo sapiens
acttatatatattgtaaaacccaaagtctctcccctgattgctccctttacccaccccaatctgtggagtatctggtgacattaagaaaaaaaattaagaaaaaaagaaatagaggtcaggtcttaactatgttgcccaggctggtcttgaactcctcagctctagtgatcttcccactttggcctcccaaagtgcaaggattacaggtgagccactgtgctctttaatacatgtgttaaagggcaaaactacaacaaatttaaatctcacttggctttattgtgattttagagttgggcagtgtgcttcattccacaaaacagagttgagcagaagaggttggcttaatagaagagctgaggaaaggggaagcaaagaacaaagggcctattagttgtttcagagctacctttcttgtaaggcagggacagggagaagacagaacaatagaaaaataactgattagttaatatcaggttacttcaggctgcttttttttgtgtaagggttaaagc

SEQ ID NO: 212641 - DNA, 305 bp, Homo sapiens
catcccttcaagttccttcttctgtgtcatcattaactttctatgtgtggttttaatgtacttcaagtaatgtcttatacttattttctcatggctattgttccctttcagacttgataagtcctcaaggagagaatctatgtcttttaaaaaaatcttgatatttccttacagaggtcctggcacaaaatagatacccaatatatgtgcaactgaatagaaatttatgagggagtgataattatccgtgtcttcctttcagctatgactgtgtcccatgataaaagttttttggatgatgatca

SEQ ID NO: 212642 - DNA, 513 bp, Homo sapiens
tagggatactttgggcaatgtcaccctcatgtcactttgaacactggctgcatattagaatcacctggatagcttccaaaaataaaccaaaacaaaacaaaacaaaagcctattcctggatttcctctccaaaacccaattcagtcagaatcccttggagtagggcccagggcatcagcatttttgcaaagctctcccaggtcattgtagagtgcagccaggattgagaaccactgccctagagaaattctttggcccatgcaccaggagacaagtattcaaagcagcagtacttctaagagacaatccaaatgtccattaacaagagcgtaaatgaatgagctgtgcgtccaagcagtggaacactgcacagcagtgatgagctatagctgtgcacttcaacatggaagaatcacgaagcaacagaagccacaaaagcaagtcacagaagtgtgtgtgtgtgtgtgtgtgtgtgagaaatatttcatttacataaagttcaaaaacatgcca

SEQ ID NO: 212643 - DNA, 437 bp, Homo sapiens
caaccccacatggtaatataggtcaaaagtttcagggaggtaatgctgacagaattgaccccaccaatgaaagatggaaaatggtacatagatatttcaatttcttcatctcattggaaggacaattctggagtatattttacaataatttttcagggatccacagtgtgataaagtttcaactgcccatggtggtgatatgttcattaattcatcctttattagctttttcccttccttattgcctttcttcacttctgccacaggctcccaaacatctcccaaagaaagtatttacacccaaatccttgtctctgggttagcttttatgaaaacaaaccaaaggtaatactcaagggaacatttcatccaatatcccccaatctgcttcaccaacccacctctactccagcagcaactactcttgctcctacatc

SEQ ID NO: 212644 - DNA, 439 bp, Homo sapiens
tttgatcttctttcatttcttttatcaacattttgtatttttccgcatacaacacatgtacttgttttgttagatttgcacctaaatatttcatttttggatgatttaaaatactattatatttttaaattttgttatccaagtgttcattgctagaatatagaaatatacagtcatgagttgcacagtgatgttttggtcaatggtggaccgcatatacaatggtggtcctgtaagattataatgaagctgaaaaattcctggtgtccagtgacgctgtagccatcatcatgtcagtgcattattcatgtgtttgtggtgacactgatgtaaacaaatctactgtactgccagtcttgtaaaagtatagcacatagaattacgtataatacataatacctggtaatgataataaaggactatgttactggcttatgta

SEQ ID NO: 212645 - DNA, 429 bp, Homo sapiens
aggggctcgatcccttgacttcctcgcggcaccatgaacagccgccattgtaaactgcttcctctgtgatatggtttggatatttgtccccaccaaacctcatgttgaaatgtgatccccagcattggaggtgaggcctggtgggaggtattaggatcatcagggcagacccctcatgaatggcttggtgccatcctcttggtgatgaatgatttgtcactctgttagttcacacgagagctgactgttgaaaagagtgttgcacccctcctctctctctttgtctccctttctcacctctgctccccctttgccttccaccatgattaaaagcttcctgagggcttccccagaagtagatgctattgccactcctctcgtacagcccgcagaaccatgagccaaataaatctctttgctttataaatt

SEQ ID NO: 212646 - DNA, 561 bp, Homo sapiens
ccatcagcatagtgctgggatggccagtctctgactgaaaaagcccctctcagagcaagcaacagtgtaatccatgccctttgctggaggttctcacaacaaggcctgcttagcaacaacgctcatatgattttgatttgaatggcaaactcacaagaggctactcctgctaaggctgggccatcttatagccttcatttcctgtcttgaattaatctttcaccccaagacacatcataaaacagaataacggcaactcaacagtgttaagtcactaaatacaaatcaaaacagcctgcacataagaagcctcaacctctccatgctgttgcacccaggttttattaggccttgataaacaatgaggtaggagctgtgggggccctgctaacaccttagacattcaagtgcagggtggaggagaaaagaggaaggcacggtggctgaacccacatgaggaggcaacatggaactgcagagagagccacttgctgggaatcaggagacttagcttctgtctcacttctaccaccagcttgcgctatgggtgtgcttgagtca

SEQ ID NO: 212647 - DNA, 669 bp, Homo sapiens
ttttggaaaatctccagaggatgcagaggtacagagcagtggttctcaagctttgggagctgctagaatcttctgggcaggcaagtgggagaaggaaggactggttcaaaatgcagattcctggccccagccccagagaccctaacttgaaatgtccagggtggggcctgagagtctgtacttttgtgccagcttcttggacaacactgaagcagatgtggtgtggatcattcaagaaccctatctggaagctcagaggatcagacccttccacctgaagacaaacccaacagccactcagtgtatttattttatgggggtatatcacagggcatgtattatggaccgaatgtttctgtctccctaaaattcatgttaaagctgtaacccccaatgtgatgtttttggaaatgggaacatttgggaagtaattaggtttagatgaagtcatgggggccaggttcccatgatgggatccgtgttcttctaagaagatgaagagaccagggcaatgtgcactctctctctctctctctttctctctctctctctctctcttcctatccctctctctctctcagtctctctctctctgccataggacacagtaagaaggtggacacctgcaagacaggaagagagccctcactggggaactgagtctgctgg

SEQ ID NO: 212648 - DNA, 281 bp, Homo sapiens
attttaagaatcaccatttacgtcatcctatttggggagaagaatctgtccattctttttatcaatccgtatttttatctaaaagaaacctccagaggatgaaatacaatcactagactttcttgccttgaatatctctgcatttagtattttgtccttgtctcaaataatctgctttggaaggtgacacttaaccccaactggccacacagctcctcactgttgcattttgaaagtttggtctgaaagaaaatattaataaaagagacatgatctccagt

SEQ ID NO: 212649 - DNA, 169 bp, Homo sapiens
tgtcctggaatgtttttttttctttctttttttgagacagggtgtcactcggtcacccatacttgcatgcagtgacacgatcttggcttaacgcaacctctgcctcccaggcccaaatatccaccccagtcagttcttaaatggctgagaccacagatgcacaccacca

SEQ ID NO: 212650 - DNA, 240 bp, Homo sapiens
ggtgcacggtgtcccggctggacctgcgtgcatcatgatggtgagcttggccagagtcaccaggaaagtggcactcctttgtccccagcaaggcgggctgtgaggatggccagagccggctctgcaccatttggggacaagccggagcagagatcccgagagctgactcccgcgatgcagccgtgctgggagagaggtgcaccctgcattcctcaattccgtggaccttactaccttcct

SEQ ID NO: 212651 - DNA, 400 bp, Homo sapiens
catatttcaagaactagatgtgtttcaaagcacataatgaaacttcagcaaaaatgagattaagagtttaggctccaataatattgctgcgattttatttctgtcaaagttttgttatttttgctgtattgtttgcttttcttcaatgttttgtaagccccggttctttgatgaactcctaataagctgtgcttaaaactatgacattgacctttctccagaaacaggtttcagaattgtctgtttttcatgttctctccctgccttttctcttgtaatcaaatcagctattcgggaggctgaggcaggacaatcacttgagcctgtgaggcagaggttgtcgtgagccaagatgctccactgcactccagtctgcgtgacagagtgagatcctgtttca

SEQ ID NO: 212652 - DNA, 473 bp, Homo sapiens
gagacaggactctacaatactactttattgtcggttatcttcacctagagatgatttaaataggaggaacacaatttcttcctagccaatcttaaatggaaaaatgcaaaaattcttccacataacagtcatatcatgaaatgctaattttcccagtctaaaccccgaagctttttgttgataccatgttggctattctatttattctacccatatatgtaaaagttgccaggtgtactattaaccacatctagcattcaatcagcttacagtgaatactgagagaaccatttttctctgaagaagtgtcttgagaaaaatggatcaggaatcactgaacatcattatccaatcctttctcagaattttactattttgcttctctagttgacatgttattgctagttattctgacactcaactattagatttccatgttcctgatgatctactaggatcaaactctgtggtgc

SEQ ID NO: 212653 - DNA, 210 bp, Homo sapiens
cttgctcattattatatcaactttcagagtactcctagcagagggttgggcatacagcagtgctcaatgaatgcatgttaatcttcctcttaggatagttcctcattgcctatttgaagggaaccactttttcttatcttgtaacctggagtagtgtgcttgggaagccaccagttagttaatgtaggagctgacccttggccttggcta

SEQ ID NO: 212654 - DNA, 557 bp, Homo sapiens
gcctgcggttactctagaggaccccgcgacctcttggttgacaacatcttgattgttctgaaaacaaccctttttgacactaaattctagtttgatactcttgtttggaatcagataagagaaaaaacgggactttgtggtttaaatattgaataaattatatagtatgctacatatggcatgttctcaaagtagataatctgggataacaaatatattaatacccactttaagatttatttaaattgacatttccttagttatattagaataattttagagcagaggtcagcacactgtttatgtaaaggattaagggttagataataaatattttaggcatgtactgaagtctgctgttaggaagcagccatggatagtatgtaaatgaataagcacggctgtgttccagtaatgttttatttatgatacattgaagtttgtatgattttcacagtcgcgttgtgtccccctccggcccccccaaccatttagaaatgtaaaaattattcttagcttatgggccatacgaaagcaggtaggatttggcccacggg

SEQ ID NO: 212655 - DNA, 550 bp, Homo sapiens
gctttcctatcttgcctcagcttttctccctcttaaggaagaaaaggccatgcctccatacctaagaacaatcccatctaccagggtcagtagggagattttccacctttacctccctgtgggctgcatgtcagctttatttttaaaataaaagctctatccagctcatgtgcattgagaacttgcttcaaggatcatatgtccactgtttctcatctctgatttctgcacttgatggtatttcttagggctgtgtcctctgcccaattctctcttcattacacaaactcttcctagatgtcttacctgttccatgacttcaacaagacatgaatatatccccacttctgaacttcaagtccttatgcctgactacttttcctacctgttttctacctacctcaacattataggttgatgctgaaaatggtctactcctatttggtaaatagctactccaatttggtaaacatcatactgtttgcccagatcagaaacctgagagtcatttggaatccacccctcaccatccttagcctttacacccaat

SEQ ID NO: 212656 - DNA, 201 bp, Homo sapiens
aatttcttaatctcaagttcaggtagttttttatttagctatctgagcttctcaagtcttgaggcaaatgctaaaaaggtagttttctaaacagctagaggaatttcagacaaaccccatcaaattcataaaaataggtatttgccagaatgctacataggatggttatcaagccaaatgaaagaggttccaccgttgtca

SEQ ID NO: 212657 - DNA, 349 bp, Homo sapiens
cattaggtggtgcggagcagtgtaggtatccacatgcaggaggcagggagccacagggtccagagcagggtgagaaggtcactcattcacatgcaggaggcagaggcgtggtgcaggctgatgaagtcagaatgtggcgaaaagggcattcattcccaccaagggcagatctggtacaggatgtcagagctgtacgtcctctaggggtgggttgggggtatatgcagaagaggagacagcaagaaaagaccagttacttacagggagttgatctaatcagcagatatattaaggatactgggtgctaggttttttttgttatcttagaagtcaattacaaaagttgaaa

SEQ ID NO: 212658 - DNA, 412 bp, Homo sapiens
ctataaatatgaccccagttttagttatggcttatcttatattcttagctgatttttgatggtagttttatcttgtctaagtgagtagtcatgaagatagtcttattttcaacatgggtttaatgatgaatatatatttccttttgtgagagaaacagttttgtgatttgaaggtaattttcaaaaagattaataattctggatttttttcagtttttttttttaaacattgttttaaaaacacgtaacataacatttaccatcttaaatttattgaagtgtatatttcagggccaggcatggttgtggctctcttctgtaatcccaggattttgggaggccaagacaggaggattcctggagcccagaagtttgagaccagcctggggaacatatggagacccctttctat

SEQ ID NO: 212659 - DNA, 351 bp, Homo sapiens
tacacatacctatctgcatacatgcatgtatacacataggtatatctatatacacacgtacacatatatatgtgtataaatatatatatatatatatacacatataattatgtatgtccgattctgtttctcaggagaaccccaacacagtgactaaggactgatgtttcatatacctaactctgtgctcttgcttgttttatttaaaatattttaaaatattttaatatattttaaaagcatgagagagaaatttttcagaccatatttctcatacttttcaaatataaaatacatttacttatttccagatttgtggatgaaagaactggtcaaatacttgcatccaag

SEQ ID NO: 212660 - DNA, 606 bp, Homo sapiens
atacaggttttgtagctcttttccaaacaaaaatagattgcatggatctgaggtacgatattttgtgcgtaacttaagaattttattgggggagggagaaagggatatgaaaagtcttaacttatactggtatatctgctcaccattgtgaaagtaataaaattttatggaataaggtttaaaaggcagctaaaaagataaacgtttcagatcgcatctcacccctgggttctggggaaagtaaaggaggcagctagatgctgttctgacaataagattcccacccctgcactcactttagacttgcttctcccagctttcttaatctcagcatctttgagagtttccacatctgtggcaatgcatgtctacacacagggaccaaggtccttctcactggtgaaaacatggcagaggtggcagctaggaggggtgagtctgtagcaacctttgcaatgaatttactcgactcaactgaagaagggatctcagcatgaagctgatgctacgctaagaaggtctatatctacggaagctgctgcgtgtaggctgacaaggctggagggtgcgttttctgcaggagagctgctcagtttgaggagtgcc

SEQ ID NO: 212661 - DNA, 409 bp, Homo sapiens
cggtgaggccggactgaaactagtgagtgcctccttcagtggtgcctcctttcttccctctctccctggtcctggggaggggccacagcagagcttctgtaactgtctctaattcaagacctggtcctgagctgctggtggccaccctggcttctggtcaggatcagcgttggcagggctgtcaccagccctgtccatagggcagctctgtctccctcacgtggcagtgaccacttccagcctggcacccaggcctcccacctgcagcaggacacggggcatggaatccacaggcaggggtgctatcagtctctctcccccaatcgccagccccgccgcgcctctcccactgggacatttctcttttctgcttgtttgccactgggaatgtggctgtgggcccctcctc

SEQ ID NO: 212662 - DNA, 457 bp, Homo sapiens
tatctccaaacaagttcctgtcattttcacatacacatcaaagacaggatattttcttaaaggattaccatgtccttacttttaaaacatttatgctgtaccaggaagaaactgctgcaaaaaggccaaactgtttttttggtttaattactaaagatgaacatttttactttagcatcaagattggtaaaccgcctcctaaatacctacatttctgtaagtcttgaaggattgtaagcactaatggcatgcatgtctgatttatatattacaaaataaaaattaattttcaaagaggttgactcttaactagtttgcttagccagttaataccatgccttgagtcagagatcagacagagtcaccttatagacaagctattgtcatagagaaatctggttaacaatccattgaaactgatacacacatttagaagatatatcaaagacagagtaaa

SEQ ID NO: 212663 - DNA, 305 bp, Homo sapiens
tgtttcccaggatggtctcaaactcctgagatcaagtgatcgttccaccgtggcctcccaaactgttgggactacaggcatagccatcacacctggacctttcttctttttaaatgtaggctcttacagctgtaaatttatttctgagcactgatttggctgcatctcatgaatcttggtatgttgtgttttcattttcattaacctcacagtatcttccaatttccctagtgagtttttccttaacccattggttgtttaagagcacgttgtttactttccacgtatttgctacttttccagtt

SEQ ID NO: 212664 - DNA, 224 bp, Homo sapiens
cggtatatataggatttattattatttttggttttaggtatccattttaggttttaggtatccactggggatcttggaatgttttccctgcagataagggggggactactgtacattactttctccatgtaaatattgcccatgtaaatactgctgagaccagtagtatattatgattctatttactttcttatatgctttgttttccttctcaagttaattgc

SEQ ID NO: 212665 - DNA, 1043 bp, Homo sapiens
tgcggtggctcaggcctgtaatcccagcactttgggaggccaaggcggacagatcatctgagatcaggagtttgagaccagcctggccaacatgatgaaaccccgtctctactaaaaatacaaaaaattagctgggcatggtggcaggtgcctgtaatcctagctactcaggaggctgaggcaggaaaattgcttgaatctgggaggcgaaggttgcagtgagttgagatcgcaccattgcactccagcctgggcaactagaacaaaattccatctcaaaaaatatatatataaatacataaaataaaatggtggattttatgatatgtgaattagatttcaatttttaattttattttatttttaaatagagacagggtctcgctattttgcccaggctggttatgaactcctgggctcaagcaatcctcccgcctcagcctcccaaattcctggaattataggcacgagccaccaggcccagcctggatttcaattttaaacagagtcatttgaaacctatcccttaacacaagtatgagcaaattatgtcttaatttaataacctgttttttaaagaaaaagtcaaatggtaagggatcaaaaagaaaatctcaacatttatgttataagagaaggacatttcattaaaatgtccttctcttctcttcctcagataattcacagtagaaagaataggcagatggttgctaagccttaggcagaatcattcctttgcctcaacacttgggcaaaataacatactaatggcccccactaaggctgttaagctgaggcaaagactggccagatgttaaccaaaacagtttcctcttttgcttgggcaaatagctaggctatccaccccagcccctgcaggtagcctctgactgacttatagccactgaagtagtagtaaaagtgatgtgtgctactcctaggcctggtccagtaaaaaccctccacacacgatgctccatgccctttacccttcctccaacttaatgcaggtaagacaaacttagaagctataaagggggaaa

SEQ ID NO: 212666 - DNA, 715 bp, Homo sapiens
tgcggtggctcaggcctgtaatcccagcactttgggaggccaaggcggacagatcatctgagatcaggagtttgagaccagcctggccaacatgatgaaaccccgtctctactaaaaatacaaaaaattagctgggcatggtggcaggtgcctgtaatcctagctactcaggaggctgagtcatttgaaacctatcccttaacacaagtatgagcaaattatgtcttaatttaataacctgttttttaaagaaaaagtcaaatggtaagggatcaaaaagaaaatctcaacatttatgttataagagaaggacatttcattaaaatgtccttctcttctcttcctcagataattcacagtagaaagaataggcagatggttgctaagccttaggcagaatcattcctttgcctcaacacttgggcaaaataacatactaatggcccccactaaggctgttaagctgaggcaaagactggccagatgttaaccaaaacagtttcctcttttgcttgggcaaatagctaggctatccaccccagcccctgcaggtagcctctgactgacttatagccactgaagtagtagtaaaagtgatgtgtgctactcctaggcctggtccagtaaaaaccctccacacacgatgctccatgccctttacccttcctccaacttaatgcaggtaagacaaacttagaagctataaagggggaaa

SEQ ID NO: 212667 - DNA, 562 bp, Homo sapiens
cccaggtataagttgcttaccaagatgaataatgagggttctttacagcttgtaaaatacttttttaaaacatcatcacatttggtcctccttaaaaaaaacccagtgggggtggttatcgtgcttacctttattttttagatgaaaaaaaaaactgaggcttggagaggatcagcgacttgtctaaggtgatagacttggaggcagagatgagaggaaggcttctgactccctcttatgccatgttcccagagggagtgcccaaaaacatgctgtctcagcaggaagcagccactacccaaaagcagaatgggaggaaaggaacaggggccacatttggtccttactagccagtgcagaaatgatggtactggaaggagatatttagagagtggcccttctgtcacctgatccaaaggccaggaattgaaggagctatgtcctagagcagcagagttctgttaatttgttgtctgtgccttctgtataatatcactttgtgcccctggatatgctgttttctccagtgagtctagggaaggaactctgagggatcatttca

SEQ ID NO: 212668 - DNA, 512 bp, Homo sapiens
aggacatattggccttttgctatccttcctgctatgcctgaaaccgtttcctcttctctttccctggccaatggtaaatgagcttggaaattcagcatcttggggagcagcagcaagagggtgtatggatcagagcagagacgtgaaaggaggccacctggggtagaagcaagcaggggcgtcttcaggcatgtagagacacagttacctgcttcccctttagagccaggctttccttaaagaccttcactctggtattcctgctgtctgtgttgtccagagagcgagcacggtagtgcagttcctgtgtgagttctgtcttcacagactcctcatcacagactcctttgatgatgtcattactatctaaaaccactgcagggaagccatctggagactgggcatcctgagagattttcctagactactaggtagatacatgctgaaatctcccccaaagcaacccataactaaataaaaactttaaaactttaaaatctccctcatcctgc

SEQ ID NO: 212669 - DNA, 483 bp, Homo sapiens
ctgccacttgcttgtgacactttgtgatgatcatggggtattttcctattggaatataggcactggtagaggagctacatggccacaggagttttgcacagcctgagtaggccatagtctaaagtaaaaggtggagaccactgacctgatgtgaaaactggaaaagacctaagattgatttgcctccatttagatgcaggggtgggctgggatgcctgtcccattctccattcctatgggattgtggaatattggtagtgcttctgggacaaagctcagaaggcgtacctgctatcactaactttttagaatggctaaatgtgaatttaggtataaagatttttttatatatatcttggtttatggcattttccatgcataattgtaatcaatgtacagaatttcaaaaatacctcttctgatttaagattatagtttattttaaccatcatttcagaaaataataaactaagttgcatcccg

SEQ ID NO: 212670 - DNA, 517 bp, Homo sapiens
tgagccccgagggcatggccctgtgatgtcacaaggtggcgtgacagccgggacgaaccccgacccccagcgcggcatccttcccgcggccagcgaccaccgcctcccgggaaggtggctgaccacagccgcaagccgctgcgcgcccggcaagccgaatggaaggacggcgcgggcaaacgaacgcccagtgaggtccagagaagagagggaccttccgagggtcttctagtcgatctcggacaggcttttgagtgccttttaagcattccaaaattttcaggagacaacagtaatttacaaaatagagtagaattaaaaggggggaaaggggagacttttcagagtgggcagagaggctgagaaatgaacttagtaaaaggcaaaccaaagcaaccgcaggtctcgtgtcgttctctggatctgcgcagtccagcagggtgagccgctacccacagactcgcagggcccatgatcgcttgaaatgtggcttgtccaaattgacatgtgctgtaaa

SEQ ID NO: 212671 - DNA, 258 bp, Homo sapiens
gtctgatcatcaggaacaatcagacatatggagaatggggaacatcctaaaagacttcgaaaaaagtcaacatcatgacaaacgaaacaagaaggtagagtgaccatgtcagattaaaagaggccaggcacggtggctcatgtctgtaatcccagcacttcgggaggtcaagatgggtggatcacctgaggccaggagttcgagaccagcctggcaaacatggtgaaatcctgtctctactaaaaatacaaatgttag

SEQ ID NO: 212672 - DNA, 534 bp, Homo sapiens
tctctcctttatctgctggaattctacagctaaacttcaactcaggtgcttataaatattcatatctatttgctacttttaattggttttcatccaattttattttttattttcctattttatattgtatgtacagagattatgagattacgtatagctattatgtcaattttttaaaggaggcaaactgtaaatgctaaatggattcaagcacagtatatggtacacagtttaatggtatatagtacacagtatatggtacacatatggtacacagcttaatgaatacttttttggataaagaaatgaatagatggtagaatgaatgagacagtaaaaagctaaaattaatgataatgaagtaactatcatgaggaatctgtgtccctaaaaacatgtaaataccatgattttaaaatgtacagaccagtaaacttgctcacaatacccacaaaactttaaaaagtcacttagaaagatggtttatgaacaattagaatacagtagcgatgaatggcaggcagcataggccct

SEQ ID NO: 212673 - DNA, 227 bp, Homo sapiens
gaaaggaagtctggggcatctagtcgtgtgatgagaggatgcctgcctttgaaactgagcacgtctgtgggtctttgaatccttttctctgaacaggtcgtagttgggcagatggcacagccagcatgcctccatgacttgccaaccacatttctcatggacccctttgttggacctgaatgtgttcaaatattcggggcttctgtagtcaccctttcatttaatat

SEQ ID NO: 212674 - DNA, 335 bp, Homo sapiens
ggctgtgtagaagcatcctgccctgagttccacagttgggaggaaatgcattctgctaacaactacatgagcttggaagaggaaactgagcctcagatgaaaccagctctggctgactccttgactgcagctttgtaagatcctgagcacagcacacattgaagctgaggctggacagtgggtgttgttttaagccactaagtttgtgataatttgatacctagcagcagaaaactaatacacctcccttttgcaagatgtatcccatctaccctctctgtcccttttcgccactttgtttttcttcatagcccatatacctttcatatttcaaa

SEQ ID NO: 212675 - DNA, 304 bp, Homo sapiens
tcgagctcttacccatattgcctggacgaactcaaacagagagatattctacaaaacaattagagtatatatttccaagatatcaagatcatgaaaaacaaagtaggttaagcaattgtttcagattaaaggagactaaagagacatgacaactctatttaacatgaattcacagactgaaccatgggtctgattgttttctgtaaaggacattattaagaagaaatataaacaaggtttacagattagataatagtattatactgacattaatttcctaattacgatcactgtactgtggcca

SEQ ID NO: 212676 - DNA, 113 bp, Homo sapiens
ctaagcctcgaacctctctctgccactggctgcttcgtccctgtgctggttctcctcctaacctccaggtgggctctctattctttccccttccttctctctttttttttttt

SEQ ID NO: 212677 - DNA, 494 bp, Homo sapiens
ggaaaaaatgatttaaacacccaaggacaaagagaatgggaatagacaggaaaagagctcacatcttcagaaaatggaaagcaccacagagaacatataaaagtaaataaaagaaaatggagaccgtatgtttcaaaatcagagagaggctgaaagcttagaagcataaggtttgagaacagtgaggctaaaaatatgagattaattaaaagtttgcttagaaggcaaatcacaccttaactctcccctccactaatgtaggaactctaggtaagagagtgaaaaactcttctctggataacttctgggaaaagatctctctatataacgatatttgagagttccccaaccaaatagtaaccttccgccttccacctaagacttttaaataagtctgctaatctgcaagctctgtgcagtcctacagcactctaatcagctttttaatgtttcattcttcactctctgaatggacaactaaggatttccaaaat

SEQ ID NO: 212678 - DNA, 417 bp, Homo sapiens
ttaattgaaagtgagagacatgtaactcacctttcacttgacactcgccttcacttagaggccattgtaaagttattaattggcctaatttcaatattgttgagtctcattgaatagggaggtccaaggagaggagagagatgggggaatagccagtcagtggagcaatcagaacacacacaacatttttgaagttcaccatcttatatgggcaccattcatactgtcccaaaacaattactcaaagatcactcattgctggtcactctaatagatatgatgatgatgaaaatgtttgagatattgcaagaattgccaaaatgtgacacagagacactaagtaagcatatgctcttgaaaaaatggtcccagtagacttgctcagtgcagggttgccataaaccttcaatttgtaaa

SEQ ID NO: 212679 - DNA, 270 bp, Homo sapiens
agagtggtgccttgcagcattacagataggtgcttcagaactgtttccctcttcatacaaattcagctcaaatgtgtgatactgattctggccagtttatgaatgatgtgtgttttgggaatatctcttaatggtttatagaatggacacttaatatgtcatcaattctacacttattttggtcctcatatgtctgctaaatcttgcagttttagtttcttttcttttttttttttttgagacagagtctagatctgttgcccaggctgg

SEQ ID NO: 212680 - DNA, 426 bp, Homo sapiens
aaggcatcctgtgaggctgtggataacagaagctttacaggcaacaaaaatctgtgtccagaatgtgaaccttttcctgttaggacaagtttctgcctccttcatggctcactgaatggcacggaagttgctatgatgtcgtgctggtggaacctgtgggaaatctgccctctagagtcctgggaaaaggcattcatggagaggtatctcaccggagacactgcagcacaactgtgatgtaagagggaggggaatgctgggagaagctcccacagagtgctgctgacccaccaggcaatggagaagctgcaagggctgcccatgcctaccaagtccacatgctggcccaggaagcaacacccttcctcttgccctgtctctcgagctccctcttctgacaaagcctcagtaccagctggctaagga

SEQ ID NO: 212681 - DNA, 509 bp, Homo sapiens
atgcacatcaccgacggggctgctgcagacattcaagggagacgcgtatctgaaaggcacttaataaagtgtacagtgtctgttactctcaaccgcctcacgctagcaccactcttccaaggcagtcaccacaactacatttcagtgtaatcatggttctggtaaaacttaatctcagccattactaataataagggatcttcaggatgagttattttcttcaatttacagaaaatatgaacccttaatttgaacgcactccacttaaccaattactttttattctgttgaacttaattataatgggaaaaatgccttattttgtaatgatggaaataagttaattggattcctgaaaccagtcccaccaaacagagctgcttggacgtatacacccaaaccaggaaaacagcaaaacccaccactagaaaaagaatctaattcaaatttagtttaatttggtcacaaattaattcaaagagcaacattaattactgccactttttcag

SEQ ID NO: 212682 - DNA, 371 bp, Homo sapiens
gcacataacagtcggcctctgtacccacaggttccatatccatggatcaaaaatatttaggaaaaaagccaggtgacatggctcacttctgtaatcccagctccttgggaggccaaggcagggagatcacttgaggtcacgagttcgagaccagcctgaatactaattatatacttcattttaatcaaactcaatttgtgaaatagctggatttaggatttgcttaatgaaagagatatgacgttcctttaaaagccagcttttctactagaatcaacattatttgaattacatgcaattatatgagatcatatcaatgcataggaagctagacatgtattagattgtggttaagggcatacgctttggag

SEQ ID NO: 212683 - DNA, 322 bp, Homo sapiens
agggcatggaaaatccattctgtttttcagattaagccacagtctgaggcaggcactctgaccctggcctcagggagagtgatcccctcagtgttcctgcccttcctgttcgtcctgtatttctggctacagattttgttcctgcctctctcccaaaagtagtctgttttctaattttactcccttgtcccaactgcaatagattttcttcagtgtcctaaggactgcagtgtttgttttccttcccctaacaagatgaagatttttggccaggtgcggtggctcacgcctgtaatcccagcattttggaaggctgaggtga

SEQ ID NO: 212684 - DNA, 699 bp, Homo sapiens
tgcaattaagtgatggaatatacagataatagagaaactgaagttttttatcactctttcttcaagtgagttcaaccataaccgaaagcaattagagttataatagcatttgaggctcttgctcatccacagggcagacggcagctagactgagtgatgaagctgctgtcactcaggcagatgctagagtgacacccctggacaaaagatcccaagtttttgtttttgtttttgcaatggagttgcctcttaaagattttgcagcttgctccttttatcgtggcattacatgataaaaataatttggagtgtccttttattgggatacacaaagagatttctctcaaaatggcttagagtacatcagagttttattctgtttaacctcatcatgttgcttaatgggaggtggaggtgggaattactgtatctattttattgctcagcagtaccagacttcaggtgctaagtgacttgtctccagtcacctgggcccattactcagtgcagatctgtggccaaaaaaaaaaaaaaaaaaaaaaaaaaaaaaaatcccccaaatttgatctttcctgttaaccacaaagtttgtaatgccaaaaagaaagactttttaaaatataagacattatttgttaaaagcccatttgattccttgcctttagtagtactttttgaaatatttatgaatgaaaggat

SEQ ID NO: 212685 - DNA, 477 bp, Homo sapiens
tgagccaccgcacccagccatactttctcttctaaagatattcttacttttatagttaaaaggaacttaccaggggccaggcacggtggctcatgtctgtaatcattttgaatggtacttgatattcacatgacgtcgtgttgatgttagcttagatcaaggcagtgcttgcccggtttcaccactatacagttactcttttcctctttccgtactctctttttttgcaagtgaatagctatgtccagtgcactctcaatgggggagcaaggactaagctctacctcctggaagagatagtgtctacatctgttactgggaattcttccgtaaggaaactttatctcctattctcttatttatttaatcatttatttatatgagtatggcctcatgtatgtttattttatactttgggttataatgcagtactacattacttgttctgttgcttggattgttccagctttggccatt

SEQ ID NO: 212686 - DNA, 322 bp, Homo sapiens
aggtataatacaacagtaaggactcaatatcagagagggcagaaccattctgaagtgatctgaagatcaccagctgcttaaaacttcctagaggcattggccaattctgaatcagggcagagaacaagctcaatgcaagccgaggctatgattaaggaaaaaaaaaatcaacaaagctgttagttgtcatggaaagctgactgacaagttataaacttgagaggattctaacacatggctgagttctgggactactcaagaggtcaaggagccagatcaaaagggaaaacaaaattttctacagatctgtgaatattaagga

SEQ ID NO: 212687 - DNA, 418 bp, Homo sapiens
ttcttagctctgggtttcttagctttggtaccatggacgtttggggctggatccccgtctgtggtggggccgtcctgggcactgcaggatatagagcagcatccctggccgccctacccaggatgccgggactactcccatgccccagctgtgacaaccagaaatgtctctataggttgccaagggtcccctggttctcctaggactgtcttggtcttagcactgaaagccccacttgcagggaagcccctcggtcctgggcaagcagggacagctggtcaccctccctggggagtgacattgccccctgccttgctccattgaaaaccactgctctaggccgagcatggtggctcacacctgtaatccaaacactttgggaggccgaggcgggtggatcatctgaggtcaggagttc

SEQ ID NO: 212688 - DNA, 91 bp, Homo sapiens
tgataaggcaaaagtggcaaagaaagaacaaaaccgagaaatactatgagggaaaaataaatgaaactttgaccacatgtgggaattgcaa

SEQ ID NO: 212689 - DNA, 124 bp, Homo sapiens
cataagtggacctgctgaaaatctaattccaataaataaccagtgcaaatatgtggctataagattattcatcacgatattcttatttttaaaattttcttaaaatagcaacggggccgggcgc

SEQ ID NO: 212690 - DNA, 484 bp, Homo sapiens
ctcccaggctcaaacgattctcccatctcagcttcctgagcatctgggactgcaggcacacactaccatggccggctaatttttttctttttctttttttttttttctggtattttttgtagagatggggttttgctgctgcccaggctggtctcgagctcttgagctcgagagatctgcctgattcagcctcccaaggtgctgggattacagacgtgagccactgcactcggccccaacgcattactttgatttaatatttggatcattaaaaataactaaagatgtatttcctcattttttctctgtctgccttactcgcaatattaaaagtagagaatttcagaatattatagtaggaaatgacctttgacataatgaatcgggcccttcattgaacaaatggttcaagtgtcagcaaactacggcccgtgggccaaaggtagattgtgagctaaaaacttgtttttactttttttaagtt

SEQ ID NO: 212691 - DNA, 556 bp, Homo sapiens
taggatcccctctgaaatgtcagcatttgaaaaacacaacccaaaagtagaggatctacagggaactttattctctcacttctgtcttcatggagggcactgccccttgggaagaccaggttggcttctggcacaggtatcccccatcttcttgggcacctgtggcattgccagcaggccagagggggcagctggcagtgttggctctagcctgacccagggggcccagttaggatgccctctacccatggcaggggtgatggctacttctccatggttcatgcatgaagcttccagccctttccagctcagggaacacatgcagaatgacagtcacccagcagactggaaactgcctcctctccaaaagtctggctcctgaacaccctcctccctgggaagggctttagcccctttgagattgggcaggaaccagaagaacagtttctctgctttgccatgtctgcaacctagggctcacccagccccatcaagtgctgagctccagcactgtccacacagtggaaaccaagtgaaatgactttggcttgtggag

SEQ ID NO: 212692 - DNA, 734 bp, Homo sapiens
ggaggggacctagggaggggctggggagtggatataactacactgcctttaatattgtcttcaagcaagaacaaaaataatgtcttcttggtgctgtgctgtctacccacttatctctttggtattggatctctctggtgagaaaacgttgtcactcctctctttttgtctcttcactttgctgtggtcaaaatcttgtaacatctagtctaggaaggaaaaaaagactaatgcatttacctcttctggccaaaatttgtaatctcttttccatctaatttagaaaactgaggctgaatatttggtttgaagtcaaacaattcaggaatggatttgaagtcctaagtatgaacaacgcattgctttgggccttacccaacacttaacttcacctgtctcatctacaaaatagagataatttctgagtttgtacgattgttgtaagtgctccaacatgggtcatctgagggccactgttaggatttttatcaaatgtgttctgcctgttctgttacctatttaatatccttatttaagtccattcaagttttcacttacctaaatttatttttgaagggaacattatttagacctcacattccaaacaggctctcgtttacttgctgcagtgatcaagtgcaccctgttcgggttaccggcgccttcctgtgcactttatccaccttgcgcgcctagtaagtgagtcccattcctcccgtcgctgttccaccacg

SEQ ID NO: 212693 - DNA, 458 bp, Homo sapiens
ataaccagagaatgagacagttgaagacccttcatgtagaagcaccaacaggaacaacagcagcaaggctgcagagaagagagatggacctaaggaacctccttgtaagtggctttttgtatgagaatctctaccataccaacaaacaaatgaacacacaaacaaaacaagctcaagatctcaattctataagagtttcaggagacaagcacaatattagcaaatgccacattgtaaccaacaccagcatgccatcctgctaacttggtttctggtgagaagtcagctgttgttcttattgaggattgcttctgtgggatgagtcacttctctcctactgctttcaagattctctttgtcttttacttctggtattttaataatgatgtgtccaggtgtggatatttttgaatgtatcttacttggagtctattggctttttttaattttttttggaa

SEQ ID NO: 212694 - DNA, 527 bp, Homo sapiens
catgctaagaccgcacacaattggttacaaaaaccaaactggatgacactgtacaaagccacatcaaatgcacactaaaccttaaagaaaaaaaaaatcttagggaaagtttaacagtcctgtaaaccaaaggcatttaaagatttctcccaggaagccatttagcaaaagacactccccagccccccttctcccacttccttcaagctcaccactgaaaacacctccaattcttgcctaaaggtgggctccgacctcccacgatatttagaaggaggaaaaaagaaaaaggaaaaaaatccacctcttaaggcaaatccactcttcagaggcccacagtttcaacagggctgaatttctctcctgggggttggggggaggcaaaagaggaggaaaaaaaaaaaaacccatctggcaggccccgagtggcgacatcctgtttattattaaacatttttagcatggagcattcagcatttcgaaaataaccctctggttcccgcactcacaccgagactgggcggccg

SEQ ID NO: 212695 - DNA, 442 bp, Homo sapiens
aatcaaatcagaatgtgacctcaagcaaattgcttaacatttattacagatagaccctctccccatcaaccaatccagatactactcagatacgtcttagtcttcccatctactggagggaggctctgctgctgctttcatcactagacgaatgtcctgcaaaataatatgatcctatgtatgcatctaggttaagcttttcttcttcttctttttgtttttttttttttttttttggagatggagtctcactctgtcgcccaggctacagtgaagtggcgcaatctcagctcactgcaacctccgtgggcctcaagttgactcttccacctcagccctcccaagttcctggaaccacaggcacttgccaccattgccgtggctatttttcatattttttggtaaaaacggggtttcgccatttttgcccaggcgtggtctg

SEQ ID NO: 212696 - DNA, 365 bp, Homo sapiens
ggtgtttttttagggttttctcttattatttagaatgctcttgttgatgctttttttctttcctgctccttgaagggagggcagtgtgatattagcggtgcatttctctcatggtgaagggcactcccagcaggagagcgcagtgaggacgacagtctagtgaactcacagctaccgcactgggcacatagcagcgtcccctcacacgtgtggagccctgtgcattttccgggttcttccacacatgctagagtgttcacatccaccccgtcacataaacacacaggaaagacattcctgtggaatagttcgtgcagatgataaaatagatgcctgaaagctaaaacgacacagtaagtaggaaa

SEQ ID NO: 212697 - DNA, 456 bp, Homo sapiens
cagttataatcctcataagaatttttataatattttttaagctgtgcaatccacagctgtgtaactgagaaaaatcacttaacctgtctgaacctaggtttcctcaaatatattcagtctgcactcccaggacctcactttaagagaaacctgaatctcttgagcacgagcatgtggatgggtgttattcccttcctgcacaccttctgtgcttcaaagagagaacttatgtaacctttttcctcatgtatccctgctttgaaacctgtaaatttctatctttctctgcccctttctgacttcttttattattattttcaacctcatcgatttcttcaaattactttccatccactaaatatttctaatgagccctgtacatttttctgtaccactgtggaaaaaaagtaaaataatttctgtcttaacaaaggattgccgcacccatctggcatt

SEQ ID NO: 212698 - DNA, 358 bp, Homo sapiens
gcccaggctggtcttgaactcctggcctcaagcaattcatcccatcttggcttcccaaagcactggaattataggcatgagccacatcacccagccttgtagttatttttaaaatgaagacaagaggaatagagtatacctttaaaaatatatgatactgtgtattggatgattctgaaaggatgtatttgcctatgaagaaaaaccttcttgttttgatgtctggttgttagctttttactttactaaagcccagttaacttttctgtgctttagttccacatctgtaaaattactcattttatatttctctatccactttgaaaattaagtaaatgctctttgaatttcaactttt

SEQ ID NO: 212699 - DNA, 623 bp, Homo sapiens
tttaaagttaggcatgttgatgtgcacctgtggtcccagctactcaggctgaggcaagaggatcgcttaagcccagttggtcaaggatgcagtgagccgtgactgtgtcactgcactcccacctgggtgacagagtggagaccctgtctcaaaaaaataaaaataaagcaaaacaatttgttagttaatacactgccttttgacatcttttcagctgtcattttgaagtgatatttaaatattatcttactaatttatatcccactagttgcccgtatcttttatctcctataacatctaaacctaggtccttgcatataaatgctttcttaaaagtacagaatttattatatcaaaatgtcaaatcttttctttaatcaggataattatgctgaatttgctaccctctttaacctagcaaaagttgttttactaactgtttatgcaattgcttgtaatttctgctaagaaagtagaaagtttcttgacctctcatggtcagtataaattatacttaaatattgttgaatatcatttacctggacctgttccaaataaagtatatttctggagcttaactatctcaatatgaaaagagtagaaggactaaaaaaaaaaatctt

SEQ ID NO: 212700 - DNA, 501 bp, Homo sapiens
accatactttgagaaccactcatacagaggcttgatgaaaaaggcttaaaactaagctttttgaaagcaggggctgttcctgtttagaagtccaagggttcactgatctaaattcaccctgaagatatgtgtccttttttcctaggaattcaggcttaaacagtctttctaggataggggtattagtaggttactgttattggaataatcccaaatattttatgatagttcagtgaataaccatcctttcttttttacatttaaaataatctaagttcctaaccttacacagctaaataattgaaagatcaatattaaggacatgtaagacaacttagttgaagagttttgtcatttcttgggaccattcttttcagtcatttccagcagggccctcaaagcaatttacagagccatttctcacaattgggcagacatactcaggtttagtgggtcatttttgcctcctgctgcttctttctctcctcttctgtatttctt

SEQ ID NO: 212701 - DNA, 256 bp, Homo sapiens
caacaacatcccaacagttaggaattattattcccatttcacagttcagagggcaaaggtgctgaaggaggcccaagttcatgcacctggtcagtgctacaccacagtttaggaatcagactgtttattccactgactcaattctcttcctaggcagatactgccattctctaaagcgtagctacttccgacctccaagtttctctgtctctctggagagggctcagtgtgctcagtgtgatgatgaagcttgcag

SEQ ID NO: 212702 - DNA, 1654 bp, Homo sapiens
  misc_feature (881)..(881): n is a, c, g, or t
  misc_feature (951)..(951): n is a, c, g, or t
  misc_feature (1649)..(1649): n is a, c, g, or t
ggaggcagaggtttcagtgagcagagatcatgccactacactccagccagggcaacagagtgaaaccctgtctcaaaaaaataaatataaaatacataaaaataaaaatcagacaagtgtggtggtgcatgtctgtagttgcagctacttgggaagctgaggtgggagactcactggagccctggcattcaaggtggcagtgagccatgatcacaccagcctgggtgacagagtgagactctctttaaaaaaaaaaaaaaaagttatttttttgttttccttgtgtagggtccctgccagtcttctctgtatcatttccatgttggtatgtatgttgccaaagtgaccactagttcttgatctgtaactataaatgggtcacaggttgagactaaagtctggcaagatcaaagccatggttgaaaaaccaaacaaaatgactgaaacccgcaggagagctctgagagtccagtgcctcaggacagactgcactggtggtgctctgggggctcggccgtatttgaatgcagatcctggcactgcagcagtgagaccacagagaaacaacacaggaaaaaggagaatgtgtaccatcttaaaaaagaattattataaaagtccaaatctagtcaggtagacaagcccaagcccatgatcaggaaacactcttcttctctctaaaaagtttccctgcctcagactttttattgctgacgttggcagaggtagaggccacccaactatggtttgtgacataacactcgctccaagaacattatactcctaaataaagacgttccctttcatctcagagtggaacaaccccaaccgagtcccctagttgccatctaaaattatctctaattctagctgagcatcangagcaccagcaactcccagtccagtgcagctgggggacaattcaaagccgtgtgcactgtcatccacaanggctgaactaatttacattcccaccaacagtataaaagtgttccctttttggccaggcacagtagctcacgcttgttaatcccagcactttttgggaggcctaggcggatggatcacttgaggccaggagtttgagaccagcctggccaacatggtgaaaccccatctctactaaaaatacaaaaaattagccaggcatggtggtgtgcacctatagtaccagctacttgggaggctgaggcaggagaatcacttgaacccaggaggcagaggttgcactgagcctagatggcgcccctgccctctagcctggacatcagagcaagactccatctgatatggtctggctgtgtccccacccaaatctcaacttgaattgtatttcccagaattctcaagtgttgtgggagggacccagggggaggtaactgaatcatgggggccagtctttcccatgctattctcgtgatagtgaataagtctcacaacatctcatgagtttatcaggggtttccacttttgcttctgtcctctttttctcttgccaccaccaccatgtaagaagtgcctttcagccaggcacggcggctcatgcctataatcccagcactttgggaggctgagatgggtggatcacgaggtcaggagttcaagactagcctggccaagatggtgaaatcccatctctactaaaaaanaaaaa

SEQ ID NO: 212703 - DNA, 427 bp, Homo sapiens
ggaaatgccacacaactgctctaacagagactgaaaaaaaggcagaagaacacagggcaaatcaagggatgtttcacgtcagaaacagacagtctctgtggcttgcagtggcagtaataataatagatcactaatatctagcacttaccacgtgccaggctccgttcccagtgctgttcctgcttaactcattaaaccctcctaacaacctgtgaggtggataaggcctttccctcagtttagagaagtggaaactgaggcgcagggaagttcagtaaatccctgaggccacaaagctaaccagcgcagacgtgagattcgaacccaggtagctgggtttcagatccccttttcatcatcatgcaacaaaactgttttctttcctgctcaaaatcacactaattaattttattctgtttctggttaa

SEQ ID NO: 212704 - DNA, 821 bp, Homo sapiens
tcccaataccatcattatctgggtcagcctccgattcagcctcatcctgtgcttcagcagtggggtaaaacaaatgtcacttgttagctgcttcttcatgaccttcatagactatgcattaatttgaagccctgcccccaaaaatagtgcttgggggggaaatgagttagtgattttgtgaagataatgggagttgaggaaaacacttaagtttgcttttctgagctctagcttcattttacttctcagtctcagtatttaattgtctccactgttttttctaacttggaaggaaatcagatggcgaaagtgaaacatacggctatcaatgtgaaaaagctgctccctatagcactggaattctcttgtcattaatagctcttgtagtcgacagattataatatacagagtcataaatgttcttgttgtcatttggaaaattacaaattcccaaaaagtggtgattatttggggctttgggtctgcaagacgtttcacattaaaatgctgataatatcttcaaaaaccacagagccatgggccttgcaggcttggtaactgactgcctttgtggtgtggttttattctttctactgaagcacctggttgaaaggagtgggatgctgaattcataggggcgtgttcacaaaaatctttaacatcaagtatctgtttattcaaaatagtgcatagttcaaagcaaccttgattccttaaactagatgtttttctgttctttaatgaaaacagcctgaacgtggttattaatctgagtctttctccattctgaccaccccactctgtttttctctttgaatatc

SEQ ID NO: 212705 - DNA, 564 bp, Homo sapiens
actaaaagcccaagcctcagtgtcatgcaatttacccatcacaaacctgcacatgtacctcctcagtctagaaaaaaattaatagaaattgtctctgaggaagaccagagagtgaatttactagacaaagacttaaagtcagctaatttaaatatgttcaatgtactaaaaagaaaatatgtctgaaaacatgtctaaaaacctacactataaaatcctttctcaccaaaaaggagttatatcaataaggagatataaatattacagaaatttctatattttacaaatagaaagagatagcaattataaaaaggaccagactacagatcttaagaataactgaaaaggaaaattcactagaggggttcaacagcagataagagaagacaaaaagaaccagtaaatttggagatagggcaaagaaaattttctagtctggagaacagaaaaaaaaatttaacagagcctaaaggacttgtagaaaaccactaagcataccaacatatgcataatggaagttccagaatcaaagaaaagaataaaaggtgcaacaagtacttttga

SEQ ID NO: 212706 - DNA, 607 bp, Homo sapiens
tctgacatctcatggtacctctcagtgaagaaaatataaaaagatttcttatcacccaggatctgttggattgggcttcacaactcagggaaattccaacatgaatatgctatatacatggtcattaaagaccttaatagtggatatagacctctatcataacagcatgaggaactctgggcccacttcccagtaaaactgatgaaatttattaaagaataaacatttaaagcacctggaaatggtcttaatggcatataaatgaataaacatctattcaagaaaatctatgaaaatttggtaacaaaagcaaacgtctgtggtaactgaactaagaccactccctctcagcaccctcccagcaaaggaaggcagaaactgcacttcagactggtacagccaagaatacagggttccccctcccctcagcttccagttgggttttcttctcaggaggaacagaatattaaccagcacttctcatctattactgaggccaatttccaggtaagtgtggttgacagggggtgactctcttcttccaccagcctctgctcacagaatggaggctctaccttgagcatggcaccactgagacaccaatgcc

SEQ ID NO: 212707 - DNA, 385 bp, Homo sapiens
agaaagaataagaaacagaagagataaaagcagagagaaaagagaagaatgcagttgagataaataacatatagtaggagccattgtgttgcttgacaatggtgatgaaggtggtacatgtagataataacactggagtaagacacataggattgaatatttctgaagtcttctactgacatcagccacttgcattttaatactcctacacgttgttctccaaacttaagcctgtatctcatcaataacaatttggaatttcattctttatggatatttatgtgtgtgtgtgtgtgtgcgtttatatgaatacactactttactaatttttatgtacattataaagcacgtacaaaagaaatagaaaattaaacagaaatacaag

SEQ ID NO: 212708 - DNA, 1032 bp, Homo sapiens
cttccagccaagcgtccgctctctctatcaggtccttgcatctgtgaaaaacaagattgaacagtttgcttctgtggagagagacttcccagggctcctcattcaagctcagcagtacctgctcttccgtgtggacatgtctgatatgacccctgcagcactaaccaaagatcccattcaggaggcttccaggacaggaagtggcaagaaccttttggatggacctccaagagtgcttcagcccttcctgacccacagaaccaaggtggctgaggcaccccccaacctgcccctgccggtgaggaaccccatgctggctgctgccctcttcccagagttcctgaaggagctggcggccttggcccaggaacactccattctgtgctacaagatcttgggtgactttgaggactcctgctgttagctttttttttttttttttaatagaggttcttgttttgtaaggttttagtgtcttgactgaatgttaaatgcaaagctgcttacaaagatttctactttaatgtttcctgacaatacttgatttgtggggaggggaattttctgtatctttcctctctctctctagccgggcctttccaccttatgttatatatagaatgtaagtctcataagctggttgctcccttggcagttttctttgctctgtttttcctccttatatttttttggttgtcattctcctatccctttgagttactcttcttgcagctcagatcacgtcaagcagatattggggttcagtgatgtctggtgatgtctggaagtgccccatgtcagaattccagctgttcagcagcacaggaagattgtacacctgcaactgtgcgaatggtcctgttgcctcctgcattttggcctctgttctataaaggaagagtaaagatggagctcctcctgcctccatcacgaaagcacatatcatctgtccctttggattttacttccaggacgtgtgtcgtccccagcgtgtgttgccttatggtgccggcagagcctcagctatctgcc

SEQ ID NO: 212709 - DNA, 905 bp, Homo sapiens
atagaatcgagctgtgtcctggacccggcaagactaaccaaagatcccattcaggaggcttccaggacaggaagtggcaagaaccttttggatggacctccaagagtgcttcagcccttcctgacccacagaaccaaggtggctgaggcaccccccaacctgcccctgccggtgaggaaccccatgctggctgctgccctcttcccagagttcctgaaggagctggcggccttggcccaggaacactccattctgtgctacaagatcttgggtgactttgaggactcctgctgttagctttttttttttttttttaatagaggttcttgttttgtaaggttttagtgtcttgactgaatgttaaatgcaaagctgcttacaaagatttctactttaatgtttcctgacaatacttgatttgtggggaggggaattttctgtatctttcctctctctctctagccgggcctttccaccttatgttatatatagaatgtaagtctcataagctggttgctcccttggcagttttctttgctctgtttttcctccttatatttttttggttgtcattctcctatccctttgagttactcttcttgcagctcagatcacgtcaagcagatattggggttcagtgatgtctggtgatgtctggaagtgccccatgtcagaattccagctgttcagcagcacaggaagattgtacacctgcaactgtgcgaatggtcctgttgcctcctgcattttggcctctgttctataaaggaagagtaaagatggagctcctcctgcctccatcacgaaagcacatatcatctgtccctttggattttacttccaggacgtgtgtcgtccccagcgtgtgttgccttatggtgccggcagagcctcagctatctgcc

SEQ ID NO: 212710 - DNA, 901 bp, Homo sapiens
cgaactcgagctggtaccggctacctacactaaccaaagatcccattcaggaggcttccaggacaggaagtggcaagaaccttttggatggacctccaagagtgcttcagcccttcctgacccacagaaccaaggtggctgaggcaccccccaacctgcccctgccggtgaggaaccccatgctggctgctgccctcttcccagagttcctgaaggagctggcggccttggcccaggaacactccattctgtgctacaagatcttgggtgactttgaggactcctgctgttagctttttttttttttttttaatagaggttcttgttttgtaaggttttagtgtcttgactgaatgttaaatgcaaagctgcttacaaagatttctactttaatgtttcctgacaatacttgatttgtggggaggggaattttctgtatctttcctctctctctctagccgggcctttccaccttatgttatatatagaatgtaagtctcataagctggttgctcccttggcagttttctttgctctgtttttcctccttatatttttttggttgtcattctcctatccctttgagttactcttcttgcagctcagatcacgtcaagcagatattggggttcagtgatgtctggtgatgtctggaagtgccccatgtcagaattccagctgttcagcagcacaggaagattgtacacctgcaactgtgcgaatggtcctgttgcctcctgcattttggcctctgttctataaaggaagagtaaagatggagctcctcctgcctccatcacgaaagcacatatcatctgtccctttggattttacttccaggacgtgtgtcgtccccagcgtgtgttgccttatggtgccggcagagcctcagctatctgcc

SEQ ID NO: 212711 - DNA, 456 bp, Homo sapiens
atctgctgccaaggtcacttgttccctttccctgcctcagtgaaatcatgagttgagatacagcttctaccagcctgggtccccaggtaagcaaaatacacccgcccttacacatggaaggtgaacagcaggcaagcttttgtcatgttaagtcatttggatctgggggttatttgttactgtaacataagccagccactgctgacagatacaatcactgttcatgtcaccagttggcgaccttcactttctgactcagcctcccctctggcttttcagttgccactctctttagttcagctctcagggacacacagtgcactcaagctacccaaacataaagctgccccctagcagttttaaggattaaaactgatatctgatgccctatagcctatagcaacccagcaaaactccagtctcatgctgcagccccattacccttggcagagatat

SEQ ID NO: 212712 - DNA, 411 bp, Homo sapiens
agaagcacgcttgcccagcctcaccctggctggcctcacagcccctggttttcttcctggcctgggccagggtccgtggggcttggcaaaattaagcttggaggaaatggatcccttcattgctgagctcaggctctggaagaaaaacaccccagcccacaggctcagagcaggttttatttatgtgtccacttgttttacgcagctgactttactggacattattcagaccagtggttgcaagtgattgttaccaagtttgtaggaaaagcaaacctccaggaaggtgagtttcaaaatagagagtggcagatgttttcgaaaggctggccaactgcttgggaccagaccagcgataaaacttctcccagcaatcccagatgtcaataggcaaaatccaaagccaaaaaa

SEQ ID NO: 212713 - DNA, 422 bp, Homo sapiens
tgtcaatctagaattctgtatccagctagactgtaatatagatgtaagagaaatacaaagatatattcagaaaagcaaagactgattattcaccacctctagacccttgctgatagaagtattaaatgatgtgcttcaacatgaagcacactgaacccaaagggtaggagtggagtgtaagaaactgtaacgattgcaaacatggtaaaaatacactgccaaacttaaaaaaaaaaaaaaaaaaaaaaaaaaaaaaaaaaaaaaaaaaaaaaaaaaaaaaaaaaaaaaaaccttgtggcccgcttgggccaagtgaattttctggaccaagtttatccttgcggccgaatttggggctaattgggcaatttcgccttatagggagccgtttaacattcaatgggccgtggtttaccgtgggg

SEQ ID NO: 212714 - DNA, 159 bp, Homo sapiens
aatttttatgtgtgctgaaaatgaatgtgttattattaattattgggtgtggaattctatgtatcattcttagaagaaacttgttaattacatttaagaaatgttctatatgatatataagttctacatattatataaatttctatagtggatacttta

SEQ ID NO: 212715 - DNA, 543 bp, Homo sapiens
cgtctaagggaaaaaaaaatcgcttctctttgcaggcactgaaaatgaccagcaggacggggcgtgatggtctgtaatctcagcactttgggaggctgaggtgggaagatcacgaagtcaggagtttgagaccagcatgaccaacatggtgaaatcccgtctctactaaaaatacagaaattagctgggaatcccagctacttgggaggctgaggcaggaggatcacttgaattccggaggtgaaggttgcagtgatctgagatcaagccattgcaccaaaagaaaaaaaaaaaaaaaaagagagagagagaaatgtctcaagaggcacagggcatctttcaaatgtaaatcaaccttgggggtgtggtgtggccagagaggtgaggtcaagagaatactggataatgtcctgtttatggcataaatcagggcccccctcattagagtttccgtaaccatgaggcatgcctcccaatttcataaataatgctacgtaatggttatgcataactgatcattcagaataaactccagatattatt

SEQ ID NO: 212716 - DNA, 411 bp, Homo sapiens
tcatgctggacgacatagacagtacccaggagaggagaatcatacttctaccggataatccgggcatgaacaagagataaggatacaaaaagccatgctaataaaaacagtaacaaaaattattaatgccagggaagacaaaaaagttatacaagatagaatatgttaccacaggcaggatgcaatggcccattcctgtaatcatagtactctgggaggccaaagtgagaagatcacttgaggccgggagtttgagaccagcctgggcaatgtagtgagacccccacctctacaaaatatttagaaattagccaagcctggtggcacacacctgtggtcctagctactcaggaggtagaagtgggaaggttgcttgagcccaaaaagttaaggctgcagtgagctgtgatc

SEQ ID NO: 212717 - DNA, 525 bp, Homo sapiens
gacacaaaaggacgaatatgtgaaatatttcgaatatgcaaattcacagagacactaggcagaaaagcagctaccagtggcgaaaggggaggtgggaatagaggagttaataggtacagagcttctgtttgggtgataaaacatttttgaaatagatatgcaggatgtttacacaacaatgtgcatgtaattaatgctactaagttgcatggctaaaatggcaagttttaagttttacagatagagacaaatcttcataataaaaaaagagagaatatatttaaatatatctgattttagcaacatattagaatacactggctcagaccctattcctgctacaaggacgtaagattctaggtgaaatataagaaggaaattttaaatgaaaaggtaagcttgatggagaaaagaagacagcatgcgctagaaaggagatcaaaaaagacacagaggcagggtacggtggctcatgcctgccatcccagcacttcgggaggccgaggtgggcggattgcctgagct

SEQ ID NO: 212718 - DNA, 199 bp, Homo sapiens
attgaccttgcatccgctgttgcctctcctgttctttgttattgggggtttattccttttacatttggacgtggatccaggtgggcacagaaatcaacctgccatgtcaaaccagagtccacaaaggattttactagcatggggtggggcttacactacaatgttaggagaaaaatgccatgtgaagaatatgctaagt

SEQ ID NO: 212719 - DNA, 311 bp, Homo sapiens
catcatgagtcttcctgctcctgaacagggtgtatctttccatttactcaagtcttctttatgtcttcaagacagtctgactttctgcataaaggtcacaggcatgacgttacctttcattttttgtaattttaagtaatatcttttttaaaacctgttgctggcaaaaaaagaaagaatgccagtgggctgggcacggtccctcacgcctgtaatcccagcactttgggaggcggaggccgagacgggcggatcacgaggtcaggagatcaagaccatcccagccaacatggtgaaaccctgtctctact

SEQ ID NO: 212720 - DNA, 352 bp, Homo sapiens
agtgacccaggaccaacagaatgaggttaaaagccacagacaccaggcaaagagaggtgtattctggaggccacagtgatggtgacaaccccaccccacagtccatcagagaaagcaccgagggatatccaggcaaaaggaagctgctgcgtttgattcacagatactcctcagtcgaagggctagaacctctcatgttctgtctctctccagaagtcaggggtttagagcatcagtggatcctgggaagagctaagactaagacacgtgggaccaggctctggcggtccagggcggaatctgctgcagggctgactctagggatggctcaccacagcatcaatccctgtgc

SEQ ID NO: 212721 - DNA, 332 bp, Homo sapiens
taattatccttgttcacaaagtcaccacaagaagccaaagactcccactcaggtgttcaatatccaaagcatcctacaccctcacacaactttttataccctaatctcttaattcctcaaattcttcttttgtataccttggaactcacggttagcatctgtgaaatcctccatctctttaacttcctctaaaaatttcacaccttctcaatgtttctcaacaagaggcactcatggcatttgagggagaactcgtcattgtgggggacactcactatcacaatcctactcccaccactctaccatgccaatatcttttttttttttttttt

SEQ ID NO: 212722 - DNA, 346 bp, Homo sapiens
cgttttgatggtgtgttttagcaggatttcttgggttgcaaggaacagaaactctcatttaaattggtttaggcaggagagaattaattggctcttggaactgaagtccggcagtaattaggtaatttcaggtatggctggatctaggtgttcaaaccaagaaaccaagtctttcttttcctacacaggcccttccctagtctctcacatcaaaacgcgttttgatgtgagagaatagtcacttttctaattagtgtgctgaaacatacaatattgtatttagtttcagtagtcctattagtatatacagaggtcttgtgccctcctccccctgaaaaaaaaaaag

SEQ ID NO: 212723 - DNA, 512 bp, Homo sapiens
tgagaaacagcaaagaagcttgcatctgccctgctcctagtggaggcagggaaggaggtacctatgagaatcaaaactccaggcttacaccaggtaggggtatagaatccacatccacactccctgtacggttccataacccagcccaagacattaacatctgaactaacccaggacacttgttaaactgaatggtgactggaggaagctgagtgaagtttatataggaggacctctctgtactagttttgcaacttcctatgatttataggaatttaatttataattattttaaaataaaaaagtttaaaaaactgtatagtaggcacatgacagttggttatctaattctctaaatgtatatatatcacatatttttattttaatataatagttaaatgtataaatcaatgcataaataccactaatacaatacagaattattctgtaattttgtttgtttttgttttgttttgttttgtttttttgagacagagtctcgctctgtcgcc

SEQ ID NO: 212724 - DNA, 830 bp, Homo sapiens
caaaatctaccttccatcctttggtcctaatttgtcctagggaatgccacaaaataagcaaaacccatctcctctccaatagatggactttcagatatttggcaatggctatcatgtctccataaatctttcttcctctagattttccattccagtctttttttctttgagatagtttccagaccttgatactatcccattggcttctggacattttccagtttatcaatatgtttaaagtgtggcactcagaaatgaccacaacactccaccctttttctacatttcattctcagtttctataaattgttgtgttagagttctctgactaaaaagtaatttcggaatacttcccagttcagtgtgactgtactctgaatcctatcctatgattatgcagaaggagcaggactgaaataataaaaaagaaagaaaaataataatgaaaaaattaagattatatgagagacactcaattatctatccctccatcttttaatttctaaggttatatagatggataaagctttccagatcaatttctcatccagcctcctgcaattattaaaacattagtagaactttttaccaaacattgaaaaaaaaatgagagagcttctctactgatggggaaggcaaaggattctctgtagcttggacaaggaatttgaagaatctcttgtcctataccattttctactctttgtcccagtcgttggtaccagtttttctggcttttgatcaacattagagctgagttagacaaggtcaagctgcatgcagattgattggcctctcaactgagaggcaccccacaagatgatagtgaa

SEQ ID NO: 212725 - DNA, 360 bp, Homo sapiens
agacagatatattcatcagtgaaagagaatgtagatcccagaaatagacccttgcatgtatggcaaattattttaaataagggagctaggactaccactggggaaaggatagtttatttaacaaatggtggtgggaaaactggatatctacatgcaaaagataaagttgggcccttactttataccatatacaaaaattaactcgagatggattaaagatataagtaagactttaaactctataatgcctacagaaaatgtaatatttaaactataaaactaatagaaaaatgtcaggacacattggatttggcaacaatttcttgaatatgacaccagaagcacaggaaactgaaagca

SEQ ID NO: 212726 - DNA, 132 bp, Homo sapiens
cctcccaaagtgctcagattacaggcgtaagccaccgcgcctggcgagaaaccaatattacatcaaaactcaccacagtgcgcaagctgaacgtgtaatcaaattgtagtactcaaactcattgcaaggact

SEQ ID NO: 212727 - DNA, 434 bp, Homo sapiens
aattagaggaaacttggatggttctggctccagtaaataatagactggtttgagaactgtacttccatgtataattttgtggttagtcacttaatgtctatcatgataaataacatacctgcacaggatttctggcaccccagtaaatctcaaacaagtgcccaaatgctagtttattatggttcctcaaatagcatgtatttatttgccaaatcaatgatccagtagcttcctgcccccacttttattgcctttttagaaatttgaaacaagtagcttgcccacatatacatttctcaaattttggtctactgctggttcatacaacaggttagcttttccaagtgactccaggagtgagttaaaaaccacctcagagatgtcctgagtatttgattctctgtctctaaaacatcacctaacctggtagatgc

SEQ ID NO: 212728 - DNA, 512 bp, Homo sapiens
aggagatgtgatggtatagtatagttccccttctagtctgagtccaaaggcctaaaaaccaagagagagagtgatttaagttccagtccaagttcaaatccaacaacaggagaaagccagtgtctcagcttgaggacgggaagagagagacagaattatctcttactctgcatttttgttttattcaggccacaatggattggatgaggcctgtctcagttcattttgtattgctatagcaaatactacggactggatcatttatggagaaaaagaagcatatttgtcttacgggtctggagggctgggaagtttaagaacttgacaactggcatccgtttagggcctttgtactgggtcgttccatggaagaaggtagaaggcagaagggcaagcaaacaagcttgtgagacagaggaaatcaggttgaattcttttattttattttagttattgagattgcgccactgtactcctgggcaacagcgagactccgtctcaaaaaaaaaaaa

SEQ ID NO: 212729 - DNA, 557 bp, Homo sapiens
gttgtataggatggtgctttgtgaactgtaaagtgatacttacacagtaaggttgaacaggcactacacaggtacaccatgcagagaacggagtgctttggaagtatctgagaaatggtgagtcactggctggagaaacgggtttatgggggaggaattatttcacaagttgtggcgtggtggtggaagactgaaggcttaaatgacaaaaagagacttttttttgtaaggcaaaaggagtctgtgacatttcctgagttggctaaaagacataatgtggcaggagctttaggaagatcaaatgagcaactggacctaatttcaatttcagcagtcacagacttcccatttaccgagggcttacaagctcctcttactgtgttcagaagtttatagatattacctcaattaatccctaacaacccttaaaggttcacattactactctgttacaaatgtgagagtggaggcttacagttaacaaacttattatccaaagccagggaaattaagatgaggaatatccaagactattatacaataaaacgggatacgtg

SEQ ID NO: 212730 - DNA, 294 bp, Homo sapiens
ttacaagtgtgagccaccgcgcccggcctaaagtggctttttattcatgtttgtttaaagttctttattttgaagcctaagtctacaacaacaaagttatgctagtgaaaacattatatttgagaaatacgaagtaattccgccagtgtaaacgaattcatcattgtaactttcctggctaaaaagcatctgaagacagtcttcagagaccctgatgccctaatgggaaattgcccaccagcagctggaggggttcacctgtgagccccctttccccttaggcgctctgtccta

SEQ ID NO: 212731 - DNA, 453 bp, Homo sapiens
caatatagaaaaataatgccgggtaaaaataggattgattctatatcaaataggaatttgtttcctttactgccttcctttttgcaatgtctgtgcaggtcttcccacaccttggctagttcagtagatatattcagtttagatatattttagttcgtcacctctgaagctcagacaaatttccaggccaagttttgaaaaataatttaggagaaacttgcagatattttgaggacgcggcgtgtaacctcccatggcaccgagacaagcgacattctgtttggtgcaagtggcgaaaaacacgacctaaccgtgtttacatgtgtattcagccatgaaattgagtattatcaacgttgaaaaaatgcaaatcaaattaaaacaagagaaaattgtctttggaattacagcggcctggagcccccaagtgtttgcttaaattgaatcatttag

SEQ ID NO: 212732 - DNA, 298 bp, Homo sapiens
agaagatgagtgagtcctacactagtgaaatcagagaactgataagttaatgtctgcgagaatattatcagttcagataggagtgaagttagcacaacagatagaaatcttaggattactgttctgtattactcaaattgttagtttaaaatactggagaaaaactgctcaatttgagctagtcaacagggctagacagacaacaaaatcctattttactaagtaacaaatggccactcactcttgctccatttccactgcactccagcctggtgacctagtgagactccatctcaaa

SEQ ID NO: 212733 - DNA, 111 bp, Homo sapiens
tgttctatatattcaacacaatctcaattaaatttccagcaagttgttttgtggataacaaattatccctaaagtttatatgaaataggaaaagacctagaataaccaaca

SEQ ID NO: 212734 - DNA, 295 bp, Homo sapiens
tctgtaggctgagctttcttcaaatggattgtaggggcaagtgtgattctggaaatcccgtcaaaggcagtgttaattcctccaccttaattgagcttcacacgcttggtaaattataactaccccttttaattatttttgtatatatttttggagattaaaaggagtggcataattaatataaagattgcttctcttctgaaaggtgcggattctgtctggactagtgaaataatgaagctggaatgctgaaaatggctctgggcacaaatgccgactcaaggtacatacacca

SEQ ID NO: 212735 - DNA, 450 bp, Homo sapiens
ttttgtgtttttaaatctattttagtggcagaaaggcgagtgggagagaaggcttcttcaggaggtacatgagaaaattaccatcaataattatttgccttgctgggagaatcaacaaaagatatctaggcaattggggatttaatattgaatcattgaactgcatgttgaatattgaataattcaatattgaattattcaatattgggaggccgaggtgggcgatcacttgaggtcaggagtacttcaagaccagcctggccaaggtggtgaaacctggtctctactaaaaatacaaaaattagccggacgtggtggcacacacctgtaatcccagctactcgggaggctgaggcagaagaatcgcttgaacccaggaggtggatgttgtagtgagccgagatcgcaccactgtactccagcctgagccacggaggaagactccgtctc

SEQ ID NO: 212736 - DNA, 209 bp, Homo sapiens
ccccgcacaatcccgggccctggggaaaggaaacacgcacttccttgcagtttcagtgaaactcctctggcacgcgggatagagtctgactcggtggctggcgcccatggcttatcggtctcaagggagcttggttctcagattctgaagctgagagcgggagggtgaagctggtttggctctttcctagaatttctctatggctctgg

SEQ ID NO: 212737 - DNA, 485 bp, Homo sapiens
actgcctaggttggtatgaggattaaatgaggtaattgatgtgaacgtgcttcctgcagatgtttttttatagccctttacaaataccatataagaagcctaatctagctgtagaattgagcccacaattggtttttgagccataatatcaaacactcagtctttccctaggtgatatttttccattctctgtttttgataaggtctctagtttgtaaggtcacttggaattcgagtcctttgtgcccagagtgttggctgcaccactaactcacctcctataagttagtacagacactcttcattggtcatgtgctacctggcaggcactgagctagacaccactgacaaaatgatggataagaaacttactgggcaggacacagtggctcatgcctgtaatcccagcactttggaaggctgaggcgggtggttcacctgaggtcgggagtttgagaccagcctgatcaacatggagaaacccc

SEQ ID NO: 212738 - DNA, 159 bp, Homo sapiens
tctcttagagagttaatgtttgaacaactattctgatattatatttaccttccatagcactcttgcctattaactatgctgaatatatatccccacattaaaatatgcaaaaagaaactactagattttttagaattacacccctatccggccacgtgt

SEQ ID NO: 212739 - DNA, 277 bp, Homo sapiens
tgacaccctcatgacagtgagcacacctaacacccagatcttgttttctaaaaactattctccacagaaaggcacccggcttctaggaaaagaacttactccacagctgggcctttactgtggggaagcctggcagtcacagtcttaaccaagtgataaagatcacatcacctgaagggaccacaaaacccatcatggacctcctgatacgacataccaagggcacatctcttccatggttcctggcaaaatcatcaggaaacactggacaaacaca

SEQ ID NO: 212740 - DNA, 366 bp, Homo sapiens
gctggactcagtgcctgtgtgtcagagcaccaagcccttgaggccctgtccccagtgctatgtaagacctgtccccagtgcgatgtaagaccctgtcccctctctttgctgtatctcaggttataaccactcataggttcctcccttgcttaatcaggccactaaccaggaatgattgagtgaaacattaagatgccaatggacagctgagcaaatgacataagctaatggaaatatgttaaatctcccttgtaatctaacacaaattaaaataataaaactatcattttcacctgccatataataataacagaaaaattaaataataatagagatttctgggtctacatgatgagataatcacat

SEQ ID NO: 212741 - DNA, 337 bp, Homo sapiens
cagtgtaaggatagaaaaattgcacataggaattgcaaatttaaattagtcatccattatttcttttgactcaaccaacattattgaatatcacttatatgccaggccttgagaaaaaaaaaaattaccaggcacggcctgccagcctatgggagatctaagggagggaagggtttaagcacagctcccctccccctctcctcatagaagaggagaaacattatgattctatggcagttgatggtgggctggagagggcagtttagagcagaaaaggggctaaggtaaaagaagccgagagagatttctaagttaaagcaaaataatgctcacagta

SEQ ID NO: 212742 - DNA, 336 bp, Homo sapiens
tggaaagctcacacatcccaatttcaaaatttactacaaagctacagtaagcaagaaagtgaattactggcataaggatagagattacatcaatggaatagaatgagagtctagaaataaaccttcacatttacggccaaccaattttttttgttttgaggcagggtctctctctatagcccaggctggagtgcagaggtgtgatcatggttcactgaagcctcaacctcccaggctcagcctcctgagtaggtgagactatgggtgcacatcaccatgtatggctaatttttaatctttttgtagagatggagtctcactttgttgcccaggctt

SEQ ID NO: 212743 - DNA, 472 bp, Homo sapiens
aggagtgtaaattgctggtcatattgtctctgttttataatacattttgaggaactgccaaactgctttccaatgtgacttcaccactttaaaatcccacagcaatatatgataattacaatttctccatatcctcaccaacatttgttatcatctgttttttttatctgagccgtcctagtgagtataaagtggtatctcattatagttttgattagcatttcccttctggctaatgatgctgagtatcttttcatgtgtttcttagccatttgcatatttttccttgaaaacagtctattaagatatttttccttatttttgaatgggttatttgttttttcactactgaattgtaagagtagtttctttatgctaaatacaagagctgtatcagttatatgttttgcaattgttttcccttttactggattgttataataaagagtctgactccattattgatgtgtga

SEQ ID NO: 212744 - DNA, 154 bp, Homo sapiens
accagaaccaaaattaaaatacactaacgaaaatgtgaagtaaatgtgagaagtagcattattaattttaatacataaagccatcataataaaaatcaacgttctcttaagtgaacaggcaaaacaggtgtggatatacaaggaaaatgaaaca

SEQ ID NO: 212745 - DNA, 204 bp, Homo sapiens
gaaatggtgacaaggaaatctgggggaaagatatgcagatgaaactctcagaacaggcacagactgtgaagatatttgtgtcccatgtgaataatcatttgcattcactgtagaggaggctcttaataagcaagttgacaaaatgacgtacttcatgaatataaatgttagacactttccatagctacaagagtgcttgctcaa

SEQ ID NO: 212746 - DNA, 239 bp, Homo sapiens
gggagtggggagacacactgggcaaagaattttggcctttcccctttagacagtggggaggcctgatttataaactgtaatacaatcaccattcctcaagcctggggaggggcaccagctgggaatagtttccactctgggcccccagcaggtgcaagtcttctcagtgactctgtgctcaggcagtggagaagggaaaaagtaggggcagccccctacttttcccctgccccaggcat

SEQ ID NO: 212747 - DNA, 418 bp, Homo sapiens
ctagttttcccagcaccatttattaaatagagtttccttttcccaatttatgtttttgtatgctttgttgaagatcaactgtttataagcatttgactttatttctgggttctctattctgttcccttagtctatctgcctccttttgaaagtaccatgttgttttggtaactacagccttgtagtataacttaaagtccagtaatgtgatgtctccagatttgttctttttgtttaggatcgctttagttatttgggggcttttttggttccatatgaattttaggattgtttttgctaattctgtgaaaaatgattttggtattttgatgggaattgcattgaatctgtacattgctttgggcagtatgatcattttcacagtattgattattccaatccattagcatggaatgtg

SEQ ID NO: 212748 - DNA, 397 bp, Homo sapiens
ttaacaaaccagttcccactagatacttattaacttattctccccacttattcatctgggatgcttcaacgagttactttgtttaatcccatcactatatacaagtgacagccaaacttctagatgaagggggcagctgatactgtgggacatctggaatgtacagctctgttcaagccccgaggaaaaatgacaatcctaccacaggagcattctttgtactttagggcaaatattcaggcccaggaacagaaggaaggaaaacaacgctttcttggttcactggctatgctaatctaccagaacctattaaataaagttaaactgaaaaaggagtataaaatagccaacccatgtcacatacatttgtttgatcatcaaaagcatctaggtgtat

SEQ ID NO: 212749 - DNA, 302 bp, Homo sapiens
tcggttcactcttctgcatgttttaaaacagtatcacaaaggtcagagagtcatagaacccgtgatcctggaatgagaggactggaggaggcctttgagaccattgattctcttgtttagtagaaacctaagctctcaagaatccagtgacttgctaacaaccccctccccccgcataagttagagacacagcagggccaaaacctgtatctaatttttcagccagtgttcactacagagtatcctatatctccagtctttgtgaagttatttttcagtcctttacttagcttccggtcgaa

SEQ ID NO: 212750 - DNA, 309 bp, Homo sapiens
gtgcgaaccccgtgaaagcacaccctcttctggggttccaggatgcttctatgaagcaacgtcttaggaaatggctctctccttgtaaatggtcaacccctttctccacacaaactgtcgtgtctcttcacactggttccctggggtgggatgacaaaggattctcttgttcatactaaagtgaagacagttttctacattttaaaattttgtccagtgggcgttataaccttcacagctgactatacgggtagttcactgtgagagagtgtagaaatggtaaataagagaaatctctttttctagaga

SEQ ID NO: 212751 - DNA, 770 bp, Homo sapiens
gtcacaaaagaggttagttccatgcttattttaaagactttgaaggaaatatgcagtagtagaatctgtcattaagatgtgaaagctatataaagagatcccaaagaatttcctgagtttttttctccattttaatgttacctcatttcgattttcactatcacaaccaagcctgcttgctgtctttctcttcctttgcccttcatccttagggacttcttttctctctcagcctttgaaggtggtatcatttcaggaggagagaatattgatgccctgaaaatatcaaaactaaatcaggaaacaattagtaaacagttgtataagctgtgtttgtataatgctatggaaaaagcaattgcatttctttgctggcatctttgtgagacaggagcattaacccaatttgacaaatgaggacagtgaagatcagagagtttaaattacttaaggaaagtcacacagtagaataaccaacagtagaaaatagtgtctactttaagctttgttaagacttcttaaatgatagcactcatctaacggatatttatggagacatagactaatggaatagaataaatagagttgatacagtcactgacttacaggtaacattgaagtgcagtagtgaaagaatgggctttttaataaatggggctttatcaattgtatggccatatgggaaaaaagtgaatttgaatccccatcttataccatacacaaaaaattaatttgagatggataagagacctaaatatacaaggtaaata

SEQ ID NO: 212752 - DNA, 319 bp, Homo sapiens
tgaaagacattaatctacacatacaaaaagctcaatgaattgtaagtagggtcaactcaaagagacactcagtgtgacattgaaacacattataatcatactgtccaaaagcaaagcaaatcctgaaagcagaaagagccactggacacgtacaagaaatcttcgataagattaatagccaatttctcatccaacatcatggaagtgagaaggcaatgagatgacatattcagtgtgctgaaaggaaaatcttgggtggtcttgatacttgtagatgttcatctgtgtctgagcattgaagagttaggtatttatcata

SEQ ID NO: 212753 - DNA, 609 bp, Homo sapiens
ttcttttaatactttatactagacttttagaccactatgattgtgataaactaagtggcccagttcaaacaaggaaatgattactgtaaggtgtcaaaggaattcctttttaataaaacagatcccaaaataaacatcttacaaagtattcagtgtagtgaaaatgttgtttatagaccctagaaatgacattagtatttaacaagcaggctttgataatagtagtatctaatattgcgtgtgtcatttaaggatggggatacactcttaagaaacatgttaataggcaattttgccattgtgcaaacgtcatagagtatacttacacaaacctaggtggtatagcctactacacacctaggctctgtggtgtagcctgttgctcctgggttacaaacctatacagcatgtagtaacatgctgaataatatagtcaatactgtaacacagtggttacctattcgtgtgtctaaacagaaaaggtacagcaaaaataaagtgttataatcttatgagactatcatctatgcattggtcaccatcatcatctattgtggaccagaacactgatatgcagcacatgactgtaaagactgtaaatgctattgt

SEQ ID NO: 212754 - DNA, 343 bp, Homo sapiens
agttgggcagagggctgcaggaggggctggaatggggcctgttcctcttgctgttaacgctctgtgagcaaacagagcccttgaaatgtcccttgctcttgcctccggcataatatgcagtgggccactgggccctggcagctcttgagtgtgtgccctggggagccatggggccattggactgtacttcgtcctggttcatgtgtcagtaagaaagtaaaccaggctgggtgccatggctcacacctgtaatcccagcactttgggaggctgaggcaggtggatcacttgagcccaggagttcaagaccagcctgggcaacatggtgaaaccccatgtctac

SEQ ID NO: 212755 - DNA, 166 bp, Homo sapiens
tcttaagacacttcaacaagacaattagatctctgtccccgtgggatcatgcattctaatggaggagcagacaaaaaataagtaaacctatttcaagttgtagcaaggcgataaagggtataatgagccaagatataaaacacaggagagaggcaactttacatag

SEQ ID NO: 212756 - DNA, 356 bp, Homo sapiens
aagtttgataaatattatacatttaatataatgtattaaattatatctcttcctcaagaaaccacaaatagtgctcccatgtgatccagagttcccactactgggcatctatccacacgaaaggatatcagtacattgaagagacatctgcacccaccatgtttattgcaggactgttcacactagcaaagagatggaatcagtggtgttcagcaacagataagtggataaggaaaaggtgccatatatacacaatggaatactattcagccataaaaaaacatggaatcttgtcattggtggcagcatggatggaactgcaggacattatattaagtgaaataagccaggcacag

SEQ ID NO: 212757 - DNA, 1253 bp, Homo sapiens
agattaatcatgagtttgtaggagttgaatgctttgattcattaatttcatctagccattaattcccagggaaacaaatctacaagaaggatattgctattatgacttgtgtttttttctcatctttggatttttaatggtgaaaaaaattaaaaacaaaatattcatgagctatattagtaatacattagttatcaacccataatatactcctcagctattactaataaccagacatattttattcagtgctttgggtatttaggacatgttctatggttactgggctttaacatggttttctacatgaaggtattggagaaacaggacatactaaaattacttgatttagacacaataatccttttaaaaatataatgccatttttattctccagggtgtaaccacaaaaccgagtgaacgtcaccatttttattcagtaggcgtaaccacaaattcctgcgaatgcattagagtgattccacagactgaaaggttaccctcacagtttctaccacctttgttggatcaagccagtgtggttgctttttaatgaatgtaattctgtaagattttaacctatactgtaccgtaagactgtcccaattaaataattgccatactccagtgtacctggcatgattttggtatggctgctcacctgatcctactctaaagatataacaggacttgaaatttcaagctctagtattcagctcagtgacttcaacaattctttcaagccatcaaactattgaggaaggcaatgtgttcaccctggaggctgtttccagattcctaaatgtacagtgatttcagcattctgtctgggaataagatccatccttccttcagcgcaatcaaccgatttctacctgaatttactctaatatcttttcttattacaagataactatttagattctgctttatgtttagtccgtatttctttaaccctaaaaagattatgaatttgacatgtcattgatctctctaataagcgaataccaacccacaaaccactcatccttttaaaaatatttcatgggcatcggtgccataactaataaatttttaagagtaccaactggtctttaattattttatgcttttaatcctgaaacagtattagttttcattcgagtggcttatttattatagtggcattagagtgattgtattcaaatagcaatttttcttcatgttttctgctaaaaggattatcaacattaaagagatttcctctttccaaa

SEQ ID NO: 212758 - DNA, 180 bp, Homo sapiens
ctgttggggttgacattcactgatccattagtctattactctgtcactaagatcagacagttgtattctgcatctgtgaataataacagctcttgttattctaatttatttggtgtttactacaatccatacctgatgctttaatacatgctctcattttatcttcaaactctccaaggt

SEQ ID NO: 212759 - DNA, 248 bp, Homo sapiens
gaaaatgtgtattctttaatttttggatgcataattctactataagcttttaagtcatcttaattaaaaaaaaatctgttgtgttgaatacatttcatcttttggtttccgaaaggagtatattgcattttgtcagctcctctttgtatgccatgcatttttgctgtacatacttcaagttctgttctttaagttgatacatgtttatttcttaatatattaaaatttatttaatattttattaataa

SEQ ID NO: 212760 - DNA, 386 bp, Homo sapiens
taaaaaacttctgaaagtttttctttttctggaaaatgcagagaaaatgactgtgtgatagtgggcattgatgctatttgacccactagtttataactgtgcattcaaataaacagtgccatttggtttcttctagtaatgtaaaagcagcatcttttgttgtttcccttagcattcttcacatttttgttcttttctcaatataaatgtccatttcctcacattttatttttgagtaatgaccatagccacagtttctatgtactgttctttaaataacagttttaaagctttatgttttattgtccattgttgaaagttgattccggctgtctgcaaacatttttgtgtctgattagctcatctaaaacttcctaccagaaagg

SEQ ID NO: 212761 - DNA, 429 bp, Homo sapiens
aaaaatatcttggaagattacagaatacaagtcgttttaaggaatttggaaatattgaagaatgacattttaagatctacaaacaggcttttaagttagctgctggagtggttgcagaatattcttctttccaccacccactcccaattttaaggtaaagaaatcaggaaagtagtgtctgcaaataaattcatttttatttgacaaataattaagtgcctactatgtggcaggcccttttctagcactggagataaagtggtggattaaactaagtcataactcatggaattatattttggttatattttgggaggcagccactacctaaagaatagttttctttatctgtacttcctaattttcctatgataaattgtattgtttctgcaatttgtattttcatattaaatatagatataaatgcca

SEQ ID NO: 212762 - DNA, 311 bp, Homo sapiens
aaattagtgtggttactctaaattgctaacatgaaaatcttaacctcctacttctgaagttatttggttttagctactcaatttttttttctaggcttccaaggttgctgttttgggcatggttttagaaatataattataagtttgatttcaaacttctggaccatgtaatcaagcacagactggtcatagtggaaaatatacaatttttagctctgcctacattgacaaaaaaaaaaatggctggatccacatcaattcaacttgagtgccatgtgtttacagtgacagtttctccccgaaaacgcaaa

SEQ ID NO: 212763 - DNA, 312 bp, Homo sapiens
  misc_feature (14)..(15): n is a, c, g, or t
  misc_feature (26)..(26): n is a, c, g, or t
ttaagctgcccttnngtcgactctcnaggatccccgtcagcgccctgtagtcggcgccctcctgtgcttggtgcagcgtttcggggaggacatttgccggaactggcgcgcactatactccctgcgtgggaacatgcacctggggagagaagcagccgaccagctctcctggagctgttccccaaaggcagtgtggctggtgggggcacctcaggcaggtcggcagcaccccagttctgagctgctctcgctggctgtctggtggcagtgaagggcacacctctctgggctcaggcaactcaccctggaatg

SEQ ID NO: 212764 - DNA, 740 bp, Homo sapiens
gtgtcgttacccgcgaattcggccattatggccgggcgcagtggctcacgtctgtaatcccaaaactttgggaggctgaggcaggtggatcgcttgaggtcaggagttcgagatcagctggccaacagggcaaaatcctctctctactaaaaatacaaaaaaaattagctgggtgtggtggcatgtgtctataatcccagctactcaggaggctgaggcaggagaattgctggaacccaggaggaggaggttgcagtaggttgagatcacgccactccactccagcctgggcgacagggcaagtgagactctcaaaaccgcagccataaggaaaagtctaacgcccatcctggtttaaggtttatttcgtattcctctgttggagataagattaagcaaaatctaataatttattaacacaatcaaataaatttaaaatggcaattttgtacataatatcctaattttgaaaaggacagcatttccaatgtttcttcagtctccagaacctatattgaaatcaatgactggaataagacaataattgagatgcatttgatttatcaactaaaggttctccttgaaaggcacttttggaggcccatttaaagggcccagacaattattcctcacctttaaaccttggcaggattgcgccctaagtttattatcccaggaaacttccttgtactgcctggggggatccttttacaggttccgggtgattggttccagtctcg

SEQ ID NO: 212765 - DNA, 1280 bp, Homo sapiens
gtgtcgttacccgcgaattcggccattatggccgggcgcagtggctcacgtctgtaatcccaaaactttgggaggctgaggcaggtggatcgcttgaggtcaggagttcgagatcagctggccaacagggcaaaatcctctctctactaaaaatacaaaaaaaattagctgggtgtggtggcatgtgtctataatcccagctactcaggaggctgaggcaggagaattgctggaacccaggaggaggaggttgcagtaggttgagatcacgccactccactccagcctgggcgacagggcaagtgagactctcaaaaccgcagccataaggaaaagtctaacgcccatcctggtttaaggtttatttcgtattcctctgttggagataagattaagcaaaatctaataatttattaacacaatcaaataaatttaaaatggcaattttgtacataatatcctaattttgaaaaggacagcatttccaatgtttcttcagtctccagaacctatattgaaatcaatgactggaataagacaataattgagatgcatttgatttatcaactaaaggttctccttgaaaaggacactactgaagtccattttaattgtctaaacaaaacaattattctggactttaaaacttggcagcaatagtaactaagattatatttccaagaaactacatttactgcctaaatgtggaatcctattacaagttacaggtgaattggatccagcaatcttaggactgaagtaggtctgagaagtcatcccctgcctctttattcctgaagaacccaatctgttttcaaagctcatctattaaagaataatgctattccctcggcatccaatttaaatgtttaacctaattacaagcagtttacaaactgggcatagtggcatgccagctactcggaagcttcatcggaagattcccaaaactcaaaatctccaggcctcagggatggtccgtaatccacgtttctcagagcgttgatccggaaaagactgcaccatgcctcaggtttcaataaccgtgaccacctcgttcacactggtccacacggatcctctcaacaacaaatacacacatctcgccgcttgccccgtacttaactgcgcatttacaacggctcaattccttctgtcaactcctctatagcgtatatctcacggcgcctttcatcgtgcttcgaaaccgggtccccctaagcgcggcagacccttctcagacggttgaccccctcctctctacactggtcctagcgccc

SEQ ID NO: 212766 - DNA, 1339 bp, Homo sapiens
gtgtcgttacccgcgaattcggccattatggccgggcgcagtggctcacgtctgtaatcccaaaactttgggaggctgaggcaggtggatcgcttgaggtcaggagttcgagatcagctggccaacagggcaaaatcctctctctactaaaaatacaaaaaaaattagctgggtgtggtggcatgtgtctataatcccagctactcaggaggctgaggcaggagaattgctggaacccaggaggaggaggttgcagtaggttgagatcacgccactccactccagcctgggcgacagggcaagtgagactctcaaaaaaaaaaaaagttccttttaagcttcaagattctaggttaaggaattaaaaatctatgtgccgcagccataaggaaaagtctaacgcccatcctggtttaaggtttatttcgtattcctctgttggagataagattaagcaaaatctaataatttattaacacaatcaaataaatttaaaatggcaattttgtacataatatcctaattttgaaaaggacagcatttccaatgtttcttcagtctccagaacctatattgaaatcaatgactggaataagacaataattgagatgcatttgatttatcaactaaaggttctccttgaaaaggacactactgaagtccattttaattgtctaaacaaaacaattattctggactttaaaacttggcagcaatagtaactaagattatatttccaagaaactacatttactgcctaaatgtggaatcctattacaagttacaggtgaattggatccagcaatcttaggactgaagtaggtctgagaagtcatcccctgcctctttattcctgaagaacccaatctgttttcaaagctcatctattaaagaataatgctattccctcggcatccaatttaaatgtttaacctaattacaagcagtttacaaactgggcatagtggcatgccagctactcggaagcttcatcggaagattcccaaaactcaaaatctccaggcctcagggatggtccgtaatccacgtttctcagagcgttgatccggaaaagactgcaccatgcctcaggtttcaataaccgtgaccacctcgttcacactggtccacacggatcctctcaacaacaaatacacacatctcgccgcttgccccgtacttaactgcgcatttacaacggctcaattccttctgtcaactcctctatagcgtatatctcacggcgcctttcatcgtgcttcgaaaccgggtccccctaagcgcggcagacccttctcagacggttgaccccctcctctctacactggtcctagcgccc

SEQ ID NO: 212767 - DNA, 479 bp, Homo sapiens
tgtgaatgaatgagccttcagatgattctagcctccagctgccaagctactcctaagcttcaagtcttcctgaaaccagtaaaggacagccactgcatttttgtctaaattcctgacccccagaatctctccttccaacaataagtggagtccatcgtccaccccttaaatctaggccaagaatgagacagaagtgaaggtgtgcctgttctgagcctaggcctgaagaggccttgtgcacttctgctcttgcctcctccttgagcttgggctaggctgatggagaattattgacctacacatgcttatcgctaattagtcatgtgaaagagatctgcctggattatcagaggtacctacttaatctgcagctgaccacaggtgtatgactgagtgagcccatctaagaccccacacacccaaaacactcagatgacttacagattcatgcaaaataataaatgcttattgttttaagc

SEQ ID NO: 212768 - DNA, 125 bp, Homo sapiens
agaatgccccccagcctgcccctcttcccctgcccttctgtttctgcccttgccacctcatgcctcagactgacactagcttcttcactgacctctctgctgcagggctgtcccctctgaccctc

SEQ ID NO: 212769 - DNA, 397 bp, Homo sapiens
aagaaagtatgggttgaaattttaaagctttcctaattgccagcatggttcactccatttgattttagtattaggtctctttaacttaagcaagttaagtccaagtttaagcgacagactaagcctggagtcaagtgtcatagcctgatgtacacactgatgtaggcactccttttatctcaagttttacatgaagtgctcctgagttggcttaaaatcacttgtgtggccggatgtggtggctcacgcctgtaatctcagcactttgggagggcaaggcaggtggatcacttgagtccaggagtttgagaccagcctggccaacatggtgaaaccccatctctactaaaaatacaaaataaaaataaaaatacaaaaattagctgggcatggtggc

SEQ ID NO: 212770 - DNA, 514 bp, Homo sapiens
actttaggatggtgatggtgcgaaagcaatatgcatccggtagacctgagttcgtatgcattcagtagacttcagattttgatttttccccaggctaacgatatgcagtatgatagtctcttgtaacgcagggcagcagcagtgagcccagctcccggtcagccctgtgatcacgaggataaatagcccatattccacagtgtgctgtattgacagatgactttgcccaactgtaggctaatgtcagtgttctgagcacatttaggctaggccaaatgatgatgtttctgtaggttgagggtattacccattttcaacttaggatattttcaacttacgaagggtttattgggatgtaactattgtaagttgaggaacatctgtacttaccttgctggtttgctttgaggattacatgagatgagataatgtatttccaagtgctgggtaaactctcaaatgccatacaaatggttcttactattaacacaattatagtctgcactgaacaatt

SEQ ID NO: 212771 - DNA, 316 bp, Homo sapiens
aaatgctaagacaattttagaatttaaggaattgaatatacagcattttcatgactagtccctcatgttcatttacgtgccaggatctcacatcctttgcagaaggaaaggtacattcctagggataaaataagtgcatgttacttggacaacatttttgctttctgtttgctaaataaaaatcccttttaaaaattcagtattgccacactttgccatattaaaaatgttttagattactatattatcctgaaactacatgtacacacacacccctaaaataagttttatggtatttcatatgcctgtacaggag

SEQ ID NO: 212772 - DNA, 321 bp, Homo sapiens
gtctcagaaaagcttcccttcccttaaagtttggtccattcaagggcaggagatggcagagtggaatttccatgtctctgcaggaacttcagccctgcagataggtcactcaggggctctgttctcaggaccagagggtgctcagaatccctgtcccagctcccacgtggcagatggggatactgaggaccagagcctggcacaaggtcaccaggtgattacaaatggggtctttcgctggaatctcaagaaaggtggcggaaagagggtgggtttggaggcagtcccaagtttgaatctcagttccactgtctctaagct

SEQ ID NO: 212773 - DNA, 532 bp, Homo sapiens
tccccttttgaaaatccctaataaaaacttgctggtttttgtggcttgtgaggcatcacggatcctaccaatgtgtgatgtctcccccggacgcccagctttaaaatttctctcttttgtactctgtccttctatttctcaagccagccaatgcttaggaatatagaaaagaacctacgtgattatcggggcaggccccccgatacgtacagctacttaggaggccgaggcaggaggattacatgaacctgggaggcaaaggatgcactgagttgagatcatgagatcacgccaaggcactctagcctgggcaagaaggtgagaccctgtctcaaaaaaaaaaaaaaaaggaaagaaagaaagcacccaagtaaaattagctgggcatggtggtgcatgcctgtagtcccagctattcaggaggctgaggcgggagaatcacttgagtccagaaggctaaggatgcagtgagccatgactgtgccactgtactccagcctgggcaacagaagatcctgtctccaaaaaaaaa

SEQ ID NO: 212774 - DNA, 191 bp, Homo sapiens
atccagatgatggtaactattgaaatgagagactcaaaagaagctggaaactgcattttttgttgtcccatgtggacacctgtgttcagttcctagttctacctcttgctgtctgtgtgttcttaggtaactgacttaaacctttctgagtctcattttcttcatttatgaaataaaagacataacactta

SEQ ID NO: 212775 - DNA, 488 bp, Homo sapiens
ttccagggcctgtggtctccagaacagggctgaaacctgttctgagttgacagtgctttcctaaggagaccccaagttgagaggaccctcttacccactcatcaataatcaaagcagacttgatgcccatcagagatgcccaatgattctggtgagccgttcctccctctggctgtcagtactggggagtatggtggggactttcagatagctcagtgaagctcagaaagagagggagttccccctgacacccgccccagtcagtaagccccggggcctgaggggcatccccactgctcgacctctccactctctcggggaggacgaggcagccttgacccacgagggctgatgaatgggtaggttatcggcaggctcctaggccaccagcttagaggtcacattgtcccttttagattcagtgtggcgggaatctaaaaggtcgaggatcgagaagcctgcaggatggcaaagtgagggaccccggc

SEQ ID NO: 212776 - DNA, 480 bp, Homo sapiens
ttaccctttaaagcatccatgtgtgacaatatgcatggagtattaacaacctgggaagctctttcaagcttcagtgtccagagttgtattggggcatcattacatagacatgattgatggatttattttccatgtgactgaactcagtctctgctgcccccttcccaggagtcagctgatatgtgacccaagggactgaccatgagtcacctctttagcccaaactataaggtatggtctgaggagtccatcatgaataacaaaaacactcctatcacttgggagagtctaagcgtttagaggttacctccctggagccaaggacaaaggccagacctttcttggccaaggctaaattctttacaacacatgaagaaactcagattataaactgccacggaaaaattacagcccatttaattttgattaattgaaaaggaaagtcaagataatctattagactaggtgctgcttatttag

SEQ ID NO: 212777 - DNA, 530 bp, Homo sapiens
ccgctctgggccaaattttcttaacctgttggcagatacactttctgtgaaatttcagaaattctttttaaaaatcttgtttgagtcaacagtgcttaccctcactgcttctattttgcattatattacatgaccaagacaccacaataaaggcaaagaagtaaaagtgaattatttgagggtaataagctgatgagttatttgtgggtgttattctatttagataaccccaaatctgtatacaagtttagcagaatcctagagtgttaagatcaaaatataatgattccattcttacctgccaagaacagaaaatataatttaataaattataaaaataaagcaactttaaataagtctataaaaattgagtaagaactttgaaaaaatgatcagactttatcaaaagatattgacaaagttaaataaacatagaagatacaatgaatgagaagaccaatattataaagcttttccccttaacccagagtttcacataatgccagtcaacatttcaacaggcgttgtta

SEQ ID NO: 212778 - DNA, 443 bp, Homo sapiens
cagttgcctttggccaagtggaaattctatgagtaaaaacatgtttgacattattaagctatctggcagaaactcttgaatatttaagggctgattttccagtgaagatttaaccacatgtacatatttgcactttaaaatgacatgttttctcggctgggcgcagtggctcacacctgtaatctcagcactttgggaggcctaggtgggtggatcacctgaggtcaggagtttgggaccagcctggctaacatagtgaaatcccgtctctactaaaaataaaaaactagctgggtggggtgtggtcacacctgtagtcccagctacttgggaggcttaggcaggagaatctcttgaacccaggaggcagaggttgcagtgaaccgagatcacaccactgcactcccgtctgggcgacagagtgagactccgtctcaaaaaaa

SEQ ID NO: 212779 - DNA, 410 bp, Homo sapiens
tgaccgagagctgggggtgagggagtcctgtgatcttggaggaaccagtatggagcggagccccgctcactggggtgggaggtcagggaggatgggcatcttatttcacgcaccacaggcccttgttcttcccagatgtcagcaggctttctccaataaatgcttcttcatttgctgttgcccttggaatcatcccagagattttaaacggctgtgtgtatgtttcatggggaagtctgtggcctccttacactgtcctgcagaactggcacctccggctgttttttgatgtgtgggggtgtgggcctgtgaggcaagagcttctgattttcaagagaaaatagagatctctatttttgtgtgaaacaccccctgtttaataagttttttaattcagtttttttgtttgg

SEQ ID NO: 212780 - DNA, 957 bp, Homo sapiens
attaattatgcaggagtttggctcctgagctaattatgtgttttacatttttctaggtagggattcagtatgatatgaggtagatgataaaacagcatggggaaaatttaaatttctacagagaacagaggagaaatacagataatttctcactagcatacctagggtatttgtggccactcttcatacttattctaatttagctggaatctaggattttttagctatactgccagaagcctccatggttttcttttttcctctctatgctttggtttagatagtttctattaactgttttttaaaacaaattagtaaattgtactgcattttagagcagttttaggtttacagaaaaaattgagcagcaagtacagaattccctacccgtagagttttcactattatcttgtatttgttaccactgatgaactcatatggttacactgttaacaactgagtacagtttacattaggtgccatgcttttctatgggttttagcaaatgcatttatatatctgccattttaatgtcagaatagttttactcccctgtgctccacccattcatccctctcttttcctccatccccaatcctctggcagccactgatcttttgactgtctctactgctttgctttttccagagtcttagatacttggaatcacacagtatgtagccttttcagacaagcagctttcacttagcagtatgcatttaagattcatggctttttaaggtttgatagctcatttcctttatcactaaataatactccattgtacagatgtatcacactttgttcattcacatcttggttgcttccagttttggaaggacatcttagttgcttccagttctggcaattataaacaaagctgctataaacatttgtgcatatttttgtggacaaaagttttttttaactcatttgagtaaagactaaggagtatga

SEQ ID NO: 212781 - DNA, 334 bp, Homo sapiens
aacagaaataatgtgaaaaagagatgaacagtcaattcataaaagaaaaaacctgaacaatcaagagacataccaaaagaaactcaatctcattagcaaacacttaagactggaaaaaaaattaagtctgaagtattctttttttttttttgaaaaagggacgggccttgcgaaaaaattgaacggattttaaccaggctattataaaaccccccaaagaaaattattgtgaaaaggaaatgaccggccatcctttaaaaaaaaaacccggaccactcaagagccttcccaagggaacctctttttttttggcacccttaaagagggaaaaaaa

SEQ ID NO: 212782 - DNA, 488 bp, Homo sapiens
tcaattaaaggtatcctttagatagttaagtctaaatgaaaggtcaatgattaaattaatggataaaagtccattgcacctacggaaaggtgcattggtctacagttcagctagtacctattttttgctaaagattaaattgcagctgggcggggtggctcatacctgtaatcccagcactttgaaaacctgatggaggccgggtgccgtggctcatgcctgtaaatcttagcactttgggaggccgaggtgggcggatcacttgaggtccggagttagagaccagcctgaccaacatggagaaaccctgtctctactaaaaatactaaattagccgggcatggtggcgcatgcctgtaatctcagctactggggaagctgaggtaggagaatcgcttgaacccgcgagttggaggttgcaatgagccaagatcatgccattgtactccagcctgggcaacaagagtgaaactcagtctcaaaaaaaa

SEQ ID NO: 212783 - DNA, 312 bp, Homo sapiens
agtcaggcccaactttttcaataatgacactgcaatccggtcatctgtgagatttgatggtttacttttcaggtgggagaaaggaatgttggtcagtttggctgaactggttgttgacttctggagagagccgaagctctgctagctcattggaactcttacccaggctaatttccctcggccagataaagagggaagccttatctgccttttaagtctttcagggttgggctgttttccccttaaagatgcctatgacagaatgggagcaagacatgtctttggcaacgaaataaatgaaaaatgatcaca

SEQ ID NO: 212784 - DNA, 348 bp, Homo sapiens
aataaagatcaaaagctactccaccaactgggcttttctgatgaacaaatccttacagtgaagacttctggcagtgggaccccatctgggagttcagcagattcttcaaccagctccagcagcagcagcagtggggtttttagttcttcatatgccatggagcaggagaaatccctccctggtgtagtgatggctctcgtatgtaacgtatttgacatgctttatcagctcgccaatctggaagagccaaggataactctacgagtacggaagcttctgctcttgatacccactgatccagccattcaggaagcccttgatcaacttgattctttaggaagaaaggta

SEQ ID NO: 212785 - DNA, 289 bp, Homo sapiens
agatactgttggctactgtcaattgagaagttaccttggtaaagagagaagccaaaactgtgggtatctgaccaagtgcattgacctggctcttgaatttgaagcacatacagtctttgctgcttggtttgcttggcaggttctgtgtttcatgaaggataggtaaacaaatgggttctctggctcaatttggatcattgttcatgctgatgattctcaaactgatgggcttcagaatcacatggggaacttgtttgacataatgtatttataaaaattcatcaccaga

SEQ ID NO: 212786 - DNA, 426 bp, Homo sapiens
cttaaaggccatcggtatttatatgccacaagtaaactaacattttttaatggtggggacaaatcatgtattcgtcatgctacttgtccacaaaacactgcactttaaaaactgatgatcgaatatcctacacaaacttttccaagaaaacagcaatgatttgttattgtggtcagatgcagtggctcacgcctgtaatcccagcaatttgggaggctgaggtgggtggatatctgaggtcaagagtttgagacaagcctggctaacacggtgaaaccccatctctactaaaaatacaaaaaattagccgggcctggtggtgggtgtctgtgatcccagttactcgggaggctgaggcaggagaatcgcttgaacccgggaggcggaggttgcagtgagccgagatcacaccactgcattctaacg

SEQ ID NO: 212787 - DNA, 459 bp, Homo sapiens
cctccagaaaaggggtccacctgggatcagggtgctcttggacactgttgacattaaaggtgctcattctttgctgcttggaaaaccaagaagttctgagagataaacagatggcttcggggcaagtcccagcaaaaagtgcaagaacctgggagcccacaacctattctgtgggaagaggagcattgttgcctctaagaacacatgcacatctgctgctaggctggccgagcccaggccgggctgccctgctctttgctcagtgcttcctgccaaaactaatctcagtggttcctttcagtgatgggtggactttggtggcttcatacagtctctgcagaatctagctggggagagggctgagtcagtttggaataaatgcatttgacagggctgagcctaaatgtaaaactttaaacgtgtataacatgcataaacctggaacttgtttctctaaca

SEQ ID NO: 212788 - DNA, 430 bp, Homo sapiens
ggtgtgaggcgcaggacagggcgccctggcccggcaggaagatgctgaacacagctcctgggagctggggagtccccggggagaggaaaagggaatcactctgttaaaggccctccgcgtgatggccatgtggttgccggtggcttgcgccattgtcactgagcagtgtggcaaactctccagcatggcgaccttgtgagggcaaggagtggcctccctgcacctcacacgctcatctctgtgcacatgtgtgttttcacgcacgggcacagcccctggtgtattcctgtactagtatctggcatctgaggctggtgcaccctgacctgggcctactgctgcccaggccacaagccttctccactatgatgagagaacaaggcttggtggcacccagcacctggctctcctggctccccgtcaccccccc

SEQ ID NO: 212789 - DNA, 368 bp, Homo sapiens
aagggttaaatattgctagaagggcatctcattatcaggctgcatgcatcatgcatgttgctagcttcccctacagcactcatctgctttcttaataaaggtactctcaagttaagggccttattcagtaacaggactccctgaccactccagagcaaatatccttcttctcctaccaacagtgagggagctagttttctgtacaggatgtatttctttttgtgtgtattcacacttgcaattattttcattccatgcactctgggattgaaatacaacttgggtaattgggaattggttgtgcattttctccaaacaaaaatcagtttagtctgtggtttgggttttctcctgcccaaaatcacaga

SEQ ID NO: 212790 - DNA, 358 bp, Homo sapiens
tagtctcagtatctgacgaggtcgtgtgagtctatgcatgtgggccgtcgttccactacggtcactgcactcgtgattactccagtagaggtactctcaagttaagggccttattcagtaacaggactccctgaccactccagagcaaatatccttcttctcctaccaacagtgagggagctagttttctgtacaggatgtatttctttttgtgtgtattcacacttgcaattattttcattccatgcactctgggattgaaatacaacttgggtaattgggaattggttgtgcattttctccaaacaaaaatcagtttagtctgtggtttgggttttctcctgcccaaaatcacaga

SEQ ID NO: 212791 - DNA, 265 bp, Homo sapiens
tatctgacattaggcttggggtcctatcagaatatcagttttacttttctagatttagcatgttcactagcttttgccattattggttatttctgtaggaaaaaaataattcagttcatccttttattaaaaaatgactcagcaactgcaatctgataggacattttctctaattttcatggagaatttttttaaactcttttatctccttttagaagttttttcttttcagaatttaatttttagttcttggttgcacatgtgg

SEQ ID NO: 212792 - DNA, 404 bp, Homo sapiens
tgcaactataactttgtcctcaatgtaataactggaaaaaataatttacgtttcaaaggctttaatctttatatttttttgaaaaggagccttcaccgagattctttaaaaattcttgctctgtcctacagtagagactgatagactcatggatatggtcctctaatggatctgtaccacctcagttctctgattgtcgccctgctgtggtgaaaattaaagcttattttcatctcatgtctaggatgtagtatgttcttgttgggaaaaaatgatgtttcttgagaaataagtgccttcagtatcactgtgtgtcacttcataaatatgactaatatctacttttaccaattgctgcaatttgatccttaaacagccatctttaaattatactttttctttgg

SEQ ID NO: 212793 - DNA, 391 bp, Homo sapiens
agcccaggttatggagaaccttggggccactctgtatggctattcaggttgttgattatataaatgtgtcatatctaagaaactgcattcacacagcggatagatactaacctggagcagttgaggctagtcatgcatcagctcagagaaacatgcatgcatacactggcacacatatgtgcataatgctgggttttttccctgacatgcactaaggtttctttttcccactgccactcttggagggcctgttatctctaccccaaacttgacatggttatctcatctgcagagcaaggtatagtggtgggtatggaatgttagggttgctgagggatatgcttcttggcttccggagtatggcaggagcgtgtatggatacctttggtgt

SEQ ID NO: 212794 - DNA, 543 bp, Homo sapiens
tcagatgttgggacttatgagaaaagacatttcagagtttgcagtgagttacagagagttggtacatgtagggtcgtggcttggaacatgatgtcaatgtcagggacagtctgagaaaaaaggaaaaagtgaaaggggcgattttggatgggcagtagttgaaagaatattagcaactacaggttgctatcagttattaaacttcttcaattttcaggtcttaggattaatgacagagtacaatctttttataaatggtcacctttttcttcggagtacttgtaaggttactgttactccaaaatgtttgtacctactatgtgcaagcaaggcttcttggatattaaaaatgaatgaaacattgaccaaccccttactctacttgcactggagtagaaagtaataaattccttaaacaataacttggtagctagaggagggagatgaggtttctgtgcagagggagtaagaaaaagtcttcagaaaggaggtattttgaatttgctaataataataacaacataattgcagctaacatttgag

SEQ ID NO: 212795 - DNA, 416 bp, Homo sapiens
tcttccccttttgctaaaacatatggtagtactccctgtatccaaattatgacagctttggaggagctctttggcaaatgctagactataaaaaatctacaaggcctcgaagattaaaaaatatccttttttcatagccgcactattgataaaattcagaggcctcataccacgggaggccatgataggagaattgcttcagcccagcagtttgagaccagcttgggtatcatagtgagacttcgtctctacaaaaaatgaaaaattagcggtcatagtggcacctgcctgtagtcctagctatttgggaagctgaggtagcaggatcatttgagcttgggaggtcaaggctgcagtgatgagctgtgattgcaccactgcaccccagcctggcaacacagcaaggacctgtctca

SEQ ID NO: 212796 - DNA, 299 bp, Homo sapiens
ttgtgaaaagtgctcatattgctgattccattgcttacatatgatcatataagtcttttctctcctttctgtagtgtggtttaaacttaatccttaaaggacatgtatttgaatttttcagctggttagaaacctgaatataccaatcaaagaaaactgctccttacatgctacagatttggttttcttcctgtactaagatgtcttttagatatagtaaatttgttaaagccaagacttcctatggaacgaagtttgatgggaggggggacattgagtagtaagatcactcttgtaac

SEQ ID NO: 212797 - DNA, 626 bp, Homo sapiens
agtgttctacctaacctcaggagtgctgtatcaccacttcttcagtatgctgttggtcacacagaccagccctggtactgtgtgggaagggactacatacgagtgaatactagaagggacgatcatcttggagcctggctacagacatagagcatgctttcaaggagctttcaattgacaagaagatgttgaaatgtacagtttgcaactttcttgccattatctcctaacatcatctgtacccagtatgtagccctgaccacaatgaaaaaatcttgccaagtgggaaaatgacaaccacttttattaattatctttttattagtgatagctagatttgatgattgatgtaagctgttactaactataagttatctagaagtcagttacaaaggttttacaactttaggaattaagtgatggtccataattccttacctgaaacccttgaggccagaatgtttttatgttttagaaagggatctaccatatattatgttatattcccagcaagatccatgacaaacaaacacattaagttcccacgaacacattaatacttacacagcaaaagttatgactgtttacactgtaaatataggaataaatgtagtctttataaataa

SEQ ID NO: 212798 - DNA, 364 bp, Homo sapiens
ggctgaccccaggatcattatcgtgttgccaagaaaaagaaccatgttcagatagtaatgtgtgatgttctgaattctgttggatatttgtagtatgtttaagatgtttatatcatatgaatgataatattataaggagctatataatttactgtttaaaaaaatgaaacctgaaagttgccggttagtagcacatctttttaacttttttataaatacattttagagacaggtctccccgtgttgtccaggcaggagtacaatggcacctacttagctcactgcaaccttgaactcctgtactcaagtgatcttccgcctcagcttcccaagtagttaggattgcagggtgcaacacgaataa

SEQ ID NO: 212799 - DNA, 240 bp, Homo sapiens
ctttttagtgtgaagagacctggcctgtggggctgaccctggtgtggctgtgaggcagacacaaagggacatttacatccagtcctgaagattacagtccagccctgaagcaacaactaggaaactattccaaaaggaggggatggggctgagtgtggggttctattctcttcataactttaactagaactcaaattgtgtaccttggtagcatccaatcataaatttattttgtcgtat

SEQ ID NO: 212800 - DNA, 321 bp, Homo sapiens
ggtcaccattttgagaggcagcaagggtcttcctaaccctcagctccctctgatttttggaattcagatttggattttggatgtacatcaagaggctggctccatgcattttaattaagttgtcttttttcatttattactaatacactcctcttaactatgatttattggttaaacaaagcaccataagccgtcacttattcatcttaatttcaacaaaattaaagtagtcgctgttagattgcacctaattgcacttgcaatgaaaagaacggagatgttaatcaaaataaattgaagataaacaataaaatcattaca

SEQ ID NO: 212801 - DNA, 2708 bp, Homo sapiens
  misc_feature (847)..(847): n is a, c, g, or t
aatacaaactcactggtttgtgaaagataattagattttaattataaagtagtaatacaaactcactggtttatgaaagataattagatccaaattacatttctgacaaaattgggcccctatatgtaattaaggctgtggaacaaaatttggggtaaagtagcctgtagaatgcagatcacgtaaaatattaaatttgacacacagaaaaccaaaagtaaattccctagaaaagacatgtctaacgaacagaatgtaaattccgtagaaactcgggtcctcaaaccacaaagacatttgtctttaaaccaggaaagacttgccagaaaagacaaaaggtcttctgtcatcccaggagagatgtaaggtcctttatttaccagatccagaataaagtcaagaggttctaccttgattttagagggagagagagtcttggcctgacaaaaggtgtgccgtggaagcagagagctccaggggctcatatgagtactgcacaccagttctaagcatcacaaactgtgtccaaaagtaatcctattcaaggtcctacctctggacactcttcatgtcaacctaaataacaaacagagaggggctctctaaaagaaaataatgtttatttgggaatagggtattggaacaggagtccacaggtcatagtaaattgtttgcatattcaggaaggtaaaggaagacaatgggtgttaaagaaaaaatgaggaggattacataattgttttgaaataattatccttgcctataaggatccataacaagggtggtggcagcccgaggttggacaagtagttgctgggcagatgtcctcagagaagtatttttgtgngtgtgtaaggttgcagtggcctttgtgcagagttgtggtttttgcagagtcttctgtgacagttttgctattatgtatacaagcatgagaaccctcccttcacagccttccctggctctatttgtcagggtttttttatttttttgttttttttaaaaaaaacaaaaaaacagtgactccattttgattctgacaactttcattgtcagaactgaattgtttctttatctgtaaggtctgttctccatctctttttctccccttataatttatcaaataaaacttttttatacttttgcattttctatgtttggagtttactgattccatccccttgctggagttgaacatgtttttctattttctataaattgataattagagctataggtgtgatcagattcaggttatttcccaccaatccccatccctgttctttttttgctgctgctgctgcaagaatcgttcataatatgtatacttctaataagagacactcactccctaatttccttccttgtcatcctagtttgtttccttttctttcttcccttccttcccctcccatctctttttttcatcttcctctttccctcccttcctcccttccttccatttttccttccttccttctgaccgtccatctgttgttccttcctccttccctccttccttccaagagccaatgcttccttgctgccttgtcatcctacatgtggctaaacaagacagatgatttcttaaatttatcgtccctctctcccaaatttgcaagagtttgggatcctcttaagttttaagacatccccaagaaaattcctcacttgttttctccattttataccctggcacttgaagttttcttcctatagtctgaagacttcttaaaatgtagagcctgatcttgttctccattctattcctagtgcctaagatagtgccaagcacacagtaggcatttactgtaatatttgagctgcatcaactgtgtcagttagatcctggcatactgaatggaataattgagattataatggactatttcaaaggtatatgtgcagggttaagagaaaccaacaagaaatgataagatgctaaactagtaacagagccagctggtactccaaggtaccaggacaagagaaggaacaaacctagagggctctaggagtggataacattcctggagctgtagccttgggtgcaggaacactacaaccactgccaccctgtggctcagcaggaaaaagatgaggaaatacatacactaaccttattttctcctaccctcctatctgctgatacctcttaattcctgaacttacctagaagccagtctataaaagtcagcctcccagaattcaggaaaaagtgaggggtggagaatggatctggagaagcagatgtagaaactgtagtacaatggacaaaaccttccctggagtatagcagttattagtttcccaggaggctaaaactttgtttcgttgggcttggacagtgattaagggatgcaggagcagggaaaaaagaatttggcctgaatatattaaagcagcagtccataaatcccctccactcaaatctttctacagctacttagtgcccttcagttacttttatacaatttcaagtctgcctttagtgttaattttaacctgatttaacctatattccaggaagtggtaagcaatattcagttgatctgtgccagacccagccttttaattaagagattattctggctgggtgtggtggctcacacctgtaatcccaacactttgggagactgaggcgggtggatcacgaggtcgggagatccagaccatcctagctaacacggtgaaaccccgtctctact

SEQ ID NO: 212802 - DNA, 578 bp, Homo sapiens
cagattatttctgtacaaattccagctactatataatttcatccaaaaaatactgcatattctccccaagagattaggattttttaaaaaaagaactgtaataccaatatcatacctaaaacaacccaataagaactccagtaagccttcatattccatcaattgtttagtaaatttttttttacagttgctttgtttgaatctggagccaaagtccatacttagtcttctgtatttcatacattctatttttttttttttttttttgagatggagtttccaattttagataacgtctaagtgactccttattatgaaagatacaagttaatatccttcccatattttattaccttacttcccaattttaaaattataacttttattctgtgtagactcataatatgtatattctattctataactataattcaccagatctgctctactttatctgaatgtatgcagagagagctgatgctggttacatgagagtttattatattgttttttacacatttttgtatgcctgaattatttgtaattttgaaaaaaaggaatgttttaaactaaaaaat

SEQ ID NO: 212803 - DNA, 550 bp, Homo sapiens
tagtaatactgtaagaagaaggcttttggaatagactctggtattttgacatgatctagatttagtgatttttaaatagagtatattgaataaggtttgtttatattaggggctaaataaacaagatcacaggatgctagggctggcttagctcaattatttcatattacagatgagaaaactgaggtgtagtaaaattaggactagagaatccacagcatgaaaatagtatcgatttttttcctgctactgctctacccacagtggcatagctgtgagcagcatctatgtaatctgatcatcacacaccccaactagagttctttgtatgacaccataatatagccagaaaattatatcttattttacaaggagtgcaggattgattagaggatttcggtttagattcagtgtgttttaaatgttattttaatagtttacttacattaagattcaccaatgtaaatgcacagtttgaagagttttgacaaatgcatataatcatgtgaccaccaccacaatcataaaacgtttttatccatccacaaaa

SEQ ID NO: 212804 - DNA, 535 bp, Homo sapiens
gtaaagaggacacaattgcataatggtatgtacttaaaatcacttggagcatcctgtcccagagaggagggcatttgagttgaaggactttgggtgggggaagcatgggcccccagggacttcactctctttgcatccttcagctttgagcctggaaatccttcagactttgttttgctccaggctgttccagatgtggtttatttttctgttgatactatggtgaatctgtttactttaaaaactacattttaaggccaggcgcggtggctcacgcctgtaatcccagcactttgggaggccaaggcgggcagatcatgaggtcaggagatcgagaccatcctggctaacacggtgaaaccccgtctccactaaaaatacaaaaaattagccggacatggtggcgggagcctgtagtcccagctactcgggaggctgaggcaggagaatggtgtgaacccgggaggtggagcttgcagtgagccgagattgtgcctctgcactccagcctgggtgacagagcgagactccatct

SEQ ID NO: 212805 - DNA, 336 bp, Homo sapiens
tctcactatattgcccaggctggacctgaactccttgaaatcctctcacctcagactcctgagtagctggaactgtaggcatgtgtcactctgctggctcttataatcctttttattggtagtaatgtcccctctttcatttctgatttatttgagacatctggtttccttagtcaatctagctaaaagttgtcaattctgttaatctttttgcaatttttgcttcctatgttttgatgctctattgctggtgtgtaaatatttataattattatatcttctgctgcattaaattttttattaatacataatgtcattctatgttctctgtaatct

SEQ ID NO: 212806 - DNA, 126 bp, Homo sapiens
gagattgcgctacagcactccagcctgggtgacagagcgagactgcatctcaaaaaaaaaaaaaaaagattccatattctgcttctttacagtcatgccccaggttgcccttctgtgatgttaata

SEQ ID NO: 212807 - DNA, 405 bp, Homo sapiens
attattggcccttttccagaagctgaggttcaaagatattaaataactgaatcaaggtcatccaactagtgagtgatggtggggctggtattggaatccaggtcagtctacttctaaagtccatgttcttaggtactccaagtagtggaccaaatgttggtgtaatggactgaatatttatatctccccaaaatttatatgctgaaatcccagcccccagggtgatggtatttgggagatgattagttcatgaagatagaaccttcatgaatgaagctgggtgcagtggctcatacctataatgccaacactttgggaggccgaggtgggtggattgcttgaggccaggagtgcgagaccagcctggcagccttgtcaacatggcaaaaccccatctctacaaaa

SEQ ID NO: 212808 - DNA, 464 bp, Homo sapiens
tcattaacttgagaagccagtttgtggccataacactctccaatgtcacctcctctaccatgatctgtgcttaaaattctgcagtactatctttggaataaagatgatgagtccaaaatacaagcatttcttttcattgcccttgacaattatctttttcctttttgagacagggtcttgctctgtcacccaggctggagtgcagtgctgcaatctcggctcactgcagccttgaacttctgggctcaagagatcctcccgtcgcagcctgttgagtggctaggactacaggtgtgagccacctcaccttgctaatttttaattttttttgtagagacagggtcttgctatgttgcccaggctgacagttacttttgtttccttatttgttaatgtttttcttttttttaaatcgctccttgtggagcagtgctaactcttaggcagtgcagctgagctgtcaa

SEQ ID NO: 212809 - DNA, 516 bp, Homo sapiens
cagtgaaataccaccacaactctaccaaagtaggtaaaattaaaaccactgacaacatcaagagtgggcaacgatgtagaacaactggaattctcctacatttttcttgggaataaattagtaaagacactcaaaaaattggccatatctacaaaagcctaatagtgttgaagcaaacgttgcactaagcaaagttaagcatgtcctataacctgaatgccgtcttccaccaaaatttatatgttgaaacccaacatccaatgtatcagtattaatttggattaggtgattaggtcctgaggaaaaagccctcataaatgggattgatgtcctcataaaaggggccccagagaactaccttgcccctctgccatgtgagtacacagtgagaaggtgccatctataaagcagagaataagcccttaccagacatcaaatataatggtactttgattttggacttcccagcctctaaaattgtacgaaataaatttatgttgtttataagccaccaaa

SEQ ID NO: 212810 - DNA, 491 bp, Homo sapiens
tgtagctggtcctgcctctggttatggtgaaatggaatgtatgacaactcctgagactgggagtctgggaagctgctgcggagagccctctcctcattttcatcaggctcagctacgcaacctctggtggaaagctatggcctgttgaggagggaggatgtcgtttttgagttagtgagttttccagttttgtttgagctccaaagctttcctccaaacaactggaaagatggctgaataattggctgaaagggatttaatcccttgaaaaacctttctggtagggagttgctggcaatactggtgggtttttcatgattttattttacagagggcttgctacgtaaaccagtgagccaggagaaacagaataaagtctgttctggaaggaaaaatgagacctggtgtgccacgagtctagtgttctcataggaaggctctaaaaacaaactcagctttcctgctattgaatgattatctctataaaagga

SEQ ID NO: 212811 - DNA, 548 bp, Homo sapiens
ctcagtctttcctatagctgaaaacaaagcaatcatcttcgacccttaatagcccttcatattcttgcaagcagtttttttgggttcttctttggtctacccatctctggaggaaagggaaggaaatttacctggttttttgttttgaaacctagttgctttctctagactgtggcttgaaacatacaagcctttgtgcaaagcactgggtcagggttgggggtgctggggccgagagaaccacaggagacccactctgtttgtcaccagtggcctcttgagccgcccgtgagtaggacggtgctcaggcgagcccggcaaggtcccctccgccctagctgcttatccattcaacaccctcctgctggctcctctgtttagagtccagaattatgaatagtttaaaaaataagagcaaatgcctgctgagcccttgctatgcaccaagcacattaggtattatctcaagaactttccatatgttatctcaacttatctttgtaacagctataatttcacactagttaattacttaactatgatttaat

SEQ ID NO: 212812 - DNA, 199 bp, Homo sapiens
ccaaccagctctgtccccgtttcttcttattgccagaaatatacctcaagaaggtccttttccaacactccatgcccaaagatatgttccacagctctgtttattattttcccagcttctatttattaaagaaagtagtcagagcaggaaatgggacaagtcaaatgatcacaatcaatctcatcacctttgcaacatg

SEQ ID NO: 212813 - DNA, 318 bp, Homo sapiens
gagactgtcccagttttagcactaaaaagtcccatgcctctagaaactcctcaatcccagatgaacagggacagttggtctctggcacacacatgtatcagtcataaaataagagttccaaagatgttacatcttgaaactcttttttaactagaaaattctcatatccaaaacttcctacagtgatatgcctttcagtcccagaaatgaaatagcatatcatggtctcagagactttatgtacttttcagccttctctccaagacaagtaatatcctctcttcctacagcttcctgattgtacccatccccattccc

SEQ ID NO: 212814 - DNA, 439 bp, Homo sapiens
tattcttgatattcagagtcctgcagatgtggcccctctctgctattctaccctgctttcccacagtgtcctcttgcatcagctggccatctctccatgactgtgttccccctcctctgggcctttgctctagtgttcctttggcttggagtatctgctcacatctgccaagcagagccgtatccatgcttcaagctttcttccatattttcttcctttgctttctttcctttttctttcttcccttgctttccctttccctttctctttctcctcttttcttttttctttcttcagggtcttgctcttgcccaggctggtgcagtggtgcaatcatagttcattgtaacctcgaattcctgggctcaagtgatcttcccacctcagctttctgagtagctggaactacaggtgtgttgccaccacactcagttaattt

SEQ ID NO: 212815 - DNA, 684 bp, Homo sapiens
tggctatttcccagtcctgtttcagctgagcagctgtcaagagaaagtctgtgccaagccagagcttggagattcttggaggatgtgtttagcaccatgcttaggtttcaacatacttgttctaagaaaaaagatacttcctgaagcaagctttaacagtcaagttggctgctcttaatcacatctaattagtactggagattggagaaagccttattagaaattagaatgtgcttcatttccacagttgatttcagctgtgattatagggttgccttccttctttctcttatacatttcatactacacccccatcctcctaatatagttatatcgtacttttaataaaacctatatttggttttttcataattgtggctgtgtaaatactatttgctaagtcagtatctatgactatgttttatttcttacagaactttaattttactggcattcatgaattatctcatttttttcatttgtttaatttttttacctaaagcttaatttcttacatcttccagtgcctttgtaaaatccctcagaaataactatcttggattctctgtcacattcctgtctggatttgttgccttctaggccttctccatatgttactgtgactttgcttcaccattttgagattctcttagtttttctcctatattggatcccttctttgct

SEQ ID NO: 212816 - DNA, 453 bp, Homo sapiens
gcacccggccagatgtagcgtttctaagcttcttttcaatagggtgtttataggtgtgctgtggaatacctgagtggctaaataaattcagaagctatttggataatacaaagttttaaaaagccttttacgaaagggtttttctttttctttttgggggtggggagggaagacagagtcgcgctctgtcaaccaggctggagcgcagtggcatgattatcggctcactgcaacctctgcctcccgggttcaagcgattctcttgcctcagcctcccaagtagctgggatcacaggtgcccaccatcacacctggctaatttttttttaatttttagtagagacggggtttcactatgttggccaggctagtctcgaactcctgacctcaggtgatctgcccttctcgggttcccaaagtgctgggattataggcgcgagccaccacacctgg

SEQ ID NO: 212817 - DNA, 378 bp, Homo sapiens
cgtgcttgtagccaggagttcaggatccacctgggtagcatggcgaaaccccacctctaccaaaaatacaaaaaattaggcttggtggcgtgtgcttgtagtcccgggtactcgggaggctgaggtgggagaatcacctgagcccgtgagttgaggctgcaatgagccatgatcatgcccctgcattctagcctgggccacagagtgagaccctgtctcaaaaaaagaaaaaaaaaaagaattgatacatagctaaatcttaatgaccttggattggcaaagtatttctagaagtgacatcaaaagcatgaagaacaaaagaaaaaataaataattggacttcatcaatatttaaaacaaaacgataccatcaagaca

SEQ ID NO: 212818 - DNA, 329 bp, Homo sapiens
tccctcctgccactagagtccagagtccaaactgtcagataacagcttatcagcaatcagtgatcctcaaggcacaggaaatgtgaggacaaatggctgacagaccacctgagagagtgccaggagagaatggggttgaccaaaacacaggcatcagctttccctgttccacagctgtcattaggctaacagtaacgtgactgatgtgtgtacttggttacacatctgggccatcctggacatgaggaaacagagaagttcactgaattggcaagattgggtcagaaccaaggaactgaagagccaagccaacactcttccctcacttt

SEQ ID NO: 212819 - DNA, 397 bp, Homo sapiens
aagaaactccttcaatttctatagtctacctgggcacaacttcccttgataatattttaaagctgattttcaattactgcatatcacacttcaaacactattctaagtgttagtacatgtatagtatatagtaattcatttaatcctcacaataatcccctgagcccaatactattatcatccccactttacaaatgaaaaaactgagccagaaaaaggttaagtaacctgcacaaagctggtaagtgatacagccaagattcaaacccagcaattatgccccaaagctcatacatttgaccacttccctttactgttgctgaggtcaagtgagtggcaatcaggatcactgggtttcttaagatcagctcagctcaaacttccattcacatcctgg

SEQ ID NO: 212820 - DNA, 407 bp, Homo sapiens
  misc_feature (90)..(90): n is a, c, g, or t
  misc_feature (111)..(111): n is a, c, g, or t
  misc_feature (132)..(132): n is a, c, g, or t
  misc_feature (138)..(138): n is a, c, g, or t
  misc_feature (140)..(140): n is a, c, g, or t
caaagtgttaatcttataagtactaggctgaattttttatgagtcttgtgactttggtctatgtggggacttataggtgttatggtttanttagttccaacccttacttgntgattcaccccagtgaccccntggagntngtggtctcaggagcagctgagaccctcagcccaccacaaaacaagtccgactccaaggctggtgagtgaggagatgcttgccgtgatgacgctgggcacagagggtcaggtcctgtcaagaggagctgggtgtcctgggtggacatttgaagaattatattcattccaacttgaagaattattcaacacctttaacaatgtatatgtgaagtactttattctttcatattttaaaaataaaagataattatccatgagaaagctact

SEQ ID NO: 212821 - DNA, 357 bp, Homo sapiens
ataagaagtgtatttacacaaagacttaaaatatagaaacacatttggttctaaataattacaattaatgaagaccctgaatcttcatattgaggtaccgaggtcaaaggctctgcggttaagttggaagctgttctttataactttctttgcacattagaacgcataatatttggtagatttagagaaaaaagtctggtgggacttagaatcactgagtttatatagtatgactagatgtatacttgcagagcaaattccatcattgttatatccttatgtataaaacaatatcttttatatgtaacaatatattttattttatacttatgaatattaaatattctgtttaataac

SEQ ID NO: 212822 - DNA, 545 bp, Homo sapiens
accttcaaaattcaaacacatgttcttcaagagtcaattacattagagtatttgctgcaggtcatctgtttcagcatcctctggaaagtagatttctgggcctattttagaccttctaaaccatgaggcctggaaactgcaactaaagtttgagtccctgaagcaccccaggttcttggctggtggagaaacaaacaaaaaaatcctcatttggccttggaatgggtagggaagcttgtctgatgctacatttctgtggtcttacttacgatgcagttttaaaactgaaaaatttttaaataaaagtagctgagctgtaaagtacctaaaacatagttgcatatacaaattaaaactcgtgtattgagtatctgctatgctccagcactgtgctgtggtctgaatgtttgcatacccccaaattcatatgttgaaatcctaacccccaaggtgatgatattaggacatggggactttgggtggtaattaagtcataaaggcagagccttcatgagtgagatcagtgcccttttaaatgagaccca

SEQ ID NO: 212823 - DNA, 309 bp, Homo sapiens
cccctggaccttggctcaccacctaagactgaacaagcactaaaggaccgaccagcccgctaacagctcactccaaaaatgagcgggactcccagagaaactatttttattggagcatcctggttttgccacctgctcaccccactgcctgtccttctctccaaggaggcttctgccagccctgcttgtccttccctagaaaaggaaagccttttcctgtctgatcctgagacacctgtagattgagtttggaatattctccctattgcaatagtattgttgaataagttttatttttccctacctctg

SEQ ID NO: 212824 - DNA, 217 bp, Homo sapiens
ctgttcagtctaggggagaactaacggtgagatctccaagctggtccttgtgatgctaaaggactttaatttggttgtgtctatcaggtacgctagcagctccaggcagctggctagcccaccactgggctagagaaacaccctccagcatgcctctagcatggccagagaggtggagggcagacatcatggaatcagacacctccccgggatacag

SEQ ID NO: 212825 - DNA, 504 bp, Homo sapiens
agctaaggactggacatatgcacgggagtaaatcgctccaccctgcctatccaggcgtctgcttgctcaggtgtcaggtggtgattagactcatagtttgcatctgtggtgttaaatcttctggagtacttatgtgtgcttcctcactggtcccacaacagttatctaagtgtgctaagcagacatgatccccattgtgcagatgaaactgaagtaagtggcctgctgagggtcccagtcatgtctccagagatgtgatgcaaagctcttaattcttaatcttttgtgctgtctacgacatgagcagccttgcagtgcaccaagcgtctcgtggggtgtaaggcctgtgaaaatatatttgagtataaaatattattggccgggtgtgttgactcatgcctgtaatcccagcactttgggaggccaaggcgggcagattgcctgaggtcagaagttccagaccagtctgaacaacatggtgaaaccccgtctctactagaaata

SEQ ID NO: 212826 - DNA, 264 bp, Homo sapiens
agtcatcagaaaggagttctgtagaagtggcaggggaggccaggagggaggcagttggagcagtccagaagggagggcctgtgggcctggactggaacagggcacgggcagtggtgttggcggagggctggggaggagtttacggtgactgtcttgggtggccagatggatggtgtctcccagagatggacacccagaagagggtatgggtctggggagagatggtgggggagttcaggtgtgatggtgcatccaccaggtgga

SEQ ID NO: 212827 - DNA, 423 bp, Homo sapiens
atgtacattgtgaaaagtgagtcatggctttttctctgcaatagtgtagacgtttctactcttaaaaataaagatagattaaaatataacacctcaactccaagagctccaagcctcccacagaacatcgtagtcctgctacactcagttgaacatttatgccctggccctggcacccacctcccttagcctgcctgtgaaggcgtctctctgatgccctatctagacccgttcttccttttcctacatttgaactttttctgagatagtttcagtttccataatctctgtgtgatgattttcatcaagaattccgactaaggagattttattcttttaagaagatttgttcaacatatacttacatgagattttgttctttttaaagactgtgtaaataaattatctgattaagaaaaattt

SEQ ID NO: 212828 - DNA, 390 bp, Homo sapiens
caagtagacttagtgtttgaaataccatctttggatacctgaagcctgaggtaattgattcttgtggccttgctttttaaatttatcatttgatattttgaattgcagataaatttagataactgaaaggaataacctcagcagaatgtaggcgtctccattttgttcttattaaattatcaaagaatgaaatgtaaaatgaattatttaaaatgattgtccttgggggcctttggtactgagtcatttaaatggactggtaagaaggtggccaggcgcagtggctcatgcctgtaatcctggcactttgggaggccaaggcaggcagattgtctgagctcaggaggttgagaccagcctgggcaacatggcgaaaccccatctctacta

SEQ ID NO: 212829 - DNA, 596 bp, Homo sapiens
gtatatccatataaacgaatagtgcaattgcctaaaatgttgtcgattaaaaaatacttaatggtgtggaaaataactataatacaatgttaatacagcaatgtatatagcactttatgacacacatatttgctcatatataattaaaaataagatatttgtctaaatgttacttgtcttgattttaggtgaaaagatttgatgtgacatttttctctctttctcgcttgtttgtgtcattatctctaatggtttttgtattttctaaatctccttacttttagctttcaccatttagacaattgtcgggggacagggaagaaggaaagtataaataatgccagcatcaacataattatttttgtcaaagcttccttatattaaactactgtaaaacttgtattttgttcatcatgagtacatacaaatgtccggtttcgtatagaaagatgaacaagtgagggatcggacagacacacacatctttcacctgggcatgcagaatgtttgcctgaatgggaattactaaatttaaaataattgcactgaagaatcaagtaattttccttttcccatcttactttcttttaaaacat

SEQ ID NO: 212830 - DNA, 523 bp, Homo sapiens
tggcacatgtttacctatgtaacaaacctgcacatcctgctcatgtaccccggaacttcaattaaaaaaaaaaagaagaaatgccatctcactaggtgagcatcacattagtcattgctgctcctgtcaccttctggtaatgatcatgcttcatgtatttttatttccctgtcattactctcttgttttttctcctggttttacctaatagataaatgccttctaaatgattttgttgtctcacagtttttttttctgaatatttagccctgtttattcccagaaaggggcacttaaaaatacatatgaccctaatcatgtgagtgactttatctcaaggctaaagaataggccagctggtgcagccactgccaagtgtcacccaggggcctgggtgatggtggctattgccaccgcacatgacatcagggaagtggaggggaagcttaaagatccagtctctatgttgcgggttcccacccaaatgtagagctgtggacagaggattgatcaaaaaaaacaa

SEQ ID NO: 212831 - DNA, 295 bp, Homo sapiens
ttctttgttggagtatggaatctgaaattgtttatgaacctgttggtctttcgtgaacttcaaatggatcttttacccatgcctgatttgtaacatgcattagtgacttgaaatagtattcactgtgttttgcagatctccaaatattgacacatttcattatacagtactcctttcccctcagaaaatcctcacattcattaatatcactgcccatctcatcataaaagtctttaattaatgggaagctgtcaggctcataaatatcaaatgttttccaaaattctaattttta

SEQ ID NO: 212832 - DNA, 447 bp, Homo sapiens
gaaaatagctgaatagcattccatcgtgagtgtgtactatattttgtttatccattcatgtgttgatgggaacttatattgcttgcaaatcttggctgttgtgaataatgctgcaataaatgtgagagtgcttgatatctctttgatatactgatttgctttcttttgggagtacacctagcagtgagattgctgtttcatattgtagttctatttttagttctttgagaaacctctaaactgttctccatagtggttgtactaatttacattgccaccaacagtgtacaagggttccttttcttcacatcttctcacagcatttgttattgcttgtcttttggataaaagccattttaactagggtgagatgatatctcattgtatttttgatttgcatttctctgatgatcagtgatgttgagcaccttcttatatacctgcttg

SEQ ID NO: 212833 - DNA, 413 bp, Homo sapiens
atatccttgtaatttaaaaatggactgttatatatactgacagttttgtttaagatagctaggaccatactagaaattatggtagagcaatgggaaactatctttaaatatacctctgaggccgggcacagtggctcacgtctgtaatcttagctgagattacagctggataggctgaggcgggagggtcgcttgaacccaggagtttgagaccagcctgagcaacatgatgaaaccctgtgtctacaagaaatagaaaaattagccagtcatggtggcacacgcctgtagtctcagctactcaggaggctaaagtgagagaactgcttgagcccaggaggcggaggcttcagtgagcagagatcacaccactgcactccagcctggtgtcagagcgagaccctgtctcaaaa

SEQ ID NO: 212834 - DNA, 435 bp, Homo sapiens
agtgaagtttattgtacgtttgtttccatgcaacaccgtcacgctagaagggtcaagtgagagagatcattagaactgtgttgatttactgggcccagttgtgcactttccctgcagggaaaggaggaaagaggctttaagagaggagctgaggggtgctgggtggggagggaagagcaggctatttgtggagggttgggggaacgatgtattgttgttgttgttttcccctggaacccctaatgggtttagaacagatgctctgcctgtatctcctgaagaggcaccaaagatcttgtttaaaagggaagctaggctgggtgtggtggctcatgcctgtaatcccagcactttgggaggcgaggtgaaaggattgcttgagtccgggagtttgaaaccagtctaggcaacatagcaagaccctgtctctattaa

SEQ ID NO: 212835 - DNA, 399 bp, Homo sapiens
ggtggttctttgagttcctagttgtttagttgaacatgaagcaggtggcaaatgtaagtttagtctacacactgattccttcctgttcgcagaagggttcatgtgttcgtttttaaataatcttcgggtaaggaatagagaaacaccaagcccaagaggcagaaggatctgtctatagctaatgagtgagaaactaactgtgggatggtttatggtctctggctctttgaaaccacagaaatttaaagttatttttaaaaagccaacttgactgggcacagtggctcatgcctgtaatcccgaggcaggcggggggccaaggcagacagatttcttgagcccaagagttcaagaacagcctgggcaatatggtgaaaccccatcttctcaaaaaagtta

SEQ ID NO: 212836 - DNA, 449 bp, Homo sapiens
ataaattgctgtactatttaccatctgttccatttgacccacttttaggtgaataaattgatgcttaaggaatttgtttttgatacaggggcaggatttggtgtagttcatcctaacttaagaaggactctgtttaacaattatctgctttaaaattaaaattaatgttttaatattaaaaagcaacatcttccttaaaattaatgacacaaaaaatgaaaatggtaaattttattttgtgtgtttaatagcctaatttacctgaactggctttcattgagttaaaacttaatatggatggattcttttgtggctcataagcttgggattttcacactaaacatttttaactcatgaggttgggacttcacattaatctctaatctttgagattgcctccctcaaaccttgctacagtattggcacattacccatctcacatgaaaaaa

SEQ ID NO: 212837 - DNA, 206 bp, Homo sapiens
aaaaagaatggccataggacattccattcaaacaaagaataatcagcctaagttattatattatctggaatacccaagttatcaatgacaagctcctgatttttctttttgaaagacttagagcaatagttgatggatggaaaaatgcagagtataacaagaagtgacatctccttaccaggagcaactcccactattcccctatc

SEQ ID NO: 212838 - DNA, 239 bp, Homo sapiens
gtcgcctgctctcattctcaccatgagcccagaaaccgttcctctccaccatcctgataatcagcacccacgtggtcactcaactctcatcttcacagtctggccaaatcccagtccctgggaggggtggataccctgcttcttcaggtgaggaaatgggtctagtgtccaggatcacactgtcaggcatcagaacagcagggtctacaccaggacccttgactctaacgtgctattct

SEQ ID NO: 212839 - DNA, 615 bp, Homo sapiens
gaggtgagaaatttgcctccagttcaacttagagcttggtaactacccactgtagcatcaacaatcatgaatgaatctaaatctttagttaactcacagctttctacagctgctgtaacaaattaccacaaacttcagggcttaaaacaaaacccatttattatattagttctagaggtcagaagtccaaaatgggtctcactggtctaaaatcaaggtattagcagggctgcatgccgtctggatgttctagtacggagcatctagcgaaaaaggtttccttgcctttttcagcttctagagctcacctgcatcccttggcttgtagtctccttcctccatcttcaaagccagcactacagcatcttcaaatctctgactgaacttgtctccctcttccccatttaaggacccttgtgattacactggacccacatggataatccaggataaccgctccaattcaagatcagctgattagcaaacttaattcccctctgccatgtaacacaatatattcacaggtttcagggattagaatgtggaaatatttgggcaccagttttctgactaacacactcatatacgttttcagaacaaataacttcaatttcc

SEQ ID NO: 212840 - DNA, 739 bp, Homo sapiens
gccgagatcgcgccactgcatccaacctgggtgacagcaagactccgtctcaaaaaaaaaaaagaaagaaagaaaagaaaagaaggaaagaagcggggcacagtggctcagtcctgtaatcccagcaccttgggaaggccaaggtgggaagatcacttgaggctaggagtttgagacaagcctggccaacatagcaagaccccatctctacaaaaataaaaattttaaaaagggctggggcatttgagctgggtcccaacagtagacaagtagaaaaggcatggagagggcataccaggtgggaggagctgtgtgcaaaggcctggagatggaaaagcatgctggccaccagcttctgacaagcagtttagtatgaacggtatgcagggaaagagggaaggagggcagaggggtgcgcacgagcacccgttagtgtccttaaatgaccagcatgggaacctggtctctttcctgagggccctagagagccatggaagggtttagagtaggagtgggtcatggttaggtttgggttttaggatgatccccctagttgctctggagaggtggagcagagcgggtactgaggctgggtgcctgtgggaggctggcgattacagacctgagcccaccagccttggcccaatggtctcgcccaattttagaatagggcaagctgaggcctcagagccaggcaagagctgaccccttcaatctttgtttgagaagtactgatcgc

SEQ ID NO: 212841 - DNA, 629 bp, Homo sapiens
gatgaagccctaccccgcattctgcttagcaccttctctgggccatctcctgccagacatgtgtgcactgtgcaggaggggcagcctgtggctgtggggccacacggaaggaagggacgtcttaaggctggatggccagaggcagtaccagcagcttcaagtggggatggaggagaaggcaggtttctgtctggatttccacctccctgtgaacaggacgaagggaacatgggaagacacagactcctggggacttgggctgcagtgccaggcagaacagaactgtgattaatgtccctgtcctcatcatcctcactcctctggtctgtgtgtgtggacgggtgcagggggtgccaacctcacggccctggagccgagccgttccaagaagcacagaagcacagcctcaactgggtcgagatgagcacagtatatggaatcggcagggttaaggccaggctatgaacaactctaggttcagcccaagaaagggcacatgtctgacatgtgactgtttctctgagagaatctggattgtcttatctaagccaggagtgtgcccccttcaccctgacatggccctcagcagagccagggccagcagcgcaggaagctcactggcatgaccc

SEQ ID NO: 212842 - DNA, 445 bp, Homo sapiens
tacagctctgagtgggccttgggggctggggcagctggggacagagacagggtggcgacttggaggccctagactctgtgaccaggcgcctctgggcccaggatgggtgctggcctggcccctggcattgtttcttctcttggtgagtgttggcttagggagaggaggcctgacaagcagctcattgtaagtgcctgctgatgggctggcttgtgtgagcccatgggcatgagagcctaacccccagccccttttactttagggagttggggtgggggtggtgctttccgccaatccctgtacacgcatgcttgctgactcctgcttggttgccatgggaaccatgtcgtggtgatggctgcttgggagagaaaggaaggggtggctggatggagatagttgtgtccatggctggcttctcagtcctgatgccgcttttcttcct

SEQ ID NO: 212843 - DNA, 546 bp, Homo sapiens
cagagagaaataattatctataaaggaataccaattctaattgtagtgaatttcttatctgaaacaattgaagccagaaaaatgtggcacaacattgttcaaatgctgtaaaagacaaacaacacaattgaataaatatttttccaagggtatacaaatgagcaaattgtgcatgctcaagatgaagatgctcaatatcattagtcattaggtaactacaattcaaaacttaagtacattcactggatggctgtaaacagaaagccaatacaagtattggagagattgtagagaaatgagaactcatacattgctggagagggtgtaaaatttgcagccactttggaaaactattggtagttcctgaaaatgttaaacatagagttgccatatgacccagtagttctactattggttatgtactcaagagaaatgaaaacgtatgtccacacaaaaacttgtacatgaatagtcatagtaacactgcttataatagttgaacagtggaaacaaataaaatatttgtcaactgataaatggtaaaca

SEQ ID NO: 212844 - DNA, 623 bp, Homo sapiens
caaatggaaatgtgaaagtactttgtagttttttattactattattaatttttaataaaatggtaacattcatttaataatcattagttttaacttcagattgtactggatttcctctagtatttcttaagattagtgaataaagtatttctcctaataaataagaaaaaacgctggctccagaaaggtgaaacacggacacttcgggcggtcaggatgggaaatggttccaccaggaaactggagcccacgttctcctcgtgcaggggaggcccgtcctggccccacggcaagaattagcttctggtccatcggaggatccgagggtgaatttccctgaaaacgtcgtgaagagcgtggcagctgcccttaagcctcttgggatttgaaatctttttaaattggcgccccgacctttaagaaaccctctttccccctcctcttccgaggggttccgccaaaacgctaataacccttaccaggcacccgggtttccccgagaacggatctttgctttgcaccgtcgtggtaccaaaactttaccccctccggggggaccccttttcccccctttcttcgccccctctctctttcttgtggttccgtgcccccccctccccccc

SEQ ID NO: 212845 - DNA, 458 bp, Homo sapiens
tagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataa

SEQ ID NO: 212846 - DNA, 346 bp, Homo sapiens
gagacggagtgtggctctgtcgcccaggctggagtgcagtggcgtgatcttcactcactgcaagctccgcctcccgggttcacgccattctcctgcctcagcctcccgagtagctgggactacaggcacacgccatcatgcctggctaatttttttgtgtttttagtagaaacggggtttcactgtgttagccagaatggtctcaatctcctgacctcgtgatccacccgcctcggcctcccaaagtgctgggattacagacgtgagccactgcgcccagccttccattccatatttttatggaaaagtctaaacaattatttccttgcccttctgtcgtcttctc

SEQ ID NO: 212847 - DNA, 481 bp, Homo sapiens
  misc_feature (450)..(450): n is a, c, g, or t
tcaacttggtgtccatatctactcctcttttcaaccgtacttaacttccaaatcaagtaaatagcaactaggcttccatgccatataatgctactatccgtcttacaaccaaaaccatgctaaccctctccccagaagaggagccaaagtccttttatgaactttttttgagacaaggtctcactctgtcacccaggctggagtgcactggtacgatttcggctcactgcaacctccgcctcccaggttcaagaccagcctggccaacatggtgaaaccccgtctctactaaaaatacaaaaaaattagctggggtggtggcagatgcctgtagtcccagctattctggaggctgaggcaggagaattgcttgaatctgggaggcggaggtggaagtgagctgagattgtgccactgcactccagcctgggtgacagggtgagactctgnctcaaaaaaaaaaaagggaaaaaaaaaagcc

SEQ ID NO: 212848 - DNA, 471 bp, Homo sapiens
ctgtttcctaaaattccatatactttccatctttatgtcctttgatcattctatttgtgtctcagtctcttttcctgtgtctctctttgtcatgtatccttactgaaatgccatttccctgactgttgaaattccatttacccttggaggtcatcactcctttttttctttttaatgagatgaagtcttgctgtgttgtccaggctggtctcaaactcctggcctcaagtgatctcctcacctcagtttcccaaatgctaggattacaagtgtgagtcaccatgcccatctgaggtcatcaatctttaaagaccttctgaaatgctgcctctgctatgaagcttttcttttttctcttctccttcttcttcttctttttttttttttttgagacagggtcttgctctgtcacccatgctggagtgcagtggcatgatcttggctcactgcaaactccacctcctggattca

SEQ ID NO: 212849 - DNA, 312 bp, Homo sapiens
gaagggcaaaaactacaatgacttttgcaccaacctagtatgagcataaggggcaacagtgatattagtcaaagagtcccagaataaggtagtaaagcttttgggagctgatacatcaccatgatgaaacaacatggccatcagaggagcaacatttaattaagtgggggatgggttgttgtgatacttgttaccagaaagattcattttggtgctggtgacatccttgtatactatcctgacaaggcatgtttatgtgagtacacatagcaggtggaggcaacatcaaataacagaaaagatttcaggtga

SEQ ID NO: 212850 - DNA, 409 bp, Homo sapiens
tgcccactgcccagcaccccatcagtcacatcacctcacagtcagaatgcatatgacagtgccctgtcacacaaactgcaaactgctatactttgcagaaaaggacaagactgcacgatgctggctggactcacacctgtaataccagcactttgggaggccaaggtggatagatcgatcgagctcaagagtttgagaccagcctgggcaacatggcgagatccgatttccacagaaaaaaaaaaaagaagaagaagaaattagccgggtgtggtggtgtgtgcttgcagtcccagctgcttggagggctgaggggggagaatcacttgagtccaagaggttgaggccacagtgaactgtgacggcaccactgcactccactctgggtgacaaagtgagaccctgtctc

SEQ ID NO: 212851 - DNA, 350 bp, Homo sapiens
taggaagtaaaatggatggaacttgatgatagattcaatataatgcatgagagaaagggagagagtcatgttgaggatgactcaacggtttccagcttcatagctttatggataatgataccgttgctgagcaaaggaacactggaaaagaaccatattctacatatccaccaatttcattatttcgtacatagcattaatatatctcccttgtattatagttatttataggcatataggtttctgatatcaaggcttttcagaggtttgcaaagtaaggcccacgggtcaaattaagacctgtttggcccatagctaagaattgtctttacatttttaaggttgttaaa

SEQ ID NO: 212852 - DNA, 222 bp, Homo sapiens
ctatgctcctgagcagtgctggtcaggcagaaaagattgactccaggcctggacaaggaacagtccagtagaggccccttacagttaagcagtgggataatcatggagcagttctatctgcattttaataattacttgttttgaaaaagttctatgtctacgaggcccataaaaatatcttaatttttaaacaatcagaataaaaaatgaatagaacaacat

SEQ ID NO: 212853 - DNA, 762 bp, Homo sapiens
ctgggttcagaatccataagctggtggcctcaggcaggtcacctcatgtcttttgcctcagtttcctcatctgtaaaaagggaataatgatagtataaaacctctagggggctgtgatgaaaattaaaaagagcacgcttgggaaaccttggtgcccggcaccttctatggactgcagaaattagttaatatgttgatgttgttactgcatgtagagtctacccagtgggagttggcaattcagacccagggttgctgatacgacatcatctactcatccaagatatgctgggcttctacagtgcagcaggctccctctaggcgctggggatgctactgtgaacaggactcccaagggtcctgctttcatggagccgagtatgctgggaattccattagtgtcattgtagggggggtctgagaaacaaaagaaataaaaaggcatgagcatgcttacttcctattttctggaggatgtgctgggatccagagccacccaaaagaactaactctgagatgggtcttcagaccctggggaggggctgggggctgggaatcccctaggggagggtgggaacttttgtttcttactacattgaaaagaaaaggcacagaatctggcagctatgtctttgtcctacttggtcccagcactacctgtgtggcttcagactactctgtccccaccagctggtccccagtttcaggcatgcagggtgatctcacctacctcctgggctgttttgagaattaatggtggta

SEQ ID NO: 212854 - DNA, 346 bp, Homo sapiens
aattgataaagacaaagttagtaaaaatatagacaatttgaacaagactatcaaataatttgacatcattgacatttatataaggagaacaacagaaaacattcattttaagtgcacaaaaaatatttacaagttagttcatattctagaccataaaacaagtctaaattaatttcaaaagattcaaatcatacaaagtatgctttctgatcaaaattgaattttagaagtcagtaacagaaaatcccaaatatgtacagactaaatacacagttctccataacccatggataaaagaagaaataaaaaaggaatttaaaaagcattttgaatgggatgaaaatga

SEQ ID NO: 212855 - DNA, 937 bp, Homo sapiens
tggctcatgcctgtaatcccagcactttgggaggacagggcaggcagatcacctgaggtcaggatttgaagaccaacctgaccaacatggcaaaaccccatctctactgaaaatacgaaaatttgccgggcatggtatcatgtgcctgtaatgtcagctactcaggaggctgaggcaggagaatcacttgataccaggaggcgcaggttgcagtgagccgagactgtgccactgcaatccagcctgggtgatggagcaaacttccatctatcagaaatacagccattgctctgtccttttggcctggcttgcaaaaaggtggacttttacatcaacaaagccctatagtagccaaaatcaaaagagtttctcctctttttctttttccttttgctagccgtttttcttcctctaccgcgccatctttttttttctctctgtctgtcccgtgggaatttagtcacttcagaggctttttttccccacaatttggaacttcctttggatttgatcaagtcatatagagttgatcaaatccagtgggaaaaagaccgaaaaaacaacaaaaacagaaacaaacaacaacaaaacagttaagcaaaacaaatgatcacacagtttatatgattactgagtgctctgatggtaaggagaaattaagaccagctggttgttaatctttagccaaagcaaaccacagttcagttacttacctatgggtgggtctcaggctgataattgctctataccatcctagaagcgggttaaaacaaaaaagaaatcgaggggggggccggtaccattcgcctatatgagcgaataaattacgggcgccgttacacgtcggacgggaaaccggcggtcccctaagcgcgtaaaaacccttaccagggggataaagccaagagcctcacaaggccgaaggaggaacaggggg

SEQ ID NO: 212856 - DNA, 926 bp, Homo sapiens
tggctcatgcctgtaatcccagcactttgggaggacagggcaggcagatcacctgaggtcaggatttgaagaccaacctgaccaacatggcaaaaccccatctctactgaaaatacgaaaatttgccgggcatggtatcatgtgcctgtaatgtcagctactcaggaggctgaggcaggagaatcacttgataccaggaggcgcaggttgcagtgagccgagactgtgccactgcaatccagcctgggtgatggagcaaacttccatctaaaaaaaaatcttttaaaatctcattacgatatttcaaatagggcaaactgctgctatttcagaaatacagccattgctctgtccttttggcctggcttgcaaaaaggtggacttttacatcaacaaagccctatagtagccaaaatcaaaagagtttctcctctttttctttttccttttgctagccgtttttcttcctctaccgcgccatctttttttttctctctgtctgtcccgtgggaatttagtcacttcagaggctttttttccccacaatttggaacttcctttggatttgatcaagtcatatagagttgatcaaatccagtgggaaaaagaccgaaaaaacaacaaaaacagaaacaaacaacaacaaaacagttaagcaaaacaaatgatcacacagtttatatgattactgagtgctctgatggtaaggagaaattaagaccagctggttgttaatctttagccaaagcaaaccacagttcagttacttacctatgggtgggtctcaggctgataattgctctataccatcctagaagcgggttaaaacaaaaaagaaaccaggccgcgcttaaacgtcggatggaaaaccgcggtccaattaggcgtgaaaaaccctcggcaggggatcgccgcggcgcccgggc

SEQ ID NO: 212857 - DNA, 542 bp, Homo sapiens
agtgtcatgaaaggatgcagtagggcaagggctggagagtgaaggaggtgctattttggataagattgtctgacgagataatgagcagaaccctgaatgatgtggtggggtaatttctgcagtatctgtaagaagagctttcctggcagaaggaacaatgaatgcaaagactctccagtggggacaggcttggcaggttcaaggaaaagcacagagctgctgtggtaggagctgagcagaaagaggccagtggatcctgcagggcccggctgcctgtggcagagtttggactttattctaacggtaatgggaaaccattgagggtccagtgttcactgaaagaacatttagaattgaattcaactgagcacagatatattgagtatctgctatgtttgaggcactggacaaatattaggaattcagtgatttatgagatattgactctgccctaaatctgaaggtcgaataattacaatacagatgaaaggcacaattagagaaatattatctctgatccacgagtcttgaaaaaagaaaaa

SEQ ID NO: 212858 - DNA, 741 bp, Homo sapiens
tcttcggcctctggaagtgctggtattataggcatgagccaccacacgaggccaatagcggggtttctactggcaaaattaaaaaaaaaatcaaaatcaactgggtatggtggtgcccacgtgtagtaccagctactcgggaggctggggtaggagattgagcctgggaggtcaaggctgcagtgagccatgactgagccactgcattccagcctggggaacagaatgagacctcatctctaaaaataaaaaatacaaataaataaatacatagttggctaccattgaaaatatttaaatatcaatctaagattaaataatttaaaaagtctgaggtacagaatggaatatactatacatgttatgaatactagtaaattgaaagtagtaatataatgaaaaaatctgggtgtaggggaagactgaggaaaatattaaaaataaatagcgactgggctgggcatggtggctcatgcctgtaatttcagcactttgggaggtcaaggcaggcaggtcacttaagcccaagagttccagaccagcctggccaagatggtgaaaactggtctctactaaaaatgtaaaaactacccgggcatggtgtcgcatgcctgtaatcccagctactcgggaggctgaggcttgaggatcgcttgaacctgggaggcagaggttgcagtgagccaagatcgcgccactgcactccagcctgagcaacagagtgagactccgtctcaaaaa

SEQ ID NO: 212859 - DNA, 161 bp, Homo sapiens
ctattctttcaatttatctacctgtccaaatttgttgttaatggacacaaaagacaaactttctcaattcttttctatctccctttgagaatccattcttaacataactttatatataaattttgatcccttttgcttgttttttttttttgagatagggg

SEQ ID NO: 212860 - DNA, 295 bp, Homo sapiens
tgagccaccatgctgggcctagctttggatcttcaaaatgaaactctacatgcctctgttatcaaggtggaaattctatgccatccgccatggtttgatcacaagatcctacctaaagtataattttaaaagaaaaatatggcattacacccactgctatttggaccaattactaaacagaatatacaaaattttgtgttaaatttttccactagaaactagactggggaacatttttaacctaaagtatatgtttaattgctggtataacaagtgctattttaagatgttatag

SEQ ID NO: 212861 - DNA, 393 bp, Homo sapiens
cagacgtgtgaaactaaatgagagacctctaacttttcttgagttcatgcattctaagaagtccactggagtggacttatcaaacatcaaagtgtcaggaagaccagcagaaatgttaacttgtcaagaaatttagtatccatgagaccaacataagaaaaattaatactgtgtgaatttagtggcttaattgtgcctggattagttaattagataattaacataagaatgtgcttttcatattagctttctgtatgttaataatagaactgttcataagatgagcaaacttgacattgagaagtgctaattatttcagaaatggaacctttcatttgctaaaatactttttcattgtctccctcagagaagtggcattgtaccctatttgct

SEQ ID NO: 212862 - DNA, 448 bp, Homo sapiens
aacatttgatgcagagatatacatgttttctccatgtaggttcacacctcacttcctttattgattaattgctttttctggtagagtctttctttcctttctgttttacctgtgtttgtccctaagacttatattttaatattatgcctcctctctttcgttctcccatcttttcttccacctattttggagccttcaggaagcttgattttgctgccttgtacattggttgcccttctggaatggaggaaacaggtcatagctgattttaactgttccatctggtgacatattcttgattttctttcttttggttggggaaaaaaaaacaatgcaaaagtcattctccaatggggttgagcctcgttaagaaatagaccctccacaatggttgaactagtttacagtcccaccaacagtgtaaaagtgttcctatttctccacatca

SEQ ID NO: 212863 - DNA, 1518 bp, Homo sapiens
tggggttgatcagaggaattttggaaaggcttggaaacattcctatgtatgtgagacacacctatgccagggcaaagactccaagctcaagtttttctcttgccttctagtcacaagaacatggctttggagtgtgacactggcctaggaatccatgactcccaaaggacggggctaggggtagaggaggttcaggcaaagcccttagattttggagacatcaggcagatgtctccaaaaatgattgtgatcaagaatctgaattataagattcacagtctgctccccaacccagtgctgccaactgtacagctgcgcctccacgaaggggcatatgccaggctcgtctgaccctggaatgaggatgtaggaagcaggcagagctccggttcagccctcacaatgggactgaagcaggagagaaggctgggcagaagggctgtggggaagtagggcttgtctccatggatgacgtccagaaggatgtcaggaggaggaatatcacaggagttatagacattggagggaacagagactggcacaggacctcttcattgcaggaagatggtagtgtaggcaggtaacattgagctcttttcaaaaaaggagagctcttcttcaagataaggaagtggtagttatggtggtaacccccggctatcagtccggatggttgccacccctcctgctgtaggatggaagcagccatggagtgggagggaggcgcaataagacacccctccacagagcttggcatcatgggaagctggttctacctcttcctggctcctttgtttaaaggcctggctgggagccttccttttgggtgtctttctcttctccaaccaacagaaaagactgctcttcaaaggtggagggtcttcatgaaacacagctgccaggagcccaggcacagggctgggggcctggaaaaaggagggcacacaggaggagggaggagctggtagggagatgctggctttacctaaggtctcgaaacaaggagggcagaataggcagaggcctctccgtcccaggcccatttttgacagatggcgggacggaaatgcaatagaccagcctgcaagaaagacatgtgttttgatgacaggcagtgtggccgggtggaacaagcacaggccttggaatccaatggactgaatcagaaccctaggcctgccatctgtcagccgggtgacctgggtcaattttagcctctaaaagcctcagtctccttatctgcaaaatgaggcttgtgatacctgttttgaagggttgctgagaaaattaaagataagggtatccaaaatagtctacggccataccaccctgaacgtgcctaatctcgtaagctaagcagggtcaggcctggttagtacctggatggggagagtatggaaaacatacctgcccgcagttggagttggactctgtcttaacagtagcgtggcacacagaaggcactcagtaaatacttgttgaataaatgaagtagcgatttggtgtgaaaaaaaaata

SEQ ID NO: 212864 - DNA, 917 bp, Homo sapiens
tgcagtggctcacgcctgtaatcccagcactttgggaagccaaggtgggtagatcatttgaggtcaggagttcgagaccagtttggccaacatggtgacaccctatctctacgaaaaatacaaaaatcagccccttttcacaagatggcaccaaaagctaagaaggaagctcctgcccctcctaaagccaaagcaaggctctgaaggccaagaaggcagtgttgaaaggtgtccacagccacaaaaaaaagaagatccgcgtatcactagccttctggcggcccaagacattgcgactccggaggcagtgcaaatatcttaagagcacccccaggagaaacaagcttgaccactatgcatcatcaagtttcctctgaccactgagtctcccatgaagaagacagaagacaacaacgcacttgtgttcactgtgaatgttaaagccaacaagcaccagaagaagctctatgacactgatgtggccaaggtcaacaccctgattcggcctgatggagagaaggaacatgttcgactggctcctgattacaatgctttggatgttgccaacaaaatagggatcatctcaactgagtccagttggctaattctaaatatatgtatatcttttcaccattaaaaaaaaaattatcaaggcatggtggcgcatgcctgtaataccagctactcaggaggctgaggcaggagaattgcctgaacctgtgaggcggaggttgcagtgagccgagatcacgcagctgccctccagcctggacaacagagcgagactccatcttgaaaaaaaacctgaaatatttctattggattctgaatacaaaatttcgcatgggagaaatcttacttcttatgcctgttacagtataattcccaaatgtaccatcagaaaaaaaaaaaaaacc

SEQ ID NO: 212865 - DNA, 859 bp, Homo sapiens
tgcagtggctcacgcctgtaatcccagcactttgggaagccaaggtgggtagatcatttgaggtcaggagttcgagaccagtttggccaacatggtgacaccctatctctacgaaaaatacaaaaatcagccccttttcacaagatggcaccaaaagctaagaaggaagctcctgcccctcctaaagccaaagcaaggctctgaaggccaagaaggcagtgttgaaaggtgtccacagccacggaggcagtgcaaatatcttaagagcacccccaggagaaacaagcttgaccactatgcatcatcaagtttcctctgaccactgagtctcccatgaagaagacagaagacaacaacgcacttgtgttcactgtgaatgttaaagccaacaagcaccagaagaagctctatgacactgatgtggccaaggtcaacaccctgattcggcctgatggagagaaggaacatgttcgactggctcctgattacaatgctttggatgttgccaacaaaatagggatcatctcaactgagtccagttggctaattctaaatatatgtatatcttttcaccattaaaaaaaaaattatcaaggcatggtggcgcatgcctgtaataccagctactcaggaggctgaggcaggagaattgcctgaacctgtgaggcggaggttgcagtgagccgagatcacgcagctgccctccagcctggacaacagagcgagactccatcttgaaaaaaaacctgaaatatttctattggattctgaatacaaaatttcgcatgggagaaatcttacttcttatgcctgttacagtataattcccaaatgtaccatcagaaaaaaaaaaaaaacc

SEQ ID NO: 212866 - DNA, 239 bp, Homo sapiens
gtgccactgcactccagtctggcgacagagcgagagtctgtctcaaaaaaaaaaaaaaattatctgtggtatagaatagattttatcctcacatattagctgtaataatcctcctttaggaactcctgtttttcttgcatttatattagcatgttttggttatctttgttggagtagagttgtcctcctttttttaagttaataaagtgctttttagaatatattttgattctagtttg

SEQ ID NO: 212867 - DNA, 211 bp, Homo sapiens
gtgaggattgaaggaatatatgtaagtacatagtcctaacacatcctggaagaatattaatactctattttggtcagaatgtaaactgtggtttggggcaagtgtaatgagaaaatgtaattattttatgtgtaattggagttggtagaaaaatagtgggttgagtatgtggagaagcagttgaaaatgaactggatggatctgagttaat

SEQ ID NO: 212868 - DNA, 405 bp, Homo sapiens
ttctttgacctcatgcctcttttgccttttgcctgcagttatcctagatcccactgactgttcttctcttacctacatcattctaggctgtctctggccccatgtctttatgtccctccctgactcttaccattacccttctggttaacattagaccaaacctgtggtgggcactgtggtggcaatttggaatcaacataaaacctaaaaagggtacaatggttatagtgctccagactactcttcactcagcctttaagggtgcaggactctaagactagaacagttctttgtacataataggtattcaaaactactagctgaacggaatgttctgtcatatatagcaggagtccccaagtccctaccgtggccaggaaagcaggaggtgaggggccagtgagc

SEQ ID NO: 212869 - DNA, 449 bp, Homo sapiens
gagagcagcttagtgatacttattttaccaacttgttcttcaagtcacagattcatgtccaatgtccctctcccaacttttaaacctttggccaaatgtgtcagcatttctgcttataactggcatatcacagggtgcaaaccatcttataaagtgacgtatgatagatttttttcctaagttagatcttttatcctagtcggcaacttatcaagacacagtgatcagttagtttttgtttttttgagacacagtctcatgctccagcttgggagacagagtgagaccctgtctgaacaacaaaaaagaattgtggccagtcatggtagctcacatctgtaatcccagcacttttgaggctcaggtgggtggattgcttgtggttacgaggtcaggatcagcctaggcaacatagcaaaaccttgtctctctacaaaaaagaaaaagaa

SEQ ID NO: 212870 - DNA, 426 bp, Homo sapiens
atgggcaagaatttacctttgatctatatctaggagtggaatcgctaggtattaggttatatcaacgttcaatattaggagaaaatgccaaactcttttccaaagtggttgcaccatttctacttcctccagtaattgtctctattgttgggcagcgtccaatccagtggaacataagataagctaatgaaatgatttaatattaccgatacataaatagggtgaataatgaaatggaagcttcaagatatgcctcttagggatgagaggacagtctccccctcagttgatattcattggtgttctgtctacatagatgtttctatttctctcctatatgtgcttctcttgggttcctctccatcttggtggctgtgggaatgttttaccctttaattcattggcaaaactaaaagcccctcccaa

SEQ ID NO: 212871 - DNA, 523 bp, Homo sapiens
acatgattatctcaatagatgcagaaaaggcctttgacaaaattcaacaacccttcatgctaaaaactctcaataaattaggtattgatgggacgtattttcaagaaactttacagtgatggagcttgttcacacagagcaagctctcagtccattaaaaaaagacaaaccctgagaagagagcttttcagggagcttccgaaaaggtcatatagtgacatttctctgggaatggatctttggggagctctaaacctgttctgccccctccagtacctggtaggctcttcattttcatagctaccctacttgcaaagctgttggttttcaaggctacttcagagctggggagagtgacatggaaatagagcaatttaaaacacaacagaggtaattattcttaccaaaattcagctatttttcttaaatgagtgctccttggattcttgcaaagttctgaaaaagttgatttcaacaactttctgccagtattctcattgcttttattgaggagcagattttt

SEQ ID NO: 212872 - DNA, 443 bp, Homo sapiens
atagctagtccagtatggctaggatgctggcctttgccaggattgaacaaatattatttgactacaaagtacttgtggcctgtgccgattaaattatcccacttgatcctcatgatattcctatggtagggaaaaagcttatccctactgttgccattttatagataggaatgtaagctacaatatgttgagtgattactccgggtgtccacttggtaaggggttgggacttgatcccaggtcattgagatccggtggccataatcctttggtgccacagcactggatcatataaggacgcatcctgtcacctttggagagcccacctgcaggtctggacctgggctttgtcaactgaaaacagaactgccctggagtgccgtgggtactcaacaagtagggaggcattgatgggccccacttttcaacataaaaagaaaaaa

SEQ ID NO: 212873 - DNA, 844 bp, Homo sapiens
taaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaatggagatgacttaagttggcagcagtaatcttcttttaggagcttgtaccacagtcttgcacataagtgcagactttggctcaagtaaagagaatttcctcaacactaacttcactgggataatcagcagcgtaactaccctaaaagcatatcactagccaaacgagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaa

SEQ ID NO: 212874 - DNA, 550 bp, Homo sapiens
gttcattgctgccctctccacgcactcctgctctacacagctccgctgcacgcataagtccaagctagtgtgtgtctccctttatccagacaagactcctcagggcgctgaccaggtcttagttatcctagcgtctcccaagctgggccctgcttgtgcgtaccaggtatctgaaaaatggctgctggaacaaaacagaggccggtcaagtggaggagattaaggttaataagtgacttcgtggagaaagtctaacatcaggtgagtggccctgcacggtggctcacacctgtaattccagcagtttgggaggccgaggtgggtggatcacttgaggtcaggagttcgagaccagcctggccaacatggtgaaaccccgtctctactaaaaatacaaaaattagccgggtgtggtggcacacacctataatcccagctacttgggaggttgaggcaggagaatcacttgaacccgggaagtggaggttgtagtgaaccaagatggcaccactgcactccagcctgggtgacagagtgagactccatctta

SEQ ID NO: 212875 - DNA, 487 bp, Homo sapiens
tcgaagaagtctccttccaaaggtttatgtgatttttgggaatatcctcaggttaactgtgctctgaagaaaggaaagaacggtagctcttcctccagttgatgtcagaagagaatactcgctggagtattaggccctagtgagagattggcagggatttgtgagccaaggtttgaatggtgactggagcaataaagttgggaaagagtttgagcttttcctacaaggggaaagaaaatggaaagtcgaggagagaaaaaccagaaccaattggaatggaacaaagagggatggttaccttaggcatatatggaatatagagaacatcaaggagtgatttgttaaagatgagtttaagaagagaagtagaggccaggcatggtggcttacacctgtaatcccaacactgggaggctgaggtgagaagattgcttgagcccaggagatccagaccagcctgggcaacaaagggagatttcgtctctac

SEQ ID NO: 212876 - DNA, 386 bp, Homo sapiens
gacagaaagtagtagatcagtggttgtatgaggcttcaggcaaaaatgcagtgcctgcaaatgagcatgagaaagcttttcggggtgctaaaaatgttctaaaacaggactaggatgatggttgcataactctgtaactacaaaccactgaattatacacttaagaaaagtgagtggctaggagccgtggttcatgcctgtaatcgcagcactttgggaggccaagacgggaggatcacctgagaccaggagttcgagaccagcctgggcaacaacaaagtgagacccccatctccacaaataataaaaacaataaaaaataaaatcttaaaaggtgaattttatggaatgtaaattataattcaattaaccttttatgaaaaatt

SEQ ID NO: 212877 - DNA, 553 bp, Homo sapiens
atattagctgggtgtggtggtgcatgcctagagtcccagctagacaggaggctgagatgagaggatcacctgagcgcaggagttcgaggctgcagtgagctatgatcatgccactgcattccagcctagatgacagattaggagacctatctcaaaaacaaacaaaaaacagtaaagtaatgcatcagtactacactctgttcatctttttgttgttgttttctattgctgctgaacaaattattcatcttttagtgtgcagttgtttttttattcttcagctgcttgcaaaaagtttgcctaagattgtagaatatatgataatctttgggctttgttcttgtttcttttgaatatttgtttacataagggatagttatttgatttaaagaagatagagcatgtaattacaaagttccctctgtgtgattaggtcttggaaatataatttcttatcataaattttgtgattttactaaagtctttaaacagccaaaaattttgaattaactatatttggggttgtactcaacttcacttttgaaaaaaaatt

SEQ ID NO: 212878 - DNA, 206 bp, Homo sapiens
ccaggtgatgtgaatactgttggtcagtgtatcacaattaagtagcaaggttgtagaaaagtccacattcataccaactgggtgaactctcaagggaagccgatgaaagtaattatggaaatagtgaatttacaatgaattgtagcccaaacaatgtaaggctaatagaagctaagaaaacaagcattatcctgctgtcctaacaa

SEQ ID NO: 212879 - DNA, 429 bp, Homo sapiens
tttagcatggctcttggtcagcacagtgcggacaactcagctctgttccagttgtctcatcctccagcaacttagcctgggcatgttttcatggcagaggcagaggtgcaagagtaagagaagaaacacaaaatgctcctgtcacaatcgctaattttatccttccatcttaatgttttgtttgtttgttttgagatggagtctcgctctgtcctccaggctggagtgcagtggcgcgatttctgctcactgcaagccccgcctcccgggttcacgccattctcctgcctcagcctcccaagtagctgggactacaggcacccaccaccacgcctggctaattttttgtatgtttagtagagacggggtttcaccgtgttagccaggatggtcttgatctcctgaccttgtgatctgcccgccttggcc

SEQ ID NO: 212880 - DNA, 966 bp, Homo sapiens
ccaggggaaggcggtgaacagaaccctcaccccgtcctgtctcggggtgcctctcctgaagcacagagtcccctctgggccttcgtttccccagctttcctgccgcggggcacacagagtctaggctcagtcagaagccccggcgccacctgaatgggagcctggggaaccctgtatggtcctccctgaacaggacagtggggatggggcagggccagggaagcagagaagggcacaccctgtgagggacaccacacgcaaccatgcagcctgggatgggcactgtggtgctctcgtcgccaggcccccatgtctgccctcgcagtcaaccttggtccctgggggatcgcctgcaatcccacgacgcctgggcagcataactgtcatttatcacatggtcatcgccggagacgccgagcggagcccccaaacatcctgcacctttgatgttcacgcggactctgtgaggcaggtgctgttctcatcccgttttacagacgaggaacctgagacgcaactgcaggccccgcagcagccggtacttggctgtcctaacccatccgctctggtgcagacaaagtggatatctgtctaacatgcaaaaggagggttctgaaacaccctacctgccaggaaggtttctagagaggagccggcccactccaccccaagctggccactccgctcacggggcctcaggcctcatccccgccacctggtgccctgtgcccagcctgatcgttgttggtcttacccactgattcttttagatggaagcgggatcttgctgtgctgcccaggctggtctcgaacccctgggctcaagcaatccttcttccaggacttcccaaagtgctgggattacaggcgtgagccaccgtgcccagtcagaactaactactttaaaatatcagggtgggtgccatggctcatgcctgtaatcccagcactttgggaggccaaggc

SEQ ID NO: 212881 - DNA, 113 bp, Homo sapiens
agggaatgtgagggagaccttttcactatttaccttcttgtttctcttggtgtgttggacagaatgaagggtaagagagataggagactgggatcagttgggaggtgactgac

SEQ ID NO: 212882 - DNA, 138 bp, Homo sapiens
atggggttgtgcaaacagggtaatgaatggggagaaagttgagaggaattacctggaccactgatctaaacaggggcccaggatctgacacgtatcaacacaaatttttccttgctggggtcccaaaaaacatttttt

SEQ ID NO: 212883 - DNA, 231 bp, Homo sapiens
aaggaaggtagtatgacctgcttcggcttcagacatattaggtttgaatgctggccaacttcacaggtaggaaaagtcagctggatttgtggaaccagagctccagcacaagtgagggctggaggcaattgtttgggagttatcagcaagatggtgacccctaaagtcacgagacggaaagaggatcaccaccagagaaaaggcagacctcacaaaacaccttagatagaa

SEQ ID NO: 212884 - DNA, 375 bp, Homo sapiens
gcattgtaagtcttaaaactgggaatgtaagtcctttgacttttttctaatccaatactatgaacaaaatagatggcagatgaaattgaaaatttcctagaaaggtgcaaactactcaaactgattcaacaagaaatagacaatgtgaatagatatataacaagtgaagaggttgaattagtaatccaaaaacacccataaagaaaagccaaggaccagagagcttcccagctaaattctaccaagcatttaaagaattaaaaccaattctcacaaactctttcaaaagactaggagagtgggaaatgcttctcaattcattttatgagaccaatattactctgataccataatcagacaaagacattgccaaaa

SEQ ID NO: 212885 - DNA, 149 bp, Homo sapiens
aaaatttggaactgatttaacgtgtaaaatgttaacagtggttatctttaggaggtggaaatatgataatgtttcagttctgttttcctatattttgcaaaatttctttaaagtacttatattacttttataataacaaaaatactttt

SEQ ID NO: 212886 - DNA, 131 bp, Homo sapiens
cccccgacaccatgacctctgctctggccatcttattatctcatactgctcagagcatactgtgccttctctcaagccccagaccacacaagctgttctctctgtctggaatgttcttcttcaccaagcac

SEQ ID NO: 212887 - DNA, 457 bp, Homo sapiens
agacagagtcttactctgttgtacaggatggagtatagtggcacaatcacagctcactgcagcctcaactgcccaggcttaagtgatcctcccacctcagcctcctgagcagcttggaccacaggcgcttgccaccatgcctggctaatttttaaaaacttatttgtagagacaaggtttcaccacgttgtccaggctgttttcaaactcccagggtcaactgaccctcctaccttggcctcccaaagtgctgggattacaggcatgagccaccacacccagccagttttctacatagtgaaaaggagttgtcagggtcaaaagttctcaacagtcagaatattatgagcttgagggtaagagacagtccaaatgcaaagacaaaacaatgctatgagggtgagacaaaaattgggttcctggaggagagccatcatctgcagaatccaccttaact

SEQ ID NO: 212888 - DNA, 501 bp, Homo sapiens
taggacacacacagtcccatcccccaccctctgaccccatacaccccctggatactcaaatccactgatgctcaagttccttgcataaaatggtatagtgtttgcatgtgacctatacacaacctcttatgtgtactttaaatcatctctagattacttatattacccagtacaatataaatgttatgtaaatggttgttatagtgtattgtttagggaataatgacaagaacaactttctatacatttgcagtacaccattgttttacccccaaatatttttgatccaaggttggttgaatcggaacccagagatacagagggctgactatactttaagaattagaattagctgggtgtggtggtgggtgcctgtagtcccagctactcgggaggctgacgcaggagaaaggcgtgaacccgggaggtggagcttgcagtgagccgagatcgtgccactgcactccagcctgggcgacagagcgagactctgtctctaaa

SEQ ID NO: 212889 - DNA, 512 bp, Homo sapiens
actttataatgccattagtagaaacttaacccttgatttttagcctttggctttacaatcatatattgcaattgtttcttatatgtgttctctccacagattggtcaggccattctctctatagggattgggaatgatatttttatttgtatgtgcctcaaatgcccaattttattgcacatacatttatttaatatttgcttgacttgaatacaaaggtaaatatttgcttgacttgaatacaaaggtaaataaaacttggcattaaggacttgtctaatgtgggaaaatgataaacaatggagtatgtataatgaattattgttgttatgccagaagtggttagagggtaccatggatcacagtgaatataagggtcaagactctcagagaggtcagacaaagtctttacagaattagcaatccagtactcaggaggctgagaggagaggatcacttgagcccaagagttcaggtccagcctgggcaacatagtgagaaccccgtcaata

SEQ ID NO: 212890 - DNA, 292 bp, Homo sapiens
ttgtttctttgtgattcttttttatgtgttggttcctgacacacaagttgatttggggtggataacttgagatgcataaatgacatgtacagcagtggcacacccttggtgatcattaatatgttgctctgccatcaagtgccttgctaagttcttgttccccagaagcagattctaagacaaggatgtgggtgtgtatagtttatttaggagttgatcccaggaaacaacagtagaggatggggaagtgagaccaggaaggaaagatgaagctcaaaacaggtcaaaaaag

SEQ ID NO: 212891 - DNA, 539 bp, Homo sapiens
ggccacactcttcagagtcaaccatccccagtggcttcagggcaattccccctaatgcccaggaggccagacactggggtctcctacaagtgagggtttccaggaagcacggcagggaacctcaactggactgcgtcctgggggtcagcacccagaactggagttttcaaggcttaaagcagggaacattcttctgggggcaagagctcaccttaggtaaatcatataaaaacccgaggcaggaagagggaccaggccacctcctgcccgatatgaaggacacccacgccctctcaagagacctctgagcccccgatgtgggtggtgggtccaaaaccttccacaatcacggcggggctcatagacgtttttgtctgacaacaccaatatttggatgatcatctcaaatgagctcatcacagctgaaataatctatttttagtcttttcccttgagtactgctcgtattttcctgtttttttttttttgtataatgagtaattttggactgtctattagacattttgaataccatgttc

SEQ ID NO: 212892 - DNA, 322 bp, Homo sapiens
aggtaagtgaggactatagaagccaacagcaattctatctaaagaagggtgagggaactcagcaaggcagtggaactgacagagggctgtaaacagagttcaaacaccttccccaacctcagagaggcaaattccatctcagctaaatggttttcaggaaaataatataacctgcctgtgtctcaaaactggtaagtggcatcctcttcctcagagctatttagctgagatgccagaagatgcaaaatctgaaaatttctttaattagtatccttcttcttggctttatcaactgccgagatttctgtgctcagggccgtgt

SEQ ID NO: 212893 - DNA, 336 bp, Homo sapiens
aagtgctgggattacaggtgtaagccaccgcgcctggcccaaagcttgtcatctttatccctcaagtccctcaccaaaaagctaaagcaaaaaaataaaataatttaaaaaaaatggttcagaatatcagttgctattaacgttggtcatgtcacaagcatttattgaatacatcttccttcagaaggaactcactgggctttgagagccgtcagcactcttgctttactatttgcttagactaggaacttaaggctggcaccttaaaacccccagcggaaaagaggataacacatagagaaagtgaggccgagtctcctctacaggctatggctg

SEQ ID NO: 212894 - DNA, 192 bp, Homo sapiens
ttcccaccaggaatgtgcatggggtccaggcaatctgcatctgcccctttgcttggtgccatcagatgtcaccactttttcccacttaaatgacagtaaaatgttatctctgtgatttggacttgcattttcctgatcactaaggatattcggcctctgcatatatttgttggttatatgttccattttttt

SEQ ID NO: 212895 - DNA, 1696 bp, Homo sapiens
cttgccagcgttgggacgcgcaaatcccgcatcagcaccgatttacgccagaaaaatacgcgtgcaagtgaggtgggggggcgggcgttgggacgtgctgctgcgggtgagacgggaggagggtagtcacgggcttagggctggaggctggcgggctagggctgagtgcagcgcctgcttagagaccttcgggagaacttctgccggaaccccgacggctcagaggcgccctggtgcttcacactgcggcccggcacgcgcgtgggcttttgctaccagatacggcgttgtacagacgacgtgcggccccaggactgctaccacggcgcgggggagcagtaccgcggcacggtcagcaagacccgcaagggtgtccagtgccagcgctggtccgctgagacgccgcacaagccgcagtgagtccctggtgctcctggccccgccagggccctaaccctggggcggcatgctttgatgtctgggaccagagcctggaaatggttgagactaccctgccacgacttcgctcccgctcccgcctcggttcacgtttacctccgaaccgcatgcacaactggaggagaacttctgccagacccagatggggatagccatgggccctggtgctacacgatggacccaaggaccccattcgactactgtgccctgcgacgctgcgctgatgaccagccgccatcaatcctggacccccccagaccaggtgcagtttgagaagtgtggcaagagggtggatcggctggatcagcgttgttccaagctgcgcgtggctgggggccatccgggcaactcaccctggacagtcagcttgcggaattggtgaggcacaactgcctgtctcccacagagaggagctgaggcagggccagcatttctgcggggggtctctagtgaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagagatctgtgaccctgaaccagcgtgtggccctgatctgcctgccgcctgaatgatatgtggtgcctccagggaccaagtgtgagattgcaggccggggtgagaccaaaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaactgagtatgtgcaaggtcgcgctggccagccgtcttcacgcttgtctctgtgtttgtggactggattcacaaggtcatgagactgggttaggcccagccttgacgccatatgctttggggaggacaaaacttgtaagtacagtcaaggacaagacttgtactcaaagttgagatttaataaaattaatatttttactacttcaccaaggactttcttaaatgaaaatggtttttccccctacaagtaaacagtaataaagaagagaattattccta

SEQ ID NO: 212896 - DNA, 1050 bp, Homo sapiens
actgggggctgggcacgagcctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaatggactgagagtcactgacctagcagagcttctctcccagccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagagatctgtgaccctgaaccagcgtgtggccctgatctgcctgccgcctgaatgatatgtggtgcctccagggaccaagtgtgagattgcaggccggggtgagaccaaaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaactgagtatgtgcaaggtcgcgctggccagccgtcttcacgcttgtctctgtgtttgtggactggattcacaaggtcatgagactgggttaggcccagccttgacgccatatgctttggggaggacaaaacttgtaagtacagtcaaggacaagacttgtactcaaagttgagatttaataaaattaatatttttactacttcaccaaggactttcttaaatgaaaatggtttttccccctacaagtaaacagtaataaagaagagaattattccta

SEQ ID NO: 212897 - DNA, 1796 bp, Homo sapiens
cttgccagcgttgggacgcgcaaatcccgcatcagcaccgatttacgccagaaaaatacgcgtgcaagtgaggtgggggggcgggcgttgggacgtgctgctgcgggtgagacgggaggagggtagtcacgggcttagggctggaggctggcgggctagggctgagtgcagcgcctgcttagagaccttcgggagaacttctgccggaaccccgacggctcagaggcgccctggtgcttcacactgcggcccggcacgcgcgtgggcttttgctaccagatacggcgttgtacagacgacgtgcggccccagggtgaggcccaagcttgggggctacagagccggggctggaagcctggaaccggagggccggggcgaggtctcggcctgatggctgcccgcaccggccgcagactgctaccacggcgcgggggagcagtaccgcggcacggtcagcaagacccgcaagggtgtccagtgccagcgctggtccgctgagacgccgcacaagccgcagtgagtccctggtgctcctggccccgccagggccctaaccctggggcggcatgctttgatgtctgggaccagagcctggaaatggttgagactaccctgccacgacttcgctcccgctcccgcctcggttcacgtttacctccgaaccgcatgcacaactggaggagaacttctgccagacccagatggggatagccatgggccctggtgctacacgatggacccaaggaccccattcgactactgtgccctgcgacgctgcgctgatgaccagccgccatcaatcctggacccccccagaccaggtgcagtttgagaagtgtggcaagagggtggatcggctggatcagcgttgttccaagctgcgcgtggctgggggccatccgggcaactcaccctggacagtcagcttgcggaattggtgaggcacaactgcctgtctcccacagagaggagctgaggcagggccagcatttctgcggggggtctctagtgaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagagatctgtgaccctgaaccagcgtgtggccctgatctgcctgccgcctgaatgatatgtggtgcctccagggaccaagtgtgagattgcaggccggggtgagaccaaaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaactgagtatgtgcaaggtcgcgctggccagccgtcttcacgcttgtctctgtgtttgtggactggattcacaaggtcatgagactgggttaggcccagccttgacgccatatgctttggggaggacaaaacttgtaagtacagtcaaggacaagacttgtactcaaagttgagatttaataaaattaatatttttactacttcaccaaggactttcttaaatgaaaatggtttttccccctacaagtaaacagtaataaagaagagaattattccta

SEQ ID NO: 212898 - DNA, 1630 bp, Homo sapiens
  misc_feature (1595)..(1595): n is a, c, g, or t
cttgccagcgttgggacgcgcaaatcccgcatcagcaccgatttacgccagaaaaatacgcgtgcaagtgaggtgggggggcgggcgttgggacgtgctgctgcgggtgagacgggaggagggtagtcacgggcttagggctggaggctggcgggctagggctgagtgcagcgcctgcttagagaccttcgggagaacttctgccggaaccccgacggctcagaggcgccctggtgcttcacactgcggcccggcacgcgcgtgggcttttgctaccagatacggcgttgtacagacgacgtgcggccccagggtgaggcccaagcttgggggctacagagccggggctggaagcctggaaccggagggccggggcgaggtctcggcctgatggctgcccgcaccggccgcagactgctaccacggcgcgggggagcagtaccgcggcacggtcagcaagacccgcaagggtgtccagtgccagcgctggtccgctgagacgccgcacaagccgcagtgagtccctggtgctcctggccccgccagggccctaaccctggggcggcatgctttgatgtctgggaccagagcctggaaatggttgagactaccctgccacgacttcgctcccgctcccgcctcggttcacgtttacctccgaaccgcatgcacaactggaggagaacttctgccagacccagatggggatagccatgggccctggtgctacacgatggacccaaggaccccattcgactactgtgccctgcgacgctgcgctgatgaccagccgccatcaatcctggacccccccagaccaggtgcagtttgagaagtgtggcaagagggtggatcggctggatcagcgttgttccaagctgcgcgtggctgggggccatccgggcaactcaccctggacagtcagcttgcggaattggtgaggcacaactgcctgtctcccacagagaggagctgaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaatggactgagagtcactgacctagcagagcttctctcccagccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagagatctgtgaccctgaaccagcgtgtggccctgatctgcctgccgcctgaatgatatgtggtgcctccagggaccaagtgtgagattgcaggccggggtgagaccaaaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgagggtgattacgggggcctattgnctgtttaccacaattgttggtctgaaagaattaga

SEQ ID NO: 212899 - DNA, 319 bp, Homo sapiens
tcagttaaatgaaaatatgtttgaatttctacttctacctttggtcattcattcatatgttacaggtacttatcaagttatatttcctaaaactcaaagtcttactgtaatttgattcttttcctgccttcaaatagttatgaactatatttacaactttgcttttggcatatataccatcgtaccagccatgtgtcctgtttgtgacttaatcctttgcaagatttagcaaacattttctgtaaaggggcagatagtaaatattttaggctttctggaacatagtttctgtcacaacaactcaaccctgctattgcag

SEQ ID NO: 212900 - DNA, 441 bp, Homo sapiens
taccgcggagtatgaattgctgcaaccttttagaaaagaatctggcaatatttagggaaataaaaaatacagatatcacttgaacaaaaactggaattcaaaagtctgacttttaagaatctatcctacagaaataaaagtaccagtatataatgacgcatgaacaaggatacttttgtactattttgttcttgtgacaactggaaacaacctgtgtatccatcaataggagaatgtttgagtaaattttggtacataaatattatgaaatattttgacttttgacctagagaatcttatgattttgatggggtgatgaaggaatgcaagattaacttctttatcttttggaggagacgttaaatatattatgaaatacttaagacatatacagatatacaaggaataatacaatgaacctctcttctcaccacccaacgt

SEQ ID NO: 212901 - DNA, 353 bp, Homo sapiens
gcgctgggataacaggcgtgagcccccgcgcctggcttcttaattgttctaacagcagccacaacaacaaaaacccagctctgagattccagccccggcgactctaacagtcccaggcccgatccctcacctagaaccgagatgccagccctgactccacagacttcacccccaacccccacactcagctctggaagcccgtcctgactccagcctccattttcggaaccccacagcctgaagagctcccggcctaaacacttcaccccacgcgccacagtccccctgtgaatatgcagccccgattcagctgcagctccacagcacccctgccctgcacccccgctgcaccc

SEQ ID NO: 212902 - DNA, 1707 bp, Homo sapiens
  misc_feature (37)..(37): n is a, c, g, or t
atagttggacactactcacagctactacacagagacnccgaacgagctgatatacacctggaccaccaccaatgtatatacacaagcaaacattccctggctttcttctgaaagagtctagaagcactgacaccctcatagcagtgagcacacatagcttgatttttttttacacattcctttttttagacatttagtaaccatgctttcctcagaaaaatgactgatttcaagattgaggcaaggaaggtacaagatgaacctggaacatcctggattgctcgacactaaggaagtgctttaaaaaaagatgggggcatttcatagagagctaacttgaaaggactcacattggccaaatctgggacaattttgagttgtaaatatttaaggacaggaatgattataaaccgttggaaaaaataggaattcttggaaccatattgataattaatggataaacaactaggggaaaggggaagtcatttcctacagagcaaagatgagtggtaaatgtagaggatatgttggagttggaagtcttcattttgcaaccatgttcatagtaaggattggttcaccaagaatcatgaatattaagtctaggtggaaaattgaagagcatcatcttgcatgatttttaagtgtttctctatagagtgcttctgcattgcaaggaaagtggagaaataggacagtatctccaaattaacatcaccaatgaggagtaaatggagatcgtacacattgggctatgatactctgatggacccaacaccacttaacatgccatttggttcaggaatgtaaaatcttagtctaattgtgagggaacattagatgaacccaaaatgaggaacattctattttaaaaagattttgaaaaaagaaaaatttgcagaagtttgggggcatattaaagacacaggagccaactgaaagagttcccaactggccaagactggaacaatttgaacaccaaaataaaataatattggattgtaactcagagtacaaaataaatatccttgagttcatactggtataaataattgattggatatataaattaatgggatagaagggacaaatcccctgtgcagaattctaaatgtatatagatactccaccctcaaggaggtgaagctaattcccactctgtaagtgtgtgctgcacatagtgtgttcctcccagagagtacagtgcacagagaggggaaaggagtgatgttacagtgcagcagcccgactgacactgtctcagccaggtggtgaaggttaacatccacaggctaagccatactggcgtatatgtactcctgacatgatgtgatgacagtggcactttacctctctggtcttcctcccagaaatacataacccagcttaatcatgaggaaaacatcagataaaccataattgagggagtttttatgaaatacttgaccagaactcaaaactgtcaaggtcagtaaaaacaatgaaaacctgagaaatgtcacagccaagggagcctagaaacatgacagctaaacataatgtggtatcttgaaggggatcctggaacaggaaaatgacattagataaaaactaaggaaaccgcgtacatacatacatgctgacagcattattcatgacagccaaaaaatggaacaaacccaaatgtctgtcagtgatgaacagataagacaaatatggtctgtccat

SEQ ID NO: 212903 - DNA, 523 bp, Homo sapiens
acaatcttgaaccctattattatctaagcttggtttttgtaatgatacgggtacagcaattgtgaaactcttttagatgtattattggttgggtgaagtgagtaactaaatatgttggtggtgttggaagccagaatttcttactgtggaagtgagatgcaaatatgaaataaaggaaggcaaggaagaacgcagtggcaatgaattggaattggaggtattggtgtggacttacgagtttttaaaatatggataggtatgtgggtatggacatagtaactatttgtgtatatgtatatacacaagcaaacattccctggctttcttctgaaagagtctagaagcactgacaccctcatagcagtgagcacacatagcttgatttttttttacacattcctttttttagacatttagtaaccatgctttcctcagaaaaatgactgatttcaagattgaggcaaggaaggtacaagatgaacctggaacatcctggattgctcgacactaaggaagtgcttta

SEQ ID NO: 212904 - DNA, 446 bp, Homo sapiens
catgttgagttaaaaaaaaatgcaaagcatggttcctgcttgtgtcaggcgccttgctgcggcctcaaagcaccaggctgcttctcagcacgaggatatttgcaaatgtgattgtgctttctctgcgaagaatgcccttctactctttttctcttcaaaatccaatgttagtgccttcctaatccctattcactctttaaaatttcacgtggcattatccctcttccagaatgcctcttataccatcctattaaggattcaccatagcacccaaggcacacttttatctcagcactttgcgcatctattttattgactgctccatttttctgttttccctggaaatttgcactttgtatctcaggcctctgccacggaacttggggcttaggaagtgtccaactgatgtttgaaaattaataaatgaatgaaagaataaatcttat

SEQ ID NO: 212905 - DNA, 433 bp, Homo sapiens
ggtgcagtggagagcgggctgaaattaagcccttaatgacatggggtggtgaaccagtaaccagtccccctgcgcccaggcaccacgggacttccaggggacagtgcaggaagctcttcagcacatggttaaaaatcactgatttagtccaacctccttgtctcacaaatgaggaaagcaaaggatgctcagtgtgaagccacccagccggtgttcagtggaggtttaagtctcctataacaaaagatagacattttctcactgattccccaacagccatataaaatagcatttattacaccacgcccatttttagagataatcaaacattgcttttccaaggagccttcttctgacaacccagagtaacttaagtgtcccacatattcatttaatactttgtccttctctacttgacatccttatcagattg

SEQ ID NO: 212906 - DNA, 493 bp, Homo sapiens
tggtgtttcctctgcagccatctggtccctatcccaacactggggcgccactcacagtcctccccatggaagtcacacagaagggtgctgtccaggtgggtgcaggcagtggccctgtgtctctgtgacccatagcatgactaggctctgtacacagccaccttctaaacaaccagtagtttgggaagagctgaatatcttctcagcggagcagctgtaggagacaaaaactcagccccctttcaaggggaggtagcttctcatctaaaaaagtccaagctgctatatcactcttacctgagccaaatacccagcagcaccaaccagggcaattcaagatttcctcacctatatgtggggtgaccattaataattacagcaaacaattagttatcgagggcttcctgcgtgcagatagtcttttaagtgctccctgtagattagcttattgcattttcttggtaaccttatgatgcaaatacaaccatagcct

SEQ ID NO: 212907 - DNA, 310 bp, Homo sapiens
gccctggggaatcctcactactcctgaagagcctggttcctgttgggaatacctgggagaacatgacacctttgggggccagtggggcagagtgtagaaacagaaacgtaaccctccctactcatggacacctcctgccaatcagcccttgcattgatgcccaggatttcctgagatttctttctgctcagcacagccataatctagtgggccagctgcactccaggaacctgcgaaaggagagacagatggcagccagactaaaggacacggcccaccccagctctatgtctgtccttgccccgggctt

SEQ ID NO: 212908 - DNA, 390 bp, Homo sapiens
aagaacatccggggtagagatccaaggaccagagagaaaacctaactggtcaaggtcacgtaaaattcaacaggaaacactatatattctaactgataatactagatctaggtaaatagaactttaagagattttgctacacaacagcattaaacttaggtaataatagcatcagactggctgagcatattaagagctaattctgtttttcataaggaagacagcagaattcctaatcacaggctctaatgaattgtattctcttcattatcataaagctgtgttacatcttgatattcatgagtgagtcttctaatccaaaggaaggaataaaaaacaaaggggaaagaaaaggaaggttccccgtgaagttccagggtaccgagctcg

SEQ ID NO: 212909 - DNA, 374 bp, Homo sapiens
aaatacaggtgcgatttaataatcttgaatttcaaacctgattttaaaataaatacaaaatctggacttcttagccagtgctgtggactgaatgtatcccccccaaaatacatatgttgaaattctgaccctgaaggtgaaggtgttggtaggtggagcctttgggaagtgattaggtcatgagagtagagccttcctgtttgggattaatgctcttacaaaagagacctgaatgagatccctcatcccttctgcatgtgaggacagagcaagaagatggtcatctaggaaccagaaagcaggccctcaaatctgccttgttcttggacttcccagcctccagaactataagaaataaatttctgttgttttta

SEQ ID NO: 212910 - DNA, 278 bp, Homo sapiens
cctgagaagacttaccaaggcggctccaagaaatgattggtttgggatttcctgtggccatgcattccaaaactacagtctgatgaagagatgttgttatgttctgtggacctgctataattgttgccttaaaggatatgttagaaaccagtatctcttgtgaagaataaacatttatgtgaagttcaacaatgtcttcagtccaggttttcttctactacatttaaacaaacttaacctttgaaataaaaactatcatctattgcattttaatgaaa

SEQ ID NO: 212911 - DNA, 875 bp, Homo sapiens
cctctgcctcccgggttcaagcgattctcctgcctcagccaccagagtagctgggattacaggcatgcgccaccatgcccagctaatttttctatttttagtagagacgggatttcaccatgttggtcaggttggtctcgaactcctgaccttgttgtgatctgcccacctccgcctcccaaagtgctgggattacaggcatgagccaccgcgcccagccctgactttcctcattcttttaacagcttcacatacatagccaacattcccctaatttctcagccaccttgcctcaagttaaaaccatgagaccggttttgccaaacagggtgtaagtgtaatgtatcactttcaggccaaaccacttaaaactaagtgtgaccttcttgcttgtttcctttgcaataatcagaggcccatttttgagatagagaaaccataatatggaagcccctccatctctgagttaccacataagcatcagttgccctacagggtcaactatcccagtggtgcaattgacagaaaagactcattttatacagtaagcttccaggatttaacaaaaaaggttttgtatctccgggcaccacaggacatgccattccttacaagacttttaaaagcaaagcctagacagctttagcaataccctctttcttgacaaactgttagagatctaggcctgaagggcaaggaaaggacaataaagtctgtctttctacatcatttgcttctcagtgatgctcatcaaattgctatcaatcactgtgtcatgtttccactgccaatttttttagatattcacaatacagcccccaaaccccaacctatcctgtgtcttagtccattttttgttgctgtaacagaaaacc

SEQ ID NO: 212912 - DNA, 1047 bp, Homo sapiens
tggaaggccctctttaacagtaggtatttgaagtgttataaaaaaaaaaaaaggtgaatttttcttttatttctcagtttgaaagaacagctttattcttggttattcctaatgtccacctagtcctcttttacttttcttggtagggttagggtggcatggggaaatgggacggtatcattttgtctttttaactttttttttttccacctacagcagctgtttttaccctgtggtcagtcaggtactatatttagtttgcagttgcactgctgatcgacccttgatggccccagttggaagttgtttggggggaaggaactaggagaggccagggcctccatttaaaccagtgtctgtaagtgtctccttggaaggaaaaaaagatactgttccaggtcatggtttcctggtagttgacgtttaaaatgggcctcatttaaaaatttcaataattcaggctaattttttccctttatatggtaactccaccaagtttgtctaaatgtatgatttttatcatgattaagtttttacttccacatcatgtgacaactggcctgggatgggatataagctcagaacacaaagtcattcacctgttaaaaaaataattctatctgtggcgggttatgttatttttgttcaaagaggacacaatatgatgcagaatacaccattgaaggattttttggtttggcaagttcttatttttttaaatggctgtaaaacctagcagtgtttctgaaattgcataccttacctgatgttcagagatccgatttacttcttgatttcccagcaagtgattttgaaaacatttaatctaatcattccccccaccgtctgttcaaatcaaaggaagtggcatccagcactaattttcatgcatttatgaaaggatgcctgaggacccttaagtataattcaaaattttgtttaatgtgtgttccttgatgaagttctttaggagtcgtagaacgaactgattgcccactgatcatcaaatgcaagttatgaacatttaataaaaatttaaaaccaaga

SEQ ID NO: 212913 - DNA, 1007 bp, Homo sapiens
  misc_feature (585)..(585): n is a, c, g, or t
  misc_feature (587)..(587): n is a, c, g, or t
  misc_feature (591)..(592): n is a, c, g, or t
  misc_feature (597)..(597): n is a, c, g, or t
  misc_feature (605)..(606): n is a, c, g, or t
  misc_feature (614)..(616): n is a, c, g, or t
  misc_feature (624)..(624): n is a, c, g, or t
  misc_feature (626)..(626): n is a, c, g, or t
  misc_feature (642)..(642): n is a, c, g, or t
  misc_feature (650)..(650): n is a, c, g, or t
  misc_feature (657)..(657): n is a, c, g, or t
  misc_feature (680)..(680): n is a, c, g, or t
  misc_feature (691)..(694): n is a, c, g, or t
  misc_feature (697)..(697): n is a, c, g, or t
  misc_feature (699)..(699): n is a, c, g, or t
  misc_feature (701)..(701): n is a, c, g, or t
  misc_feature (703)..(703): n is a, c, g, or t
  misc_feature (708)..(708): n is a, c, g, or t
  misc_feature (712)..(712): n is a, c, g, or t
  misc_feature (714)..(714): n is a, c, g, or t
  misc_feature (720)..(722): n is a, c, g, or t
  misc_feature (724)..(724): n is a, c, g, or t
  misc_feature (728)..(729): n is a, c, g, or t
  misc_feature (740)..(741): n is a, c, g, or t
  misc_feature (744)..(744): n is a, c, g, or t
  misc_feature (750)..(752): n is a, c, g, or t
  misc_feature (756)..(756): n is a, c, g, or t
  misc_feature (765)..(765): n is a, c, g, or t
  misc_feature (767)..(768): n is a, c, g, or t
  misc_feature (771)..(773): n is a, c, g, or t
ctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttnanaaanntgganaaaaaaannaaaaaaannnaaaaaaananaatttaaaaaaaatgngtaaaaanaaaaaanaaaagaaaatgggaaaaaaacanaaaaaggtgannnnagngnananaaaanaggnanaaaaannnanatgnnaaaaaaatgtnnaanaaaaannnaaanaagggaaanannaannnaaaagcctgcaactgtaggactttcctagtaaagctgttgtatttcctatatgtctgtactcttcctgtgaaatttccatcctttttgtgtgtcaggaaagtaggtactgccattgttttgagtggaagggcattgacaagcacttgggtcactgacattgagttctcaggtaaatgaccggcggattgtggatgggatgtttcctgtctgtggcattctatagatgtttctaa

SEQ ID NO: 212914 - DNA, 214 bp, Homo sapiens
caggtaaatctatgcaccctgaacacacaatgcaggctaagctgggggaaatagtttcaatctttgaggttcttggtatgggatgttctacttagttccccatccccaagctcaatgtcagtccacagaataaatttctgagatagaaattaaaatgagttaaaattcttatctgtgtctgtgagttttatatacacagaggagtgattagcat

SEQ ID NO: 212915 - DNA, 317 bp, Homo sapiens
agggtcgggggtggctggagcacatcctgggggcaatttggcaacagctctcagaattaaaaccgcacagagcctcttggccaacacctgccctgccaggagctgacctgggctagaaggagctcaccgtgttggttatgatggcagataaacccggcaataacctaaacatcagccggccagaggccggttcaatgcaatacagccacccacacattggaacacccagtgaacttctctctctccctccttcccagtctccatgcttccttcttgaatatttcagcccaaagccatcaggttggggaagaaaggta

SEQ ID NO: 212916 - DNA, 664 bp, Homo sapiens
aggcgtgagccatcgtgccgggtttttgtttttttttttttttttttaagagatgaagtctcactatattgtccaggctggtctcaaactcctggcctcaagtgatcctccacccacttcggcctcccatagtgctgggattacaggcatgagccaacgcacccagtctgcaagtggatttttaaggaacaaagaagagagagttcctaaattgttaccaagaatttacattgaaacagcataaggtatctgcaggtctggctcagaaaaaaagataacagaaggtattgattggctatgcactgtttattgtatcacaaattccaggaacaagaagctaatggggagggcagctgtgcaggaaccactgcctcgggcatgggtggaggaggcgtgtgaccgaagtcccctattcactgtacagtctccctgggcctgatacatttcgcatagctcagactgatctgagctatttttcttttctcaagttgggtgggggtggcccctctggactggaaaagcctcatttttcccccaagtgacacacctgagtttgtttgacttgtttcccccaagtgacacacctgagtttgtgggacttgtgtggagatgatgtatttatgtcacacttcagtcttcgctgatggctcacctttttttatat

SEQ ID NO: 212917 - DNA, 660 bp, Homo sapiens
ttgcggtgagcatcgtcgggtattctggtatggtttaattcttaaaagatgaagtctcactatattgtccaggctggtctcaaactcctggcctcaagtgatcctccacccacttcggcctcccatagtgctgggattacaggcatgagccaacgcacccagtctgcaagtggatttttaaggaacaaagaagagagagttcctaaattgttaccaagaatttacattgaaacagcataaggtatctgcaggtctggctcagaaaaaaagataacagaaggtattgattggctatgcactgtttattgtatcacaaattccaggaacaagaagctaatggggagggcagctgtgcaggaaccactgcctcgggcatgggtggaggaggcgtgtgaccgaagtcccctattcactgtacagtctccctgggcctgatacatttcgcatagctcagactgatctgagctatttttcttttctcaagttgggtgggggtggcccctctggactggaaaagcctcatttttcccccaagtgacacacctgagtttgtttgacttgtttcccccaagtgacacacctgagtttgtgggacttgtgtggagatgatgtatttatgtcacacttcagtcttcgctgatggctcacctttttttatat

SEQ ID NO: 212918 - DNA, 471 bp, Homo sapiens
aaatattttggggtcaattaatcaaatattttactcagaactcacctgtctctttctgccttgttgctgttttgatgaggttattgagagataaagtgcatgtgtgtgtgcgtgtgtgtgtgtaagagagagagagagagaatggaagcaagcctaaaattgggagattatgcctaaaactataattacttttatagagcaagtcaggaaaaaatgacaagaccacacatctaaacacattacagtgatttttccattgctagcttgatagtgcttttagtctttagcctgctgaaaccaataggtgctgagttatgaacaggcctaggcaaatggtaatgttttacttttccttctaagctttgtaatgtctctgtgtggtcttgatgagaaagaagaaacttccatgttaagaactgcagtgaattcagtttcacatttatttcagtgaaatagcataggataaaaaaa

SEQ ID NO: 212919 - DNA, 241 bp, Homo sapiens
ccttacctaagtaccctcttcattcctataatctttcctgtgtaaatattagctgtgattcttttgtctatcttgcttcccgtagcaggaagtgcctttaagaatctccttgaagaacttaggtgctgacctcagttaggtctctaaagctgagttcttagtcccagttgggtcagtgtggtatgatatgaacctttaccttctcaatgatgttcacattcccctcccctactaggaggtg

SEQ ID NO: 212920 - DNA, 558 bp, Homo sapiens
tcttattagagcactcctctatttttctgttactaaaatttctagcttcccttctacaaagtgataataaaaatcaaacattaacttttcctctaagaaaatccatgaaaaaaccatggtcatcattggtaatattcaactagttcaggttctcctccctcttgggcacataataggatcatttccccatcccttgggtgggagcatgtgactgattttgatcactgaaatgtgagtgtacgaggatgtgtcacttcaagagccggaacacacacatgcccaggtagaagcatatgttgaggagatttccatcagcctggacctcagaggaactacagtcagcagacacaccacaatggccacatagcacgagtgaaaaaataaaccttgctctcataagccattgggattttggagtaatgcattacctagcctaccttgattgatacaaaaatcaagcctggaaaagggttcttagttaggaatcaagagattctgctttgctgggtgtggtggctcacacctgcaatcccagcactttgggaggctgagacaggc

SEQ ID NO: 212921 - DNA, 108 bp, Homo sapiens
ccccagagtccccaggcaagcactgactcattagaaatcccagttgtcatgttcctgagcttgatgcattccagtgtccctcaactgtcaaaagactcagaaatgcta

SEQ ID NO: 212922 - DNA, 805 bp, Homo sapiens
  misc_feature (773)..(773): n is a, c, g, or t
aacctatgttatctgcttctggcactaccaagttttcttttcaatttattgttgaagtgttagtttcataccacagatttatctttagtccctgtatctatatctctcagatcacttatgaaactttttagggcattcccttccctcctcccccattgcttccgagacatctctacttactccaaaaggaaggagggaaagaagaagagaaatacaagtttaaaaaatatgtatacagttgattctcattattcatggtagctatgttctataaagttactgtgaacactgaattagtgaatgctgaaccactgtccctaggataaatatgagtgagtttttaaggagcatttggtaacattttcatcagctgatcagtacataaacttgttttatgtgtgtttctgttaaacacaccttatttaatatatactgttgattcactagcgttaaactcacagccaacagcactacagatagaatatccctaatctgaaaatccaaaatccaaaatgctccaaaatctaaacaccaacatgacgctcacaggaaatgctcattggaggatttcagatttctcattttcagattagggatgctcagctgatcagtataatgcagacattccaaaatccaaaagaatccacacccaaaacccttctgatctcaagcattttagataagtgatactccacggtttactcaggctgaaaggaactatttggcgggtttctcataagggactagcttgttcttgggatgacgctttgggnatctggcgcgccgttgagaccaccacgttggg

SEQ ID NO: 212923 - DNA, 415 bp, Homo sapiens
tctgtgtccacctctaactctcccaggatctgtctctctatctctgtctctcacagcatctctctcttcctttttgggtccaactcttaagactatctctctctaaatctctgtgcttatctctccctgtgtctcttcctttctcggcatctatctctctctcttcctttctcggcatctctttctatctctctctctctgcctctttctgtctcttactgtctctctgtctctgtctctcccagcatctctgtctctgtctccccctcgctggtttccgctcagattaagccggggacctaattccaggcccaggatcgaattttctggcaacaaagggaaatagcgaatcgatcggtcgctctggagattaagagacaagcggcgcgcggatctatcacggctaaacggcccc

SEQ ID NO: 212924 - DNA, 275 bp, Homo sapiens
ttcatccaataaatattgagatcctaccaagtgctgagctctgtgatatggcagtgaggcgtagcagtaaacaaaacagcaaaaatctctgccctcacagagcttacattctaatgggagggaggcagaccaagaaatgaaataagtaaaatatatagtatgttagatggttatgaactctctggtaagaaacaaagcaagaaagaaaataggaagggttgggggaagctgcattttttttttttttttttaatttagagacagggtctcactct

SEQ ID NO: 212925 - DNA, 288 bp, Homo sapiens
acctctgcctcctggattcaagcgatactcctgcctcagcctcttgagtagctgggattacaggcgtgtgccaccacgcccagctaattttgtatttttagtagagacagggcttctgtgtgttggtcaggctgatctcgaactcccgacctcaggtgatccaccaacctcagtttcccaaagtgctaggattactggcgtgagccactgtgcccagcaaaaaaaaactcctttaaaaaatagtacatatttctgaggtgcattggtaaaacattagcctccagtgga

SEQ ID NO: 212926 - DNA, 154 bp, Homo sapiens
acctctgcctcctggattcaagcgatactcctgcctcagcctcttgagtagctgggattacaggcgtgagccactgtgcccagcaaaaaaaaactcctttaaaaaatagtacatatttctgaggtgcattggtaaaacattagcctccagtgga

SEQ ID NO: 212927 - DNA, 171 bp, Homo sapiens
tggaagtttggcttttggatgttacaatttataatctgctctgttctctctgaagatgagattaacgtgagcatggaatgttctctgagttgcttctccaagcagagagatatgtgtgcagggccacccatgcttaccatttccctactgaggctcttaggatacttttgt

SEQ ID NO: 212928 - DNA, 578 bp, Homo sapiens
tctgccagtaactggatgtgtaaccttcgacaaatgaccaaaaacatctctgctcccagatttcctcatctgagaaacaagagggttggattagatgacctttaaattcccttccagccctacactccattgatttgtgattcctcatggggaggtacaacttttgatttctaaggaccaatggttgaaaaagtaagcatttatatagcatattttatatatgcaaaatcccttacaaatgtttattattcttacatcaggcaaatttttaggttttactagtgtcagtgcaagtacataaatttgccttctttgtttcttatgttcttcatatttttcccacgttcttcatatgttcttatgctcttcatgaagagtattacagctcttcttttaaatttcattcatttacattgcagttcttaagatagtacttggtcagccaactcacttgagccagtccctcctctcctatccagtcctattacacaatccttgagtccttgagtttagttctccctaacttgggacctaatggtccttccccttatttagattgagccccacttacctgtgtc

SEQ ID NO: 212929 - DNA, 468 bp, Homo sapiens
gtggggagggagagcatcaggataaatagctaattcatgctgggcttaatgcctaggtgataggttgataggtgcagcaaaccatcatggcacatgtttacctatgtaacaaaactgtatatcctgcacatgtacccaagaacttaaatgaaattattaaccctctatatccttcaaattagcacattttaattagttatcctttatattctacatggaagctaattcggaaaattactcccccctcaacaaacacagctacttatttggagagtaggtccctaaagatttgaaatgctttctgctctcttcagtgtggtttgtgtctttagccccaccgtacaacatacttctgcatttagtgaatatgaaataaatgatggtacacagagtgtatagaagtgattgtatgctgtgcttgtaaaaatgattaaacaacttgaatcatttcaattcagttatatgatt

SEQ ID NO: 212930 - DNA, 1119 bp, Homo sapiens
cttatagtagctctgacaagatatttctgttcttttattgggctattacttagtaggtgcttttaaagcttgttgaaataaaacagaaatgagttagaccagtgaatcactggcatttccattcttccagatgacaactctggaagaatatctaggaaatggggactggtacaattctagctaccctttagaaatcagaaccccagtgggggccccaaagctagatataagatctgaatgcacactaccatcaccatcaagaatcctcggccaagagaaagtacagtctggaaaatgatataaacactggttcttgaaaagaaaaatgcaaaactgctccccaaaatgctcaccttttaagaattaaaaatgacataaatagccatgagtcagcatatgcaaaagtcaggattcctagtcctctgaaaaagactctaaatcagtgtttaaattgttcataggaacagaatctataaggcaagaacagactatcatgaaaaaagaaaaagatctagaaaagagcccaaatgaaattctagatatgaaaaaagtcattttcattgaaaattcagtggaagtgatgtgaacagctaaggaaaagggtaagttggaagaaagatctaagaaaattatctagaatataccagagaagatgcaaaatatgaaagcaaaattgagacaatgatagaagagaaaaatctaagttacttctaataggagtcccagaagaaactataaaatatgaaagataagcaatatttaaaatgagtttatggcaaaatatttccagaaaagtcctcagattaaaggactacacagagctcctaacgaaaacaaattaagtcctagacataccagattgaaacagaacgtcaagaactaagaagaaacattttttaaattacctgagatagaaaagtttcattataaataacactgagagcaaacttaccagtagtaataaatgccataagacagagtactgagggaaaacattaaaccttatatttttaccagttaactcatcatttaagcatgaaggcaaaataattccatgtaggccgggcatggtgtctcatgcctgtaatcccaactctttgtgaggccaaggcaggtgga

SEQ ID NO: 212931 - DNA, 767 bp, Homo sapiens
agtgtcgggattacatgcatgagccacggtgcctggcctaaatagtaccattgagggaccttctaattatgaatttagctggtatttcatatggtggaagcactatttattgtgtcctaaatcagaggagatacatgttatataaacttgccagtcatttgggatacatagggcatgaaatatttacttgaaatcattatttttgtatatataacatgaaatacttagaataaagatatgattcttgatagctaccagttgagtgcctgctccataccagatgtttcataatttgttaagtcttaatacagtgcctggcacattgtggatgctcattaaatatgtctgtctattagatagtactacatagtagtaatgctattgtagatataaatatataattctcctaatagtgaagattgacactctgcaattatacaggcagtagaaaataaatgaatagtagttaggattgatgtaagagtattgtccttattttacaactgaggaattagattaagtaacttgtcaaaggttgtgcagaataagtggcaagtctgagcttcaaaccagggccgattcctgaaacctcggctcttttcaccatgccatatggttttccgaaattggtactggatgacttattaaaggaaagcatatctgagaatgaaatggcatgtggtatagctcatactaatgagcttatgcttcctttgtgcaatataaggaaatatgtggtgctccagagacataaaataattctttaa

SEQ ID NO: 212932 - DNA, 277 bp, Homo sapiens
tgaaaagttacttccttccccttcttagggcttttaatccctctttatgttgcatttcagaaaatgccctatagcgtactatgaaagaaagacattcattcctgtctttgctgctgtgtggacgatctgtattccttgctccgtgggagttgtgggtttatgtctattcttgcatgttttgcctgaaggaccacagtgacctacttggtggtctccctgctttcatggtttcactatgctgatctatccttcacttaattatagagtctatcttaaa

SEQ ID NO: 212933 - DNA, 410 bp, Homo sapiens
tcaaaatttaggaaaatgagatgtttgggttaaatagtcttcaagaatccttcaaattctgaaatactgtaattcctttaatctgtaattttgctttattcacctataaaaattcagaattcctaagacagaggcaggattttcagatgacaaggcaataggtgtttccattagggggccatgtccaattgatactatggttttcagagaaggataaaatagaatttgaaaagggctgttaagtgcgtaacattctttaatccactagttagagtcagtcagagttgaatgaggcctctattcctaaatttttatatcattgccttgaaggcattatttgaagaactactattttttaactatttagatcttgtgactattctcaacagagaaactgttcaaagaagact

SEQ ID NO: 212934 - DNA, 320 bp, Homo sapiens
cttggattataggcagggaccaccatgtccggctaatttttgtgtttttaatagaactgggatttctccatgttggccaggctggtctcgaactcctgatttcaagtgatctgcaagcctcagcctcccaaagtgctgggattacagccatgagccactgtgccaggcccctgacctgcttttctgaggacaaaggttttctgggatcttcctgccctccccacctccacctatgcactttttaccaaccaaagtttgcttgggtcaaaaattcacaaaagttaacaacattaaacaaaacatgttttggtgtggtctaa

SEQ ID NO: 212935 - DNA, 497 bp, Homo sapiens
tcaaaaatttaaatataggagtatgatgggactatcagcctttcatacccaaggatacatatacttgattccttcaacctgaagcagatattgattgcatataaattgccttccacccacgaaaacaaaggatagtttatccagcaataagatgaggagggttattaggagatgagagagctgcaagaagagataaagagttacaaaagatcagtttcacccaatttcaaattgtagaaaagggaaggaaactttattcctcctttgcaccaactgggcccctgctatcagaattcagaatttaaattagaactgtctgctaacacagacttttacaggtacggaaaaaaaaacaacctctatataagtttcatgaggaaattataattcaactactatcacagtgaagttgacagtccataggaggcagagaggatgaggtcaagactactggtaaagcattattattattattatttttagacagggagtctcac

SEQ ID NO: 212936 - DNA, 331 bp, Homo sapiens
aacccacagatgtggaacctttgaagatcatctggtacgaaacagatgtgactgtaccagtggctgctttatcaagctgggaacaaatattggaaggaaattcaccaaaatgttaaactgatggtcatgggaatgaggagtgacttatctgatctccttcttctttcgaacttctgtgatgcagagaggaaaaaatataaacccgatatttagatgaaaagcatcccaagcccagtctccagacagatgaatgggtgtgtatgccgatttgacacggccggtgtttgttcttttcatgcttttttttttttttttttttttgagatggagt

SEQ ID NO: 212937 - DNA, 268 bp, Homo sapiens
aggataaagcattttctggtctggaaatctatatggaatcatagattctggttatgttgtacttcagtaaccctgaaacagaattctatgaaaagaagtaagttagtgtacacagctggtacttagctaggttatggtaaattgtatttttgttgttgttgttgttgttgagacagagtctcactctgacacccaggctggagtgcagtgagccgagatcacgccactgcgttccagtttgggcaacagagtgagactccgtcacaca

SEQ ID NO: 212938 - DNA, 415 bp, Homo sapiens
cacaacaataaaaaatatataaattaggccaggtgcaatggctcatgcctataatcccaacactttgggagatcaaggtgggcagattgcttaagcccaggagtttgagaccagcctgggcaacatggcaaaaccccatatctacaaaaaaaaaaaaaaaaattggaaggttaaggtaggaaggtcacctgagccctctggggaggtcaaagatgcagtgagtcagcctgggtgatggtgaactacctcaggctgggtaatttaaaagaaaagaggtttaattggctcatagttcagcagaccttacaggttctgtggggagggctcaggaaagtcacaatcatggcagaaggcaaaggggaagcaggcaacatcttagatgccagagcaagaggaagagagcaaagagggaggt

SEQ ID NO: 212939 - DNA, 441 bp, Homo sapiens
tgtgaaattagagaaaacctatgtgaaatgggaaagtccttaaaatgtcctatctctagttgattctgggtcctctttttccttcctggccccttcccactcgaaacccaagttcactctagccatatgctgacatgggtaagcaccagacccgggccgatttcccacaattccaagtggcatttgcataaatgttcctggagctggaaaacccaccttgtccaagcctcttgttttgtggatgaggaggctgaggctggggcaaggtaagtaactaacttgctcacatggctagtaacaaacttcctacaggttcctctaccttatgagatagtgagtactcctgcactcaaatatattggggttcatgttaattgcatgaattaatccagtcatcaataactctaaatcttaaattttgaatttggaatctgagtgaat

SEQ ID NO: 212940 - DNA, 392 bp, Homo sapiens
ttaacgagagaccctgcagaggcgtgcaagcccacccagggagcagatgcccatgttatcagtgccttcggtcccgagaggggttcacactgaggatgaaggcgttcaggcctgtggcagggaaggtatttggggcagttgctctttcatggaatcgcagagcaggttcacctgcacagccctggcaccttcttgcttccaaatccacagcgccttagcgaaatacaagctcatccagtcctcaaagagtgttaactttccaccaacaggtgtacttttaaaaaagaagggtgccgccaacctaaaaagacacggcccacaatgagccatctgaaagatgactggaggctctgcttttaaagaagttgtcaatcagtcgatcagcaagccag

SEQ ID NO: 212941 - DNA, 483 bp, Homo sapiens
cacttcaccggaacctagagctacctgtgaacaggtctcctacacgttgaagatttttctggatttagggtgtctaacctttgatgggaaagggcagcttcatcttggagtgtttactttcaagaattgctatgggctaaaaatcaattctctttaaaagcaaagatttaatctgataaggaatcaatgcagcatgctaaatacctttcatatggcatgaaaacgtcttcagttactcaagccacaggcaatgagaataaggtgccacagcaccgtatttttcacaaaaagagtgacctgggattcaagaaacctgtatagtataactatcgccagttcgttttgtggctttgggcaagtcacttcaccttttgtgaaagtctggagcttctttaaaatttctgaactgcattagataacgctttaaaaatatacctgacattctgtaactttaaataaatgaaaaatgccaatctattaagt

SEQ ID NO: 212942 - DNA, 546 bp, Homo sapiens
atctgtcccattcacaggaaggcatcggggctgcgccgggcgggtactgcggtcaatgtagtgtgaagagcaggcctccactcaggcagcctctgttgtgcagtttgttttattgtagatctgagttatgacgcacacacactcacatgtactctctcaaccaagaagagatgcgaaaatagccttgctggcttcctttcctccccctttattttttgaagcacgtggttaactcagcaggtacaattctagtgcatgaaacacacttggttcatagaaagtcagttaaaaacacacatccacatggacctttctggctgggtggttgtgtgttaacataaggactccatacttgtactaggattcttctagaaattagtgggttttgttgttcttgctctctcttccccacctctttttttgttttttgtttgtttgtttgtttgtttagcactttccattgtgaaaactattttggttgtccagtttggattgttggtctaatatttgtggtttctaagtcttaaaatgaaagaagagaaagaa

SEQ ID NO: 212943 - DNA, 105 bp, Homo sapiens
ccatatcgattctgcagcagattgaattagatctaaaagccacccaggccttggtcctagcacccactcgagaattggctcagcagatacagaaggtggtcatgg

SEQ ID NO: 212944 - DNA, 480 bp, Homo sapiens
ctgctgccacggagtttgtgccttacctgggtttgtgctcgtgggcgttgatctgggttgagggccgcagcctcgctcctgtttatagacactcggggtcccagcccaatctgccccaggggctccctgaggctctggggtcctacagacctgggtcagaagccccacacgggctccagcttgcagggatgctgggtgagtccctccctgcctgtgggctttgcactcctgcctgcagaatgggggtgcagaagcacctcctcatcaaatgctcaggtggcttgagtgagccgatgcccagggcctgcccgccttgggggatgcccaggacacccacactgccatccaagtttggctttgggcgagttcccagctgcctgcagctctgtctcctctccgagaggcggtcatgttctgcctgccctccaaaacaaaggggatggaaatgcgttggggtgagaaggacctacccggtcagac

SEQ ID NO: 212945 - DNA, 441 bp, Homo sapiens
tataggtcttctgggcttttctgtatcttaatcaagatacggaatctttctctcctctaacctgtcctcagcttttcacggggtgaggtccagatttaagatgggataccagattaaacatacttcagaattgtatattaagagagaaacatttttggctgggcccagtggctcacatctgtaatcccagcactttgggagactcaggcgggtggatcacttgaggtcaggagtttgagaccaggctggccaacgtggtgaaaccctgtctctattaaaaatacaaaaaattaagggggcatggtggtgcatgcctgtaatcccagctactcgggaggctgaggcatgagaatcacttgaacctgggaggcagaggttgcaatgagccaaggtcctgccactgcactccagccttggggacagagtgagactctgtggcca

SEQ ID NO: 212946 - DNA, 379 bp, Homo sapiens
taggacagttccccaggtggccttggactgatccagttctcccctctttctcacttgtagttctcaagaataactgtagaatgtgctgacaatacagcaccctgtgataacagaggagctggttggaacaggctctgttccagcccctcacatcagaaaacaggatgtctttccatgctttagaccagggtgtcctgctttgtgaaaaacccagggcaggctgctttgtgggatgcctcagctgtggtgcaagtggagcatgtacagaacagaccccatctatcccaggcagctttcttgagctggggaactgttccctgctgcctgtcagtaataaacccacttctacatggtgaaactcaaacttaaacattcttgg

SEQ ID NO: 212947 - DNA, 334 bp, Homo sapiens
caggcaatctagaaaatagcctgagaccagggtgtatctcccagcctccatgccgcaggccgggaggtttgtgtagtcgacgttctccccctagtggcctgagtgaagatgacaggcaggagggaaaaaaagccttttcacctgcgaggcctggctgccaagggctcccgagctgcggatggacaccaggatccagctgctcttccatgactcgccctcccttacctcgccctgatcccggccctgtcagatctcatctttacttaacattctgatattttgtttatcatagagtttttgggttatttttgatttattaaaatattgtattaaa

SEQ ID NO: 212948 - DNA, 274 bp, Homo sapiens
aattttacttaatcagcattttttatgatgtgtgacatatatctttcttgtaaaaagaattccttcaaaatatgttttaactaattaaccatactataacaaaattacataacttaaatgttcttagtcatcagtattaagctcttgttcctcaaaagacattgttaagaaaatgaaaagccaagcttgtgatcccaactattctggaggctgaggcaggggaatcacttgaactcgggaggcagaggtttcagtgagctgagatcatgccact

SEQ ID NO: 212949 - DNA, 371 bp, Homo sapiens
tcttttccactggtgtttttctatttatctgtgaccaggtcacaaaatagctcattaaagtttaactttgagccgggcgtggtagctcacgcctgtaatcccagcactttgcgtggctgaggcgggtaggtcacttgaggccaggagttccaggccagcctggtcgtcttttcacaatttttataaagtataactattttttaaaaaattaacagctttgttgagctataattcacacaccctacagtttccctatttaaatgtacaattaaatggtttttaatattttcacagagttgtgcaaccatcatcacagtcaattttagaacattttcatcaccgctgctatgaactaaattgtgttccccccc

SEQ ID NO: 212950 - DNA, 261 bp, Homo sapiens
ttaacgggtgttagccagaaagccagaatggctggagctgagggagtagaggaggcggcatagaaaatgaggtcagagatggaggcagggccggatcacagaggggcacagagaacgaggagggaattggatttttggaaaagattgtggcaaaatacaaaatataaaatacaaaaataaaatataaaccataaaatgtactacctttaccattttaagtatgcagttcagtagtgttaaatacatttacatcattgttca

SEQ ID NO: 212951 - DNA, 441 bp, Homo sapiens
ggagaagctataaagagagcccaggtttcctgactccaagtccagagtgcattccacaggacatgatggaggtgctgctgacattatcaggagagaggaactggtgaagaaagtgaagggggcaaaatcttgtctaatattcagcactgcgggcagtcaagtaccaggcctaaaagactgagaatcaggatgctgccatgctacacaaatcaagggaagacaatgtcaggaactaacccaatgtgtcaaatgttgtacagatgtcaaacagaacaaacgacgtctctcttcctagaaatcagaataaagctagtaacctttgagacaatttttgtagagtagtagaggccaaagttagactattgtgaacttcactaaagtgaagagtaaagcaaggggacgaaactgaaggcagccaagacaggacaatttttctcaaga

SEQ ID NO: 212952 - DNA, 610 bp, Homo sapiens
tggtctgtgtatttcagtgtgtttttgtagtggctggtaatagtttctcctttccatatttagtgcttccatatttaggagctcttgcaaagcaggcttgaggtggtgatgaattccctcagcatttgcttgtctgaaaaagaccttatttctcctttgcttatgaagcctagtttggccagatatgaaattctgggttggaaattattttctttaagaatgttaaatattggcccccaatctcttctggcttgtagggtttccactgagagtttcagttagtctgatgggcgtttctttgtagatgacctgtatgcccctttttaaaaaatcttcacattagtactgacaatggaagtaaaggcttccagagcttgtgcaatgagggccatgatggtatgtacaaagtgtgcccccagttactatgtctgagctcagaaagacctttaagaaattttgtgccaggcatagtgactcacatctgtaatcccagcactttgggaggctgagttgggaggatcacttgaggtctggagtttgagaccagcctgggcaacatggtaaaaccctgtttctattaaaaaattaaaaattcgttgggtgcagtggc

SEQ ID NO: 212953 - DNA, 253 bp, Homo sapiens
ctcaaagtgtcagtggtcagaggcccagggccaaaccacaaactgttgtcccagtggcccatgtcaagataagtgtagaaatcgagagcgtttaggcatttttagagcaatttgcccttgctgtgacatctagtaattaatatttttgtgtgtttgcagaagtattggtctgctataaattggacatttaaaaatttgtgaaataagccagacatagaaaaatattgcaggatctcatttagtggaatgtaaa

SEQ ID NO: 212954 - DNA, 506 bp, Homo sapiens
cccctcatctcacactctggttgctctgtgtagttgaggctgaggattgcggtctgctgggattctacaatcagtgctaggattcagggaggagaggctggtcaggaagagacactgcccacgatcctctaccgcatttgtggcctccccagggtcttgggggtaacctagaaagaagataaacagagcaggcttgtgacaattgaaaatatctatttttctcccaaagccagacacaagaaggaacagggtgacttcttcagctcatctcaagggaacactttgatccaggtctaatggatcactaaagtctcttctccccgctgagtgggtagaatgtcaacagcccagagcaacagtacccccagttgtgttccaaatgtcttcagtctctcattcattctgcaaataaccccacctccaggtccagcccctgtgatgtgccaggtgctggcattatagcagccaggcaaggctctgctctcaagcagctaacattgtagctc

SEQ ID NO: 212955 - DNA, 268 bp, Homo sapiens
agcttttgaaattgtgcacaaggtatcatatactgggcaagatacagaaatggaatcagatctggaggtcagctctgacaaatgcacttcctagttatgtgatcttgggttcatcatttagcctcagtggactacacttttctcatgtgtaaagtgaataatgatctgtaagattacataattttaactattgaaatgtatgcagttgaggtaatgaaacatttaagaatgtaagtaaaaaaacagtatctcttaaaatataaaaaat

SEQ ID NO: 212956 - DNA, 278 bp, Homo sapiens
tctgcctttccttctcaaaacacttttctctcttcagacacctttgtgcctctgattctggggcttcctgatattgctggagaaaactgtacacctggattgatttgcaggaaaaagtaatttgagtgacgcagcctcagtgagatctctgttgttttccatcctgttctccaggaatcctgtcaccttccctactgagccaagccaagcctttttcacttgcttcaaatcccatcccagttctggagctttcacactaagaaacctggagactcctc

SEQ ID NO: 212957 - DNA, 917 bp, Homo sapiens
gcaatctcggctcactccaacttctacctcccaggttcaagcaattctcctgcctcagcctcctgcgtagctgggattataggcacgtgccatcaccctcggctaatttttgtatttttagtagagatgaggtttcaccatgttggccaggatggtctcaatctcttgacctcatgatccacccgccttggcctcccaaagtgctgagattacaggtgtgagccgcctcgcccggcctatggcattgcttttgatagatcattctatacatttgaattgagggtaggtgtcctatctacttgttcctcttatttccccaaggttcttaccaagatgcccttttctctttactaattaccactagcttcaatttagaacagtcagattggctcattataaaacattctgaaaatgcttaaaagcaaagagaaaatatgaaaattaccttaaatcatatcatttattgataacaatcatgaacatttttactaatttgcttccagtcttttcgtctttatagacattacttgcaatctttaaataaagctgggatcatactacaaatgcatccgagcagccttcttttcatgtatacatttaaaatagtatcttatgccattaaatatttaaaaaatataatttgcaatggtgcttaacatcccattctatgactctatactattcacccttcctcctttatgagacattcagattgtatcagtattttgatattctaaataaataataatatcgtttgcacattgatgcttagtagacattgttggctgatttctgtcactcaggtgccatttaatccacaattttgatggatagcacataaaactgtaatttagatttctaggccacttagtaccctcagcttgttccccatgctgtagcctatttattatagaggg

SEQ ID NO: 212958 - DNA, 538 bp, Homo sapiens
ccgctgcccatgaagacccgacagcccacttgccatctgggaacctcgcgccctgctgtgcttggagttttcggaaacgatggattccaaacaacttccagtgagcaattggtgatattaagttaactgagttcatcttaccctttttattttgcctcagagagtaaaataagatagaagcaaacataccagcccacaaacatgtccatgcttccttttgcttctagaaggcgtatgttgggaaattaatcagaccaacgttagccccttcctcccggccctggaagaatgcctggtgtgtgtgcatccccctctccagttagcaattaccgaacaacttctgtggctaccaaggagagcatgatagggtcccagccctccagagcttacaatgtaagagaacaaacaggaacatgagtctttacaatacctgcagtgagcgccaacaaagtggaataaaatgtcacctgaaatacctgagaaaggggcttctcaagcttggagaaggcagaggctttggagagatgtttgatctgag

SEQ ID NO: 212959 - DNA, 486 bp, Homo sapiens
catacattatttcattacaacctgagaggtagttgttattatcctcattttacagatgagcaagtggaagctcagcggggtcactgaaggacccacagcaagggagtggccgaactgggatttctttcgtgggtctgactcccaaagccgtagatgttccctccacatcactgtccaccaaaatgtgctccatgatccatccacatgcaaaacctctgggaaatcattaaaatgcatgttctcagctgggcgtggtccctcatgcctgtaatcctcatactttgggaggccgaggtgtgagccaccaacgcctagcctcagagacttctagtaacatcatatagttagtaaaggggacagctggttttcaagtaaaggtctgtttgattttttctattatagaaatcctttcccctttcttaatgtctctttggtattcttgaaaaaaacaaaagagagccaacaaataaaaaaagttggcggccg

SEQ ID NO: 212960 - DNA, 359 bp, Homo sapiens
gtttagtaagttaaactaaaaataataatatgaaaccatcatattttataagcccttttcagcttatgaaaatatttccccaaatataagttttatgaaagcatctttcagcatttccttctgaactgcaacccaaacaatgcctaagcacatttctaatataataaagtgttgttgggaaaaaacactgttagggaatggctttcacttggcattagtttgaatgacttggcattgtcaccaggggtggtggtattttaaacacagaacattctgcacagtgattttcattgtaaagtctgtgatgtcaaacctcaataaaatttctttctggaaattgaacctgcaaaatgcaaaaa

SEQ ID NO: 212961 - DNA, 291 bp, Homo sapiens
gcacccagcctatgaatgattttttaatgtgttgtttaatttgatttgtcagtattttgttgaggatttttgcattagtgtttatcactgtgtctatcatctttttttgatgtttctttgcttttggtatcagggtaatattggccttgtagaatgagtttggaactattctcttcactattttttggaataggtcgagtaggattggaattagttcttccttaaatgtttggtagaattcagcagtgaagccattggatcccaggcttcttttttattgtggcttttact

SEQ ID NO: 212962 - DNA, 174 bp, Homo sapiens
ctcggctgggcttgctcgtgtgtctttggtcagctagcaggttatctggggcctgattggtctaggatggcttcacttgcacatctggcacttagatgtgtgttagctggagcaatagggggcctggaccccgtgggtctccttttccagcaggccacttgggcttgttcacag

SEQ ID NO: 212963 - DNA, 391 bp, Homo sapiens
ttgaggaggtggaacataattgtagagaaaaaggcaagcaaactttaaaaaatgtctgctggaatgatgattcacttggaaccaaacattgttagagtagaaatttatatttggtagtatctgtttgaaaaaatgggaagagagagggattgtgaacttgtacaactccttttttaatgtctagttaagttgaaggtgcatatatcctttgatccagaaatttcacttctaaatgtagctcagagaaattcttatgtgtagaaatagatgaggacatttagaacagtatttcttgtaatggcaaagcaatcctgtttgtaaataggaaaatgggtatatattgatacaatagaataatgtagtggaaatgttattataaatcctgatatat

SEQ ID NO: 212964 - DNA, 558 bp, Homo sapiens
caacttgcttcctcacttccttcagatctccaaaaagccatcttcttggtgaggtcttctctgattaccctaataaaaacttcagcatcctccagacactccttatgttccccctgcttttattttatccagagcactcacctcctcttagtatttggtgtaatttacttatttattttctttctttgtcttgtcttcccctgcaattagactttcagctttataggaacagggacttttgtctgtttggttcactaatgtatcctgagtgtcgggcatatagtaagtatcaataaatatgcaaataaatgaatagtctttagaggagataatgggagtataaaaaagagctaaggagtgcagtcagtatgattggggtgagtgatgcttttcatgttggaaaagttgtcatgaagggccttacatgtcattctaaggagcttagattttatcctataggcggtaaaatgtcagtaaagtagtcagtggtctgaattggaattttagaaatgcgttctggctgtagtataaagaatgaggccgggcacggtggctcat

SEQ ID NO: 212965 - DNA, 141 bp, Homo sapiens
ctgaacctagtatcttcctctctgattctgctctctcactgtactttctctgttggcaacatcctaccagttatatttggttccttcttctacattactaccattaataatggggcaacccaatgtttctgtcaagcctat

SEQ ID NO: 212966 - DNA, 332 bp, Homo sapiens
ccacactgccactactggggtaagtgtgcatgaatgccattgcaatgcccctgttggcatgaaggcatcccaccatgccaccatctgtgcaaatgcacacatggacactgccaaccgacttttaccaccattgtgcccaagctgatgtgcagacaccacactgtgccactgcactgtggctgctggcatgcaaaagccagcacatgtaactctgccactgttctgatgaagcactttggttggcaacccccatcagtgttgtggccagcaaaatggaaactcctcagcctctccagtgcagcaggttcctaacctccaggggagacaggata

SEQ ID NO: 212967 - DNA, 213 bp, Homo sapiens
cgcacccggcctctgtcacttttttggccacacttcattcacgcgactaaagtaacctgatctactaagtggttcttgaatctgaatgttggggaaccagaagcacggttcttttcgtactcagatataccctcacataacctaggacagcctgtacagaagattaggccagatgagaggtgtgagcagcaggtcttagtgtcttaccctcct

SEQ ID NO: 212968 - DNA, 1046 bp, Homo sapiens
gcgccagggctggacgcggcgaggtgggaggcaggatggaggggcgggagccaaggccgagggggcggacacgggtggcgtctggcgctccataaaggggttgcgggggccgcgctctcttctgggagggcagcggccaccggcgaggaacacggcgcgatgcaggttcagtgccagcagagcccagtgctggcaggcagcgccactttggtcgcccttggggcactggccttgtacgtcgcgaagcctccggctacgggaagcacacggagagcctgaagccggcggctacccgcctgccagcccgcgccgcctggttcctgcaggagctgccttccttcgcggtgcccgcggggatcctcgcccggcagcccctctccctcttcgggccacctgggacggtacttctgggcctcttctgcctacattacttccacaggacatttgtgtactcactgctcaatcgagggaggccttatccagctatactcattctcagaggcactgccttctgcactggaaatggagtccttcaaggctactatctgatttactgtgctgaataccctgatgggtggtacacagacatacggtttagcttgggtgtcttcttatttattttgggaatgggaataaacattcatagtgactatatattgcgccagctcaggaagcctggagaaatcagctacaggattccacaaggtggcttgtttacgtatgtttctggagccaatttcctcggtgagatcattgaatggatcggctatgccctggccacttggtccctcccagcacttgcatttgcatttttctcactttgtttccttgggctgcgagcttttcaccaccataggttctacctcaagatgtttgaggactaccccaaatctcggaaagcccttattccattcatcttttaaaggaaccaaattaaaaaggagcagagctcccacaatgctgatgaaaactgtcaagctgctgaaactgtaattttcatgatataatagtcccgtatatatgtaatagtaggtctcctggcgttc

SEQ ID NO: 212969 - DNA, 463 bp, Homo sapiens
tcatgaaacttctcccgagagtaggtactgtgcattttttacttggatatctgtcacttcaagctcacaactgaagcccccacagtcatctttcctcatcttcaccacccacgacacccccctcccaacttctgatgttcatcactgtcccagtgagccagacttaaaacatcttttactccttttcctcatgcttgggtcctagttagtctccagtgcctactaatactttgtgtgaagtatttttttcccatcagtcccttgtctcagcaccctcttccttcatcagtgcaacagtctcctttcagacttccttaagacaaaaagcacttgaaggctgggtgcagtggctcatgcctataattctagcactttggaaggtcaaagcaggtggatcccttgagctcagcagtttgaaaccagcctgggcaacatggcaaaaatctgtctctacaaaaaatac

SEQ ID NO: 212970 - DNA, 562 bp, Homo sapiens
ccatcagaggtctccctgtttcaggagcagtgatctgctcctgtgggctctcttaggagtcatgctgtttattccttttcattttcaaacttcttgcgtcctcaccttaaactcctctagtttttttcccctcctctgcttaatctgtgccctcatttcttcccaatcctttggactcttctcaagtcccattttgctggacctttctgcaagtgttacattttaccctcatctttctggaaacttctcattccatttcctaaatgtggtcattcacttaggactcggtccctgggctccctctcttcctttgtcatccctgatgggagcaagacgcatcttgctcccatcagggtgtggggcatttctgagtttcaaagatgcatagcgtagggttgctccttcaaactcttttaaactggggtccgggttaacagtggctgcatgcaaatccttccaaatgtcactattaatctttcccccattcagaacagcaaaatcactccatggctgtttctcgttctctggggtgggagatggcgttacagaactaagtgaccct

SEQ ID NO: 212971 - DNA, 509 bp, Homo sapiens
tctttatagccgtacattatcagggaccagcacatacatatacccctccccacacttgctgtctcaaaatagtaatgaacatctttaggtcatcagctccagttctctgcctaaaaggtgtgggaggtaagtgtgaaccccagcatccgaattcaaagagaacaaacttctgttactttgtaagagcttttctataaagttctacaaagagaggagaactgggacgcaggagagaggtttctcccctctgcactcaggactatgcattcttttggaccgggtcactgaagagcaatttgctggaacaatttaattaacccaaaataatgatcaaattaatttaaagtctgattcccttagggtgcttaattaaattacactgtaattttaaaagttagaaaactgaaaacccaaggtttatatgccatttgaggaatgggtgaaagaattctttaaaaatgctcaaagtgtgaaaaaacggaaatcacattcaggccaccccaaagaaa

SEQ ID NO: 212972 - DNA, 118 bp, Homo sapiens
atagctattgcaagaaaggcaagaaaacgtaataaaatatatatgacatttatatagtttgtatatttgtcctcacccaaatctttttttttaagagctttcttgccttttaatttct

SEQ ID NO: 212973 - DNA, 191 bp, Homo sapiens
agcatctgtatctcaaattcaactacttgtcatctcagctgctgcctcatgagttcaccaccagctatatcacctgcactgctacaccatcttcccaaatcatcttctacctccactctggccccatcagtcattcctccacattattgaataaatcaaattatgacactatcttaaggaaaatccttctc

SEQ ID NO: 212974 - DNA, 310 bp, Homo sapiens
gttgaaaacactcttttctcctctgggataggtgctttcttagtcctgagcctgacattctacacagtggccaagggaattttccctaagggtccttctgggtgatatttgggactggatccttctcagcagcttggacatcgtcagcctggtcaagtgtcatcctctctaaggccctggctcgttccatcctgtgtgtgtgcacagatgtccatatcctgggtctctgcttggcaattctgcagacacttccagagctaagcacactctggttccctagtttctctctggctttctcagatgtgcttga

SEQ ID NO: 212975 - DNA, 207 bp, Homo sapiens
ggtgaattagcaacagtaacactgattatccaacatatattttggaatatctactatgtgcaaggaatttttcttaaactctaaggttatgaatcactgggcaaatccatataattagagaattttaagtgctttagagcggtgtgattctactgtgctcagcctagtcaatttcgcattaaactgattatcagctgagtatcaata

SEQ ID NO: 212976 - DNA, 559 bp, Homo sapiens
ttatatttattgtcctttttgcttcttttttcctccttgccttgccttgtatcagattgacagcattttctatttttcctcctttattcttctggtctgaattgtatttctattattttagtcattactcttaaatcaacatacatactaactgtaattttttctaataaaatttaaaagttgttgtacataaagtccccaaaaaggcaaggatcatgttactttttacccattgaacaacccatttcacccatcttccttattgttggtgtctagattttcatgttttaaaacgatttaaactggccagacatggtggctcatgcctgtaatcccagcactttaggaggccaaggcaggcagatcacctgaggtcaggagttcgagaccagcctggccaacatggggaaatcccatctctactaaaaatacaaaaattagccagatgtggtggcacatgcctgtaatcccagctactcaggaggctgaggcaggagaatcacttgaaccagaatgctgaggttgcagtgagccaagattgtgccactgcactctagcc

SEQ ID NO: 212977 - DNA, 400 bp, Homo sapiens
tgagcagcatatggaatattctaataaagtcaagtataggtttaactcctttaggaaacaatcaaacaggtaaaacgtgagtctttgggtgaattttaaataaggtttgacttatgtgtaacctgggatcttagaataaaaagggaatttacaactctttcaattatgttttatattgtatggggataggcatggtactcagcaaatttcagcccaagcaacagttttggggaagaaccataatgataataatgccagaatttattctttccgtgtgcctaagtaattcaagctgatggtggtgtttctgattacagactgaaagcttttcgcttactctcatttagaacaaatggtatatcaagcaaacagattgcatatattataggacctgagcttt

SEQ ID NO: 212978 - DNA, 553 bp, Homo sapiens
ggggtaaggaaatgaattaggcttcttcccaattattagggagctttcggtctttacagtctaatgggggtgaaggacaagtagacttatcaattataaagtgattaatggtatgtttagggttcctcaggaacatgaaggagaaacatctaattcagaatgcggaactgagaaaggctgcatcttgaaagatgatttgtagttagccggaagtgtgaagggagagggatatcacagagagaaggtgggaactgttattaatgttttatttctgaaggtggtaatgagttcttggaagttcattgtattatttgtatcactgtatatcagaagactttaataataagcattgaatcattaagccttagaggtgatttctgggtattgataacaaaatatgaaaggattttctattgtatagaaactagaggcaggggtactataaatgagaaataataatagatgagtgaaagtaagtttatatattacttgccttttcaggataagtttcatttgggggaaatagttttactatttttgaaattaagacata

SEQ ID NO: 212979 - DNA, 452 bp, Homo sapiens
aattcattcctcttttagacaatgatcatccatccatcacttaaattctccctctcagccaacatttgactccaaacctagcctcatccatctcacatttttcacgtctcaagtatttgttcctttccttctggccactccctcctagttccctcccgactcttttccgagattctttttctcccgcaatcatccattccccagcagtgaaaaccttttgtcatcatcctaccttgtgcagcagaagctacatcctgccagaaggaggttttctttccctttctacctcctccagtcctccgtactcaggggcatctaggaaaggataaattgtactgcaaagggggcttcagtcctgcgataactattgcctacgtgcagtcaggcaccttaatgattgactatttggtttctgccgttacccggaggacttttaacctgaaagctgccaa

SEQ ID NO: 212980 - DNA, 265 bp, Homo sapiens
tgctgaggtggctatcgcccagatgtcaacggctcaatgccacacaggagacttgtgggaaaagtcttaagccattaggtcatggaagataactgcaagagggggaaaggacgctggcttgggaaacactggtgtgtcatatgataaaaacagtgaccagccagcctgagctctgtgcctaaacacatcatctgcgccctgcacgatgcccctgtgaagtagagacacgcggatcagaagccccaggtccccgatagccaccctt

SEQ ID NO: 212981 - DNA, 443 bp, Homo sapiens
caggggcgtggtggggagccgtagacccgagtttttatccttctctggcgccgacactcggctgcggaatcgagtttgagctcggtgtagctgaagtttaaattgtagctgtttcaaaggtagaccccacctcacccccacccctggaccaagacctctggaagcgtcctgcctggaagccgcttgtggggagggctctcctagggtctccaggctcccgctggagcacgcctggagatgccttgggagtctgaggaaccccagattcagcacccctgcttaacctgcttttaagaagaaaaaaatggaacttgataaacttcactcaaaggagagacccactaataactccacacacctcacaccgagtgaaggtctggctgtccctctgtcttcatcttttcaggctgctgtaataaaatgctataagtgggtgacttata

SEQ ID NO: 212982 - DNA, 441 bp, Homo sapiens
ttctaactttattggtgacaaaggcatcactcacttcaagtgcataagtcagtgatattttaagtaaaatgaccaagttgtacagccatcaccataaacaagttttagaatatttccatcatcccaataagttgtgtttgctccttctcctcaccctaggtagccactaatttgcattctgtctctgtagattttccttttctggacatttcatagaaactgaaccatataatgtatggtctctgtgtctggcttctcttactgagtgtgaaagtttttgggtttcattaatgtcaaagcgtattttactacttcattcttatctattgacaaataatacttcattgtatatgtatagcacatatttctattcattcattagttgatggatgtttagattgtttccaatttttggttgttatgaataatactcttaagaac

SEQ ID NO: 212983 - DNA, 276 bp, Homo sapiens
gatataaggacacagaaatcacatagttttggtacaagtggattacagataaacctttttcaaatttaggcctgttccaagatccaaatgaaaaaggaactcctaaatagagatgaggcttagtctccttttggtggccattaaattctgctacccagcaaccaccaaaagatctgaacatcagcaaaaggaaataaacatgaactctaaggaacgcaattaaaaagggaactttgtcaatgtgcatacacagaacaagccaaagcccaaggggaa

SEQ ID NO: 212984 - DNA, 337 bp, Homo sapiens
gctgatgagcccggtccaggagccccagccccccaggagcttggggctgcagacaagcatggtgatctttgtgaggtgagcctcacctcctctgcccaaggagaggccagggaggatcctctccttgacaagcctactgcacagccgatcgtgcaggaccaccaggagcacccaggcttgggcagcaactgctgtgtgccattgttgtgctgggcttggctgccaagaagaaggagataaacatcaccatcctcaaagagctgctcaagaaatttttaaataagaaaccaagttatggggttaatctcctacacaattcatttacttcctttgaatg

SEQ ID NO: 212985 - DNA, 422 bp, Homo sapiens
gaaaaaggaatgatcttcaggaaatcaattatttttacatggtgatctttctgtaattggtgaaaatagaattgtaggtaggcagccatcatgtttgagttctaagataacaccaagcatggatatttttctgggactgggttgaaatcatattgttgtagttgggttggatgtgttagataggtgacatataattattagtaaagttaatattcaggtgatacatgactataggggattattagaactgagtgagagataatgctgctagagtaaacaagtcagatctgagctccatgcaggaactaatttgcatttctggacctctcatccacccacttgtttcttctcttggtgttttatgtggaagcacattgttggttctcattacgtatttgctgagtgaataaagaatcaaatgg

SEQ ID NO: 212986 - DNA, 256 bp, Homo sapiens
ggcctcccaaagtgctgggactataggcatgagccacctcgcccggccaacgacagcaatttattctctaacagttctggagcctggaagtccaaaatcaaggcgtcagcaggaccctactccctccagaagctcaaagggaggctcctttctgcctcttccagatgctggtggctccaggcattccttggcttgcggcttcagccctccaatctctgcctttgtcttcctgtagttcatgtagtcttgctctctc

SEQ ID NO: 212987 - DNA, 341 bp, Homo sapiens
ctgggttcaattgagtctcttgcctaagcctcccaagtagctgggattacaggcgcccaccaccatgcccagctaattttttgtattagtagagatggagtttcaccatgttggccaggctgatctggatctcctgaccttaggatccacccatcttggcctcccaaagtgctgggattacaggcgtgagccaccgtgccaggccgggtatggcttggttttatacattcacgatctgcacttcttaagtccagtgcgtttatttaagacgctcagttggaatatgcttaggaaggtccaaagcagaatctcaagcttatctgtacctgtggtttaggaag

SEQ ID NO: 212988 - DNA, 699 bp, Homo sapiens
cagaccaggtcctgtctgcccctgtggcatataaggtttgctctcctggaatgcccttttctccctccacacagcactggatcgcagcatctcaattagccctttccgtgtgttcccatttctctatttgcccatctcccccggtgaactgtgagcttcccatgagactgtatcttattcatcctgtgcttagcccagtgcttagctcagtaaatgtttgtggaatgaatagctgacttaatttctctctttcctagtcccctcttttaacttaagaaaggtttattgggacactttaaaaaggtttattgattgaatattgttcggtgaacaaacatgcaaagataaaactacgagacggactcctttgccccaaaagccaggagttagctgatgaaataaaacctgtacacaaatacatggtcagtagtggtaagggccgtgaaaggcccaagaataacatgtgattggggtacaaggcagagaaatcactttcccttacagcaggattcttgacccgggggcatgggctccctagagggatttgggggaagggtctttgaactccctagaattgtggttgaaaaggtctctgtataggtacatatgtgcatctttccctggaagagggtctgtaacttcttaaaaggatacaaagccctcaagggttaagaacctttgtacaggcttctctcaagt

SEQ ID NO: 212989 - DNA, 466 bp, Homo sapiens
aaggctaggggtaaagagtgaaaaatatgtaggattttttctgagaactgcctcagtgcgtttgtcataacttcttctttatttaaaaaggagaagtttattaatgtagagaagaccagatattgatctgtttccagtttacagaacagtgattttgatactacaataatactcaattagaagaaattcaggctggttgtggtggctcacgcctgtaatcccagcactttgggaggtgaagcaggaggatcacttgaggctaggagttcaagaccagcctgggcaatgtagtgagactccatctctacaataaattaaaaaattagttgggcacagtgattaatgcctgtagtcccagctacttgggaggctaaggtaaaaggatcaattgagcccaggagcttgaggctgctatgattgtgccactgtacactctagccttgacaagagagcaagactgtctctt

SEQ ID NO: 212990 - DNA, 369 bp, Homo sapiens
ttctactgtgtcctctggaacccctggcacatgctaaacaatttttcctgcatctttagttttactacaggaggcttctgccagctaagtctcaacttaaaactgaatttatcctcccaaaaaactattctccctccatcactctcaaatggttgttgctcaatgtaccacacttcaagtagggaggtagggttggcaacctcttcagtccctgatgctgcatccagatcattaaatgcggtttaccttccacatgtcgtcactattgtctacttccaatctctttgttatttccgatcattcattaaagtatctgaaaactagaccatagacttccactccattaaaaggcctaccatcatcttgaga

SEQ ID NO: 212991 - DNA, 608 bp, Homo sapiens
tctcctggagcctcctgcagtagaaaccttttgttcaaaacctatctcaggctgggtgtggtggctcatgcccgtaatcccagcactttaggccgaggtgggtaaatcacttgagtctaggagttggagaccagcctgggcaacatgatgaaaccccatttctacaaaaaatacaaaaattagctgggcatggaggcacgcctatagtcctagctactcgggaggctgaggtgggaggattgcccgagcctgggaaattgaggccgcagtgagccactgcactccagcctggatgacagagcaagaccctctcataaacaaacaaacaaacaagcaaaaaaagcctatctcaggccctggctcaagtctgttcctccccatctctgcagggctcctatctctgttagtggggcctctagccccctaaactccctcctgaatcaggcagcccaaccagtctatgagatcagctcgcctgtcagagccatcagtaaatctgtcggcatgttggctcacacctgtaattccagcactttgggaggcccggagggaagatcacttgaggccaggggtttgagaccagcctgggcaacatagtgagcctgttt

SEQ ID NO: 212992 - DNA, 153 bp, Homo sapiens
aagtttctagaataaagagaataatggaagtgtttgcacttggtgaaccccagcaagctctgctggactgagcatcccttcctttgccttatttcagttccagcacgaggtcagggctaatttaccaactgaataaacttgggaaagtcactc

SEQ ID NO: 212993 - DNA, 289 bp, Homo sapiens
attggggggcctcacattatattctaatacctgttataacttcatctcatcccactgagccgatgtcattcttatatccacagtttagcacaagagcagggattgataagtaagtacatgtatttatatcaactgaactagaatatctgatggtaaaaaggctcaggggtccctacagttgcaaaacagtctcacatcccacttaatttcctccatagctgctttggttctgccctgggctgtgtcccgctctaatctctgctcatctccctgctcctcccccactctg

SEQ ID NO: 212994 - DNA, 455 bp, Homo sapiens
aatatcttgctgttggattttggggtgctgctccagacatttcagggtgaaagggctgtttatgtccagcatatgcaccacaattcctttctaaagtctgaaaatttctaagtttagactcacatttggcctcaagaatatcagataaatagctgtgagcctacattaaaaaaataattgacaccagctagtaggcaaacgtgatgcctcagttattttaatttacatttctttgtttactagtaaggttaaatatatattacctatctttagcatcaatatgattattcagtttttgtttattttggtagagattttggttgtctagagaatttcttttttatgagagacatagtctgtaactttatttggctgatgattgcaaggatgtatacatttgtcagaactcattgatctgtacattttactatctgtaaaatattcttcaaagaata

SEQ ID NO: 212995 - DNA, 219 bp, Homo sapiens
ccagtcgaatttgggagccagcaagagtcctgacagcagcacattggccaccagaagacacccaaaggtagggaggcggcagatactgcttaagttcaggagctcctctggccattgctgacccaagttcccccagaggcatccacagcctggggctccttcctcctgcctagagtttgctttcctatgcccaggccccaaccaggaggactggctctg

SEQ ID NO: 212996 - DNA, 492 bp, Homo sapiens
gcaatttgacaactctttccccagttgtctgtactgaacctggccctgtgctccgtaatggtgacctagctgtgaataagatagaatcaccttaaactcagaggggtaatgttctgttggggagggagaacctagttttgcatgctaagtagaatgatgaatgaagtatttacaaagggagcatgatgactgatatgattcattggtattatgtattaagagcctatatcatttcactcattcaaagatttagtgaattaagaatagaagcatgggaacaagtaaagatattgctcttgcagaacattttccactgaaagctcatcatattttcctcttttgtgaggataaagaaaaagtattatttctacatggaaatttgatgtaatacatttcaaccctaaaggcttttaatgattgctggaatctctaaaacccacttatgaacttctcctttagggggcaggactcagaataacaatagtaccactt

SEQ ID NO: 212997 - DNA, 399 bp, Homo sapiens
ccgccactgaaatctggagccaaatatatctggtaagtacccacagatttccttgagttgtatagactcttccatggaatagttctttaaatagctgtgagcaataaactctgtgtgactgtttttgttagaattggtttttgtatatgtatatgtttatttcaggcacaggagtgagagaagaggggatgagagatgagaagggataatcaagtgtgatggcaattgcatctccttccaaatacacccatggggctggctttagttgaacttgcccacctactaaaatagtgccacagacagaagcccaagattataagcttgaggttttaacaatttggtcttgtagatgcctagttacaaataaatttggctttagtaaaatggctcatctttaaa

SEQ ID NO: 212998 - DNA, 3270 bp, Homo sapiens
  misc_feature (2092)..(2092): n is a, c, g, or t
  misc_feature (2488)..(2488): n is a, c, g, or t
  misc_feature (2577)..(2577): n is a, c, g, or t
  misc_feature (2579)..(2579): n is a, c, g, or t
  misc_feature (2675)..(2675): n is a, c, g, or t
ttgtgtgtgtctgaggatccgagtgtgggttcaagaaagtggggaaagtcttataaaatgaattggaattatttctggatatgacatcagaagcataggcccaaaaaagagagagagagaagaagaaggagaaatagctaaatgggatggcaatacatgctgtggagagaaataaggcagggtaaagaggatggaaagtggtaagaggtaaaggatcgatatcgtagaggacattcaagtcaggcctcactgaaaatgatgcttgcacagaggcctgaaggaggtgagggaatgagccatcatgatatctggagacagaaaatccaggcagagggagcagcatgcgtgagcctttgaggacaggcaagaggtggccatggttagaacagagttgagaggagcattgtaggagatgaggtcaaagatgtagcagaggtcctgatcacctaaagcttcatagccatttttaggactttagcagttaccttaagtaggataaggagccacagaggattgagaggggaaggaagccatttggtgatataccttatgaaaggatcactctggcagctgtgttaagtatagtgcatggggtgatgagaaatggataaggactaaagtaaaataattgacagaatctagtaaagaattcaagtaggcagttagatatattaatctggaggtcaagggagagatgaaataaataattttggaagtctttggtgcacagttggtttttaaagccttgagagtggataagctgacaccaaaggactgagtacaaagggtaaaaagaaagggtccaaggactaagccctgagacctaccagcatttagggggtaagcagatgagaagggagcaccacaagggactaagaaggagctgctgccgatctccagtgcaacatggaggcaagagcctcattagatttaggtccagagaaaattagaataaagaaattgcaatagggagtgagtgataacttcacatatatctagctaacccacagctaccttgatgggagctctattggtgggaagaggcaggaagagcctgattaagtgggttcaagaaaacctaagaggaaatgagttggatactaccagtatggaaggtctttgaacaggttttgccctacaagggggaagaaaaacgaggtagcagttggagagaatacaagatgaagacagtttttagaaggcagtgatgttacagaatatttgtgtaagacaagccaatagagaggagaagatgacgatgcaagagaatccattgcaggagcaatgttcttgagtcagtgataggggatggaacataatggacaagtggagtggtgtgatcataaatcactttgatgtaaagaccatctcatcaagaactccaacagctttcccccactgcctcctttgcataacaccaaaggtccatctttgtgttctaaccacagcctacctttcatctatgaaaagtgaatactcttctaacttatatcagtctcctcatgtttatacacacatctaggattcctttcttttgtgtactattgagtaaggaaagaaggctatacatattcactagaagctgtactttgagtatccatacaaccatctgattttttactttcagtaagtatagtattcagtaaattacatgagatattcaacacttttgttataaaatgggctttctgttagatgattttacccaattgtaagctaatgtaagtgttctgaccatgtttaggctaggctaagctatgctgttcagtaggttaagtgtactaaatgcatttttggcttatgatattttctaattaccatgggtttattgggatataacctccatggtaagttgagaagtgtctgtacctggtgaagcattgtattggccaggtctggaagccacatatatcacttctcgcatcccattggagaacagttagttacatggttgtaccagatcacgagagaggctgggaaatgtattgttgctggacatctagctactttattacggtggaaaaagtgtagcatgggtttgggtggacagctagcaaactctttcttaggcatcttttatgataccagtagntctttttgaatatgaatgcgcttatacaattttaagcaataaaacataaaatgtacaaaagggtacaaaaaggaattcaaatatgccattaatcctttcttaacgagactctatcaaatattctcctcttagagctcaaggttagaataatgaacctgttttgactaacagcattcctgtagccttcagattgagctgtttgtatattgagagaggcatttttgtgtgtgtcctctattaaggttttgtcagcattttacagttttagaagatgaatttgtttttgttccaagggtttttaagtgcttcagtcagtggtcaaacaggttttgagcctagctttcaatgccaacacggagagggagaaagaaaaataatcaaaaacaaattccacantctaaaatgaacttttatcaaggcttttgctcttttagacttgagtttatctttataattaaggagaatggtttttaaaatttagttcntntgacaccccaaaattatcaaaataaattatgttgtagtgaatctgtgttttgaaagtcattgataggacttatatgagtcaaaattttatggattntaaactaggctttatctggttggaaataattgcaatacaagaagcaactttattaaattagacctaaagtcacaatcttcttctttgctgctttttaaaaattacctattacctttaaaagatcccaaatttagaagaggaattaaaataaaagttaatgcaataaaacacttccacaatattctattacttcaacctctaatcaatgaaaacattaatggactactcttactacgcctggtagggatgtgtttgggacataaaacagtttaaaaccttcaaaagacaatgactcaatattttcttgttagacaagtactattagcacctacagcacatttgaaggtctaatggcatacttctgaaaagcattctgcatttcagcattattttgacctgtacattacacttttcccttccctcatcttagtgaagtagagagattactgatctatttctttatcttaatcattcctccctaaccccaagacaaagaatacaaattagaatttacaaaatgtattgtgcccatggaaatacatagttttgttactgtactcatagatatttactacccttgttagtttcattctga

SEQ ID NO: 212999 - DNA, 1234 bp, Homo sapiens
ttgtgtgtgtctgaggatccgagtgtgggttcaagaaagtggggaaagtcttataaaatgaattggaattatttctggatatgacatcagaagcataggcccaaaaaagagagagagagaagaagaaggagaaatagctaaatgggatggcaatacatgctgtggagagaaataaggcagggtaaagaggatggaaagtggtaagaggtaaaggatcgatatcgtagaggacattcaagtcaggcctcactgaaaatgatgcttgcacagaggcctgaaggaggtgagggaatgagccatcatgatatctggagacagaaaatccaggcagagggagcagcatgcgtgagcctttgaggacaggcaagaggtggccatggttagaacagagttgagaggagcattgtaggagatgaggtcaaagatgtagcagaggtcctgatcacctaaagcttcatagccatttttaggactttagcagttaccttaagtaggataaggagccacagaggattgagaggggaaggaagccatttggtgatataccttatgaaaggatcactctggcagctgtgttaagtatagtgcatggggtgatgagaaatggataaggactaaagtaaaataattgacagaatctagtaaagaattcaagtaggcagttagatatattaatctggaggtcaagggagagatgaaataaataattttggaagtctttggtgcacagttggtttttaaagccttgagagtggataagctgacaccaaaggactgagtacaaagggtaaaaagaaagggtccaaggactaagccctgagacctaccagcatttagggggtaagcagatgagaagggagcaccacaagggactaagaaggagctgctgccgatctccagtgcaacatggaggcaagagcctcattagatttaggtccagagaaaattagaataaagaaattgcaatagggagtgagtgataacttcacatatatctagctaacccacagctaccttgatgggagctctattggtgggaagaggcaggaagagcctgattaagtgggttcaagaaaacctaagaggaaatgagttggatactaccagtatggaaggtctttgaacaggttttgccctacaagggggaagaaaaacgaggtagcagttggagagaatacaagatgaagagggaggaggaggaagatgaggaagatgatcaggaggatgatgaagg

SEQ ID NO: 213000 - DNA, 1290 bp, Homo sapiens
ttgtgtgtgtctgaggatccgagtgtgggttcaagaaagtggggaaagtcttataaaatgaattggaattatttctggatatgacatcagaagcataggcccaaaaaagagagagagagaagaagaaggagaaatagctaaatgggatggcaatacatgctgtggagagaaataaggcagggtaaagaggatggaaagtggtaagaggtaaaggatcgatatcgtagaggacattcaagtcaggcctcactgaaaatgatgcttgcacagaggcctgaaggaggtgagggaatgagccatcatgatatctggagacagaaaatccaggcagagggagcagcatgcgtgagcctttgaggacaggcaagaggtggccatggttagaacagagttgagaggagcattgtaggagatgaggtcaaagatgtagcagaggtcctgatcacctaaagcttcatagccatttttaggactttagcagttaccttaagtaggataaggagccacagaggattgagaggggaaggaagccatttggtgatataccttatgaaaggatcactctggcagctgtgttaagtatagtgcatggggtgatgagaaatggataaggactaaagtaaaataattgacagaatctagtaaagaattcaagtaggcagttagatatattaatctggaggtcaagggagagatgaaataaataattttggaagtctttggtgcacagttggtttttaaagccttgagagtggataagctgacaccaaaggactgagtacaaagggtaaaaagaaagggtccaaggactaagccctgagacctaccagcatttagggggtaagcagatgagaagggagcaccacaagggactaagaaggagctgctgccgatctccagtgcaacatggaggcaagagcctcattagatttaggtccagagaaaattagaataaagaaattgcaatagggagtgagtgataacttcacatatatctagctaacccacagctaccttgatgggagctctattggtgggaagaggcaggaagagcctgattaagtgggttcaagaaaacctaagaggaaatgagttggatactaccagtatggaaggtctttgaacaggttttgccctacaagggggaagaaaaacgaggtagcagttggagagaatacaagatgaagacagtttttagaaggcagtgatgttacagaatatttgtgtaagacataacccggggggataactctagagtcagacttcaggcatcaagcgtgcatgccgtac

SEQ ID NO: 213001 - DNA, 501 bp, Homo sapiens
atgggattctcctccatctggagatagtcactcccctcctggtctatacccgtggggttctcctcaatcaggaggtggtcactcccctcctggtctatacccgtgggattctcctccatcaggagatggtcactctccctcctggtctatacccgtggggctgctcctccatcaggagatggtcactcccctcctggtctatacctgtgggattctcctccctcagaagatggtcactccccctcctggtctatacccatgggattctcctccctcagaagatggtcactccccctcctggtctatacccgtggggctgctcctccatcaggagatggtcactctccctctcggttgctcagtccaaaaacaacctctctggaaaactgcgtggaatttttttttaaagaattgaaactagaactagcatttgatccagccatctgcctgctgggaatacacccaaagaaaaataaatcattatataaaaaagataaaaaa

SEQ ID NO: 213002 - DNA, 653 bp, Homo sapiens
gtgatactcacttagaaatgatctttgcagcgtttgtttatacagatataaaatactcaacttttaaaaacatacagtgcacttaatcactaacagcctactaggctgttggacaccaggcacccagaggtaaagccgttccttcaatggtcagccccctgccagcgcccctgggattagggagagcatggccttcagaggctggagcctgtagtcctaactgcacagctggtccagcagggcgtaacgcatctacctagagagtaaaatgaccaacagttgttccctaagctcagcacttgcaagaaatcttttgggaagatctcttcaaatgtctagaactctgcgcaaacaataggtaggacaagtgtgaacctacccaacctctgttgacaaatacagctgcacacccctcagcgaggcctgctgtgaaatgccaccttggtgaaatgagaataaagggtgagtgagccagctgcttttggatgaccaaattaattcttagcctcccattaagacaggcctgctcagcaagattttcatgggattagtgaattggtggttgccaaatgccataataatgcaccatgcagtagacttgctgtaaagcacagtttcatcataacaataactgtaaataatgctactgaaca

SEQ ID NO: 213003 - DNA, 599 bp, Homo sapiens
gtgatactcacttagaaatgatctttgcagcgtttgtttatacagatataaaatactcaacttttaaaaacatacagtgcacttaatcactaacagcctactaggctgttggacaccaggcacccagaggtaaagccgttccttcaatggtcagccccctgccagcgcccctgggattagggagagcatggccttcagaggctggagcctgtagtcctaactgcacagctggtccagcagggcgtaacgcatctacctagagagaagatctcttcaaatgtctagaactctgcgcaaacaataggtaggacaagtgtgaacctacccaacctctgttgacaaatacagctgcacacccctcagcgaggcctgctgtgaaatgccaccttggtgaaatgagaataaagggtgagtgagccagctgcttttggatgaccaaattaattcttagcctcccattaagacaggcctgctcagcaagattttcatgggattagtgaattggtggttgccaaatgccataataatgcaccatgcagtagacttgctgtaaagcacagtttcatcataacaataactgtaaataatgctactgaaca

SEQ ID NO: 213004 - DNA, 372 bp, Homo sapiens
tctttctcatagaaagactgttggttctggtgttctgcactctgcacatttctactaataattaaaatacttactgcctctgagatgcctccggacacccttctgaatcacagtgttcagaaatgctctctaaatcaggaaggtgtggatgacctttggaccttccctggtgtgaggagtttagcacactgagagtaatatatgaaaaagaccgccaggcgtggtggctcacgcttgtgatcccagcactttgggagaccaagccaggaggatagcttaaagccaggaggatagcttgaggccagaagttcgagaccagcctggacaacgtggtgagatgttgtctctacaaatatagcccaaaaaaaaaaa

SEQ ID NO: 213005 - DNA, 425 bp, Homo sapiens
agccccaataaggcagtggcaatgaaaagcagatgaattctgaaaatgtgagcaagctgggttggagtgtgagaaggaaacagatatctaggcagacatcgacgctgtttaattaagatggaaaataaagtaggaggtgttgctttggggaggaatatgatatactagtttgctggccaaagtttgagggcctgtgggacacccctgtaaatatacttaggaggcagcaggattcaaagggcagaggtttaggacaatcatatggactggacatttgggagtattaatgtagaggtggcttaggaagtgcaacagtgaagccctggagatcctcaacatttcatcaaaccagtgttattgtgtgtatgtgtttttgtgtgtactatctatgtatatcttctcctaagcaactacttcgcatccta

SEQ ID NO: 213006 - DNA, 412 bp, Homo sapiens
gatggccatgagatcaggttctggccaatctaaacacagatttccacacctaaagagaaatcctctgggggtcacctctgacgttcttgcttttctaataagaatacggaagtgactgcttttgctggccttgtaaactcatgtagtggttggagcttcggtagccgtcttacagccataagctaaattccaatagactcacaaagatgctgggcctaacattgttgaaccagtgaaccatagccaggaaccatagatactctaactatgtaagaaaaatgaacctgtctttgtttaagtgactgaactttcagattaatgcactcccaacagatacagagcatgatcccatatatacctgtatgtgcaaatatgaatagaaaaataaagtgattatctctgcgtgatagga

SEQ ID NO: 213007 - DNA, 457 bp, Homo sapiens
tctgcatatttcctgggaagagataaaaggtcttctgcatttcatctccctccacctcccacctcttgcccagcatggcattctgctccattataagctatcaaaggatttttcagacaagaaggggagaaaggagaaagaaagattaaaaaaaatgatttatccaaggtaaagaaataaaggaggatcaaaggtgataagacctgagggagaaagagataggaagataaaacataactcactttgtttagactctggttcagaagttatgcctttgcaaaaactgttggctggaattttggctgatgttttacttagttcagcacaaggaaaatttcaacttggccttctccttgaggaacatttatgaagaaataagagttatatgaagatgtgaatgaggagtcaactcacatatacccttacttaaagtgaaagttagcagctaagtgccacc

SEQ ID NO: 213008 - DNA, 140 bp, Homo sapiens
atcctaccactgcactccagcctgggcaatagagcgagactctgtctcaaaaaaaaaaaaaaatcggtaagtggttgcctaggcctgggagaattggggcaattgaggagtgctgctaataggtagtttttcctttgggg

SEQ ID NO: 213009 - DNA, 823 bp, Homo sapiens
gttcttttctcagtagctgttttctcctcagctttgtggagtctttccctcagcctgtgcagctctgtattcagccaatgatttgaggccactgtaagcagctctttccctttggagctctttttgtaagcaaaagctcagtttcttacgtaagaaaacccaattccccttgaggaagagaaagagctggagtcctttaaaattaactgcctgtttttctgtggctagggagccttatctctccctttgccaggcattgtgaagactctgtttctctagctgtgcagctgcaaggtcactagacagataatctcaagtcgtaaaatatgccgttccttgaaaagtaagaaatgatgtaatgcatgtctctactgaataagtgtctttgtttctcgcttctgttgtatgcttccccctgcacagatctcttcctgccccagaaatgcttaaaaggtaactggactctttgtttggggctcagtcattttggatgttgatctgactgggccggtgcacctaaataataataagaaatcctcctcaacccctcagtctctctgattcctaaattatctcactgcaaaggcaggagaattgcttgagcccaggagtctgagaccaacctgggcaacatagtgagaccctgtctctacaaaagattaaaaaattagccaggcattgtggcgcatgcctgtggtcccagctactcgggaggctgaggtggaaggattgcttgagcccaaaggcccggtatgagaaggtgatcaacaaggcttcagcgatgaaagagactggtccaccccccgggtctggacagcccggg

SEQ ID NO: 213010 - DNA, 993 bp, Homo sapiens
atggcccggacgaagcagacagctcgcaagtctaccggcggcaaggcaccgcggaagcagctggccaccaaggcagcgcgcaaaagcgctccagcgactggcggtgtgaagaagccccaccgctacaggccaggcaccgtggccttgcgtgagatccgccgttatcagaagtcgactgagctgctcatccgcaaactgccatttcagcgcctggtgcgagaaatcgcgcaggatttcaaaaccgaccttcgtttccagagctcggcggtgatggcgctgcaagaggcgtgcgaggcctatctggtgggtctctttgaagacaccaacctctgtgctattcacgccaagcgtgtcactattatgcctaaggacatccagcttgcgcgtcgtatccgtggcgagcgagcataatcccctgctctatcttgggtttcttaattgcttccaagcttccaaaggctcttttcagagccacttacattctcactgaggatagctgtcacaccattggtcgactgtcttaaatcaactttaaagcagggataaactggcggaaagtcgtcaagggttgttcattctgattccttgcagtgtcctttgtcttctaagacggtccttttcacttgtcctctgtgacccatctcacaagggtctcactttctccgaggaaagtcagcaaatctatatccaaggtcaatccgcttcaaggggaaagccaaagtccttcctgcacatgctgtcctttggggatagcatctccagaaccccataactaacaattagattacaggttaaatgagatgccatttttaactgaaacgggcactgcccttgggtcccctggaagcttgctgaaaatcacggacatgaggccggttgatttagcacatagacacgggagacttcaaaatgaggacccacccaccaatgagatacagaagtttatatatcaccttgagattatagaaagagtgcaagcttggaacctgggaa

SEQ ID NO: 213011 - DNA, 399 bp, Homo sapiens
actctaggcatcccttgtgtttgtcaggatttcagcttatttggggtggctgcaaggctttgagacatgcccatgatgctatgcatttttctaaactcagcctttgtcaaggtagtcagggattgttcattttgaaacctctgtagatatctgcatgtttgctgcaaaggttttgtctaggtgagatggactggctcatgtttcctaatgctgatgcccttccctcccttccatctgtcttttatacacacagatctatttattactttcttttctttgaaaagtataacttagctttggataaaggaggaacaggatcacatttgattaaacgcaagcaacagtttacctcgcatgggcttggatgaataaggaatccaaaaggagcggtattcagga

SEQ ID NO: 213012 - DNA, 928 bp, Homo sapiens
aacagccaacacagcgagtcctcgtctctacaaaaaagaaaagaaaatggaaaacagtatcagctaccatttattgaggactaatcctcacaacagctttccacagtgggcatcattttacaagtaaggaaacaggctaaaagcacttagggaagttgtccaagttcacagtcagtgacaaaacaaggtttgcatccaatggcccaggactcctcacttgtaattatcaggctaatttctccaaagccaagagagcccctctgtggggagagaaacaactctcagttgagtagaaatatttagcattgatcgatgggatggtgtgatttaggcaaccaggacaaattgttctggtttgggggcctacggttcagtgtccctggtttctagacaaccagagagactgaaaatggagcccaggagagtagctttaataaaaggaacttgagttatgtctcctggaaaagagaagcgggaggagtgatttaataatcatgtcaaatctccaaggatggcagccggcagttctgtagctccactgagagaagaacaagaaggaacaggtttccaatccagtgagaggaattaaagttgagtacctagacagatgtcctagcactgcaggcttgtagcttccacaccctcggtgtggactttcctccttgggagagatttgaacaccttgcggaggctcagctggccaggcaggctctgtcctcccaggcaggctccgtcctcccaggcgccgggtggagaggtgggtgtcacccctgtcagcaggctctgctgtgccaagtgcgtttcacacaatgtaacaaaactgatacaggttggtgctaaagtaattgcggtttttgccattactttcgcacaaaccttaatacttaaggagtacaggtcactagccaggccttgtgctttatgtgta

SEQ ID NO: 213013 - DNA, 471 bp, Homo sapiens
aggaaccattctttaataagtggcttattgaattaaaaccattcagtctagctttccctgaggatgcaatttagagaaagtttatcttttattactataaaccagatgtgtctacaaaacaagtgtggagttactagtgaattctagcaagaatttaaggaagaaattaacagcaattctacataaactcttccagaaaatggaagagaagggcatacttctcaactcattctacaaggccagctttaccccaatactaaaattagataatgacactacaagaaaattacagaccaatgtctttcatgaacatagatgcaaaaagtctaaacaaaattttagcaaaacaaatttggaggtgatatctttttagagagcttaaagcagagctatgtgaacatccaaagaaaggacaagtagcatttgctggccctgaataaagtcagtaggggaactgcaatgactgaggca

SEQ ID NO: 213014 - DNA, 257 bp, Homo sapiens
ctgcagagttagatccccagaacaggatctcagctggctccatccttcctcagctgggcaaccatggccaatgactagctttctgtgcctgagttgctccatctgggaattgaagattgtcatagtccctgcttcaaagagtcactgggaggattaactgagaaagtgcagggaaggtgcttggaactaaatgctcaaaaaaagtccatctggccaggtgcggtgtctcacaccagtaatcccagcactttgggaga

SEQ ID NO: 213015 - DNA, 658 bp, Homo sapiens
gcacacattctctctgcctactgctaaatctcataggcccgaacaccatatagtggaagccgcccttaaaactcttgcttctccagtgttaacatgtaggtgccaccataacagaagagatatattataattttaaaacaataaatataaatgcagttattaaacttaagttcttatattttcctacagatggcaaagtttaggcttaaaatgacttaggttttctttcctttttttgagacggagtttcactctgttgcccaggctggagtgcagtggcgggatctcagctcatcgcagcctccgtctcccgggttcaagtgattctcctgcctcagcctcccaggtagctgggattacaggcatgcaccaccacacccagctaatttttgtatttttagtagagacagggtttcaccatttgagccaggctggtctcaaactcctgactcaagcgatccacctgccttagcctcccaaagtgctaggattataggcgtgaaccaccacgccaacctcaaatggctttcctttaaaatttcttgagcctagtccgaagatagtgagttatctcagttgattgttcacagtcagttacagattgaactccttgttccactcttttccccattctcactactgcacttgactattcttt

SEQ ID NO: 213016 - DNA, 934 bp, Homo sapiens
cttttcccggatcattacacgcaaatgcaacaaagccttccattctgtcatacggctttccttttaatgtgtttgttgaagcttattggaggtgaagtttctcacagctgtctatctttgtattttcctttgaatctgtttcatataccagactcgttagaaaaagttgacagatcttattaaagggacaagtgaaataagtgaaaggaggcatcccagcgataaagtatttatgagcctttgggagagtatattgtaaaacatcagctttatttctctctacctactggctaaatgctcatcttggacagaggacaagataattaaaattgttgtggccttctaagctcttgcttctccagtgttaacatgtaggtgccaccataacagaagagatatattataattttaaaacaataaatataaatgcagttattaaacttaagttcttatattttcctacagatggcaaagtttaggcttaaaatgacttaggttttctttcctttttttgagacggagtttcactctgttgcccaggctggagtgcagtggcgggatctcagctcatcgcagcctccgtctcccgggttcaagtgattctcctgcctcagcctcccaggtagctgggattacaggcatgcaccaccacacccagctaatttttgtatttttagtagagacagggtttcaccatttgagccaggctggtctcaaactcctgactcaagcgatccacctgccttagcctcccaaagtgctaggattataggcgtgaaccaccacgccaacctcaaatggctttcctttaaaatttcttgagcctagtccgaagatagtgagttatctcagttgattgttcacagtcagttacagattgaactccttgttccactcttttccccattctcactactgcacttgactattcttt

SEQ ID NO: 213017 - DNA, 496 bp, Homo sapiens
  misc_feature (82)..(82): n is a, c, g, or t
  misc_feature (85)..(85): n is a, c, g, or t
tgacaatcgtgacaaccctgtgatgtaggggctattattttccccaattacagatgtggaaactgaggaacagagaggggcnggnagttgtctgaggtcacacagcaaataggtccagctgggcgacagagcgagactccgtctcaaaaaaaaaaaaaaaaaaaaaagaagggaagacatataaccttcatgcgatgtgagaaggtgcgttgaaatgccttctacaattcttgcttcggtcggaagtcacaaagggattgaacttcattttggctgctcccacttctgtgatggccgcaaaagggaagagaactacatgctcctttttatttattttgtatggagattgggtctcgctatattgcccagcctggtctcaaactcctggcctcaagtgatcctcccacctgactcttcaaagttctggaattacaggagtgagccattgtgcctggcctctacgccccttttaatcctcctgacaaccctgtgatgt

SEQ ID NO: 213018 - DNA, 551 bp, Homo sapiens
  misc_feature (518)..(518): n is a, c, g, or t
  misc_feature (527)..(528): n is a, c, g, or t
acttacccctcctgactggggggggacctgcctcctactgactgggggggaacctgccacctcctcctgggacctgccccctcctgactgaaacttgctctcccctgactggaacctgtcaccttcagactgggaacagccccctcctgactgaaaccagccccctcctgacagggacctgcccctcctgacagaaaccagccccaacctgactgaaaccagccccaacctgactgaaacctgccaactcctgactgagacctgtcttctcctgaaggggacctgccctgtcctaactgaaacctgccgcctcctgtcagggacctaccctctcctgacagggacctgctgcctcccgactgaagcctgtcacctcctgactaggacgtccccctcctgactgggacctgccctctcgtgacagacacctggccctcctgcctgaaacctggctgctgactgaaagcagctccctcctaacagggacctgccccctactgacaaggaactaccctctnggtgtgggnnaaatcaaaagtccgagtgaatga

SEQ ID NO: 213019 - DNA, 480 bp, Homo sapiens
ctaaatgtccattagtagggattggttagataaatcatgatagctgcatacagtggactgctctgtggctgtaaaagatgactgaatatgctctttgtgcacaatgttccgtgttgggaacaatctctagcatatgtgatgcgagaaaaatgtagtacaattataatggtaatgtgcagagtagtatgctagtgtttgtaaaaacaaaggtgtgcagaagtatttgcagttgtttgcaatcggaagaactctctagaagcatatacaagaaactcgtaatactgattgcttccaacaaagggaacctcagggttgcaggacaaagggacaagaactttcagtgtatactttttgcacttgctgaattttgaaccatgttatctattcagaagtttttttctgtaattaaatctccaaaataaagtatactatactgtattctaaaactaagcataccaaatatatttataaatcactgta

SEQ ID NO: 213020 - DNA, 572 bp, Homo sapiens
gaacaagagtgcaggaacggaagcctctatgtgagagataacactggcgtcctgagctgtgagctcatagacctggacctttcttggttgggccatctttttctgttcccccgttggagttacctccctcctgccaggtggaattcctcaggggaagggcacttggagctgtgggatgcccctgtgccagtgtttcctttgaccatcagtcctggccccgtcacgcctatccctgtcctctacccagagagtgcttcctgcctgctcaggctcaggtaatttccccctctaggcatggcaggggcgctgtaaaactgaaggatgatgctgggtcagtggagggagagaaagaaaagggcattgatagtaatatagactgaatgttccaaatcaagggaatggtgggctttgaatattaagaaggtaaagagaagggttgttcaagggatctgtgccttacctaagggaaagagaattttgaaggtttttagcatagcttgctttgggctatggacattttgtatcattaccaggttattctttactgtggaagggacagcatttatagggaa

SEQ ID NO: 213021 - DNA, 679 bp, Homo sapiens
gaacaagagtgcaggaacggaagcctctatgtgagagataacactggcgtcctgagctgtgagctcatagacctggacctttcttggttgggccatctttttctgttcccccgttggagttacctccctcctgccaggtggaattcctcaggggaagggcacttggagctgtgggatgcccctgtgccagtgtttcctttgaccatcagtcctggccccgtcacgcctatccctgtcctctacccagagagtgcttcctgcctgctcaggctcagaaacaagctcagaggtgtgcagcgaaacctggctgggagtctagttcgattgagtgctctggtgaaaagtaaacagaaagcttacttcatcctgtctcttggtagatcacacccagctgtcacccacgtgtccatcatcgtgcaggtccctgcccagctggtgtggcacagagcccttcggcctggtacagcctatgtgctgacagaactgcgagtgtccaagatccgtggtcagcgccagcatgtttggatgaccagtcagtcctcccgtctgttgctgctgaaaccagaatgtgtgcaggagctggaactggagctggaaggacccctcttagaggctgaccccaagccactccccatgcccagcaactcggaggacaagaaggatccagaaagtcttgtcc

SEQ ID NO: 213022 - DNA, 1525 bp, Homo sapiens
tatcaattttgacaaaataagtcctttaacaatccacttagagttaatattgtaccacttaacttaaaatgtagaaaccttgcaactatataggtccatctgtcctcttctcatccttcatgctatagttgacatgtgcattacctctgcttatgtagctaaccttcaaaaccatgtgataatttttgctttaagcaattacatggaaagactctggctgtcaacatcagtatgttcacctctttgcatgcaccaatacaaagtagtttcttcagtgtaacactcctgtttttccttttggaaataataagtaatttgtgggcagatactgcatataggctgtttctcttccaacttgcatctgctacttttagtattgttgataattcttacttgaatcagttattaatttgatggttggttgccaagtggatattttcctactttttaaaggtagaaaattgaacattttggtaattttataatgtactgaaaatagcagtctatatgacatcacccatatcattcacgaaattaaaatatagtacttagagtttttcagttaatacagcatttactttttttgcatattcttacaagcaaagcatgtgagatttgctttctgtagtttaagaaaataaataggcatgttaagcatattgattttttttaactacaagaactttttgatattatttttctacccaaaccccctaatttgagaattgcctatttaaatcatgacattcaattcatttggatcatcactttaccttggctctcagtgattaccaataaatattaaatgagtattacccataataaagtattttggattaagaaaataattgtacatttccagccttcactaagtttacattctagataattaacttttaaaaattaaaacttggtcactgctcatgcctgtagtcccataattttggaagcctaggcaggcagatcatttgaggcaggggttccagaccagcctgggcaacaaagtgacacacgtctccacaaaaaataaaaaaaaattagttaggtgtggtgacatgtccctcgggctgcagtgtagtgagctgtgattgcaccgctacacctcagacatatatatatatatatggcctatttttttaaaggcagatgtttcattgattttttatgttgtgaataatgagcatgataagtccttgaaattatatacctctgtactccataaattgagagggaacattgtgaactcaaaaaatcatggtttattttcaacatgcaaatcactttgaaaccttacacagtctcactgagttaagcattttgcagcgaactgactttcttcctgtcatcgaagacctctgtgagtcccgtttggtttatacttgtgttcatttaaatatttcaaaactaccccagaaaaaactttattatcacataaccatgaataagaggtataactcttaaaactcacctttttttgcacattgagctacaagtatcccttcataaatgcaagaaggagtaagct

SEQ ID NO: 213023 - DNA, 540 bp, Homo sapiens
gcgcttgcttggtgctttgattctaagactatgcatttttgttcctggcctactttttagattgtattatattttattttttaagctgtttcatgtatatggccaagaatcaggatggtactaaaaggagtgccttggaagtgtcggcccacccctgccccacgcgcccattcctcaccggcaggcactgcccactggtgtgcttctgtccacacccacttgtgtttttaaacgcataacgagtggaaagataggagtattcttttacagatgataacatagcacacgtgtgtttctaggctgtgtgcatgtgtattcatgcttttctccctctcccctggtgccatcctgtccgcagtcggctccctgtccacggcgtgtggctccttcaggacatcagtcacctgttgtccatgtggcacatcagtggactgtgcacaccccccgccttccccagctgtctgtccctagaacgcatcaggttccatgttgccgttacagtggagcgttccgtgtccataaaacgttttttaactggga

SEQ ID NO: 213024 - DNA, 606 bp, Homo sapiens
ttttttttttaaagagatgaagtctcactatattgtccaggctggtctcaaactcctggcctcaagtgatcctccacccacttcggcctcccatagtgctgggattacaggcatgagccaacgcacccagtctgcaagtggatttttaaggaacaaagaagagagagttcctaaattgttaccaagaatttacattgaaacagcataaggtatctgcaggtctggctcagaaaaaaagataacagaaggtattaattggctatgcactgtttattgtatcacaaattccaggaacaagaagctaatggggagggcagctgtgcaggaaccactgcctcgggcatgggtggaggaggcgtgtgaccgaagtcccctattcactgtacagtctccctgggcctgatacatttcgcatagctcagactgatctgagctatttttcttttctcaagttgggtgggggtggcccctctggactggaaaagcctcatttttcccccaagtgacacacctgagtttgtttgacttgtttcccccaagtgacacacctgagtttgtgggacttgtgtggagatgatgtatttatgtcacacttcagtcttcgct

SEQ ID NO: 213025 - DNA, 521 bp, Homo sapiens
cagagcagcacatctagaagaaagagtagtttagatctagacattgcctctggctagcttagggccttaagcaagaaaatggagtaatgatccctacagttcgtgttgttttgaggagaaactgagatgatgcatgtgataatgtaaactataaaatgccatacaaatataagctattgtatcttgagatgtatggccagccaaagaagaaaaagaatagtttaaccctgactttcgacaagaccacagtgaaaaaaccatgtttcccaatgctgttttagcaataccctagggaagatcccaggggcctgtgggactgccacaaaattcttgcaaaattgtcttaaccaggacactttaatttcaccatcattaaaaaaataacttgccattgagtacatctgggaacaggagatgtcagaaaatcaaagattgaatgtcaaaatagtgaaatggtagatgaagatttaggaagcattcggttaaaccaaataaaacaagttatttgctgctgttttact

SEQ ID NO: 213026 - DNA, 628 bp, Homo sapiens
ccatgcgcgggatataatctcctggtgtgccatttgctaaaaccactggaaaagtgcagtattagtgtgggagtgacctgattttccaggtgccgtctgtcacagcttcccttggctaggaaagggaattccctgaccccttctgcttcccgggtgaggcgatgtcttgccctgcttcggctcatgctcggtgctctgcacccacggtcctgcacccactgtccgacaagccccagtgagatgaacccggtacctcagttggaaatccagaaatcacccatcttccgtgtcgctcacgctgggagctgtagactggagctgttcctattcggccatcttccagtatactttatataatctttagattgcttacaatatccaatgtagattctatgtaaatagttgttatacaatatttttaaataaatattactttttattgtttttatccccaaaatattttgatctgtggttggttgaatctgtggatgcagaactcattgctatggaaggctaactgtactaaagagcgttcttcagttagaaggaaaatggtctcagacagaaagctagaagtggagaaaggaatgaggaaagatgaaaaggataaatgtgtggatagatggaa

SEQ ID NO: 213027 - DNA, 756 bp, Homo sapiens
tttccctttaactttacagattacactcattcccaatgttaagtgggtcagcaccttattccctaaccaccttcagtgaagttgttttataaacttgtcatatacttagacttgtcactttctgcattccatccttgtattctccaaactaattttttttaaatttgtacctgttaaggtttatattttgccataaaatcctatggattttgataatgcttaatatcttgcattcaccactactgtattatacaaaatattttcaccaccctaaaaattcccctgtgttttatatatttagctagtccttctccaccacctactgaacatctggtaaccactgatctgattaccactgctacagttttgcttttttagactttcatataattggaataataatatgcaatatgcatttaagtttcatttatatctttccattggcttgatagctcattgcttttcattgctgaataaatttcattgcacagtatgtcaagtttgtttaatcatctattcaagaaacacttggttttgctctgcttttggtgaataaaattcctataaaagtttgcatacaggtttctgtgaagttttcaactcatttttgtaaatacctaggagtgcaactgctggattttgtgttaagcctatgtttagttttgtaaaaacctctcaaaatgtcttccaaagtagttgtaccattttgcattcccatcagcaatgaataagagttcctgttgctccacatccttg

SEQ ID NO: 213028 - DNA, 617 bp, Homo sapiens
aggcagaggttacctcgaatcgacagtttctctttgccagactagactaaagaaggagcactactttattctgataaaacaggtctatgcagctaccaggacaatggaatctacgttgactttagcaacggaacaacctgttaagaagaacactcttaagaaatataaaatagcttgcattacagggtctctctcctttgggatctcacctcaccacaacctctgtttcccaggctcaagtgatcctcctgcctcagcctcctgagtagcttggaccacaggcacatgccacaaggctcagctaagtttttgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcactagatatcgttgtggagagaccagattagaggccagcctttgtcttgttcagatgactgttgcacaggaaagactgctggctgactat

SEQ ID NO: 213029 - DNA, 487 bp, Homo sapiens
aggcagaggttacctcgaatcgacagtttctctttgccagactagactaaagaaggagcactactttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcactagatatcgttgtggagagaccagattagaggccagcctttgtcttgttcagatgactgttgcacaggaaagactgctggctgactat

SEQ ID NO: 213030 - DNA, 330 bp, Homo sapiens
gaaagaggtctgggtgcttaaaaagatagaaactttttcaacttgtaaagaaatgtgagccctgacaaatatgctccccttcctctatgataactctgcagcctaacagggactatttcaaatgtgagcctggcctcaggttgaagaatgccgggcctagcccagatcagggttatggagtctttgaactaaatttcagcacctggtctggtgaagaagggaggaaatgggtctgtgccccagctacaaatgccagccacagagcaagctccatgacacctgcagttaagcagtgggaaggactgacccctatacaggaagagcccttaa

SEQ ID NO: 213031 - DNA, 532 bp, Homo sapiens
atttattgaataaagcgtcctttctctattgtttatttttgttgactttgtcaaagatcacttggttatagatgtgtgagtttattttcagggtctctattctgttccattggtgtatgtgtctatttttgtaccaatagcattctgttttggttactgtagccttgtagtttagtttgaagtcgggtgatgtgatgcctctggcttttctttgcttatgattgccttggctatttgggctctttttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcagg

SEQ ID NO: 213032 - DNA, 624 bp, Homo sapiens
  misc_feature (11)..(12): n is a, c, g, or t
cgggtccctgnntaatgattaaagatcttattgtacagctcactctatttgagccacgcattcccgctctcccgtgatgttcatgcatctggtctgtggaccacactttgagtagtacctaactagctagcttatgcccttacccactaaagtgcactattgcgtgttctatgccacagctggattctgtacttccactgcctccattactcaacattacatctaactattggctggttcctctgattgcttcctgggtagggtgaccaagtgtctcagtttgcccaggaatgttcctgttctagcactggaagtcccatgtcccctcagtcacaggcaaaccaggatggtcctgggaactctggctgtttcccagactctccaactgtgccttcaccccagtaactactgcatgggccctcgggctgttaactcgcttcagttataccattctttctggctctcctctagtctctctagctggccactggtcaatcaggctgctacccacactggatacatgtttaatgctcacttgacttgttccctagttcctctggttacttcccagggcctctggtggaccctcagccccaagcacattttggctgctccctctggctg

SEQ ID NO: 213033 - DNA, 281 bp, Homo sapiens
tgcctacagtcacacaataagctggtctcacaggcaagaccatttccaggtctccaaatgttctgcctggagctctgcctaggtttcctttaaacccaaactcatgcagggatggagcagatgaaagtgtgtgagagggcagaggttaacacaagagtcctgtgggcccatgtcttacaaacgcaaatgctggattattctgttataaatccttcttgggaggaaatttattattattattattattactccagcctgggcgacagagcgagactccatat

SEQ ID NO: 213034 - DNA, 552 bp, Homo sapiens
ccaaactttttgatcacaccttcctatttgtgaaatagttttgaggatacttacaaagtaattataaatctgtactcctataaataggaaagctaagtctttcctttagttaaagcataaacagaactccaactgataaagctttcttcctgccctcaatggctatcttgagcactgcttatctactgctctagtttaggagctcggtgaggacagcaggggtgtttcattctcgttgtattcccaggatctctaccgaacccaaaacataataaatgaaaaaatgaattaatttacttaacagatagtggggcccctctgtaggccaggcccgtgctaggtactggggacatactggtgacaagaaagagccctggccactgttgtcataaccctacaggctggtagggtgggcaaacaatgattttccaaaaaagtgtaacaaagaccaccgaaccataagagccctcaaacaggagagtgtcacctaggaagcagggccagagataatttccccagaacatgacgctccaggtgagatctgaggggtaa

SEQ ID NO: 213035 - DNA, 530 bp, Homo sapiens
ctgctgttgaagtagtcagatgagtaagcattgtgtgcacaagacttttccttttttatgtaaggtcacagctgcttgtgtttgccattgtgctacacatttctctactgaaaagggggctttaatttctcatttgacaagtgctagattactcagtgcctgattatcaagttacggattacctaagattaccatccctcccttccttccttccttcaccatcctggaacacttccttagtggtaattctaccagcagatcctgtgagacagaggcccacgcagtagtatcagagtcataggagcggcaggaaagcgcccctcagtatcaaccggtgccggttgggtttgtcctctacctcccatttgggtctagtcgcactgtacagctacggccgtgtgatttaaaaacgattttatccatgcaaaaagcatgtagagatcgtccagaaaggttccatatcacctttcagtagtgtgttctaatgtctcaccattcttttctagtattcaaataaaaatacgcattgc

SEQ ID NO: 213036 - DNA, 541 bp, Homo sapiens
  misc_feature (43)..(43): n is a, c, g, or t
  misc_feature (496)..(496): n is a, c, g, or t
  misc_feature (533)..(533): n is a, c, g, or t
tgtttatctcatgtagctgtactctccgcttgactaccatcangtatgctcctcgactcttgaggataacccatcgcatgtgccgctccccaactctgcatctggagcctgcatctgtttatgcctctcctcatgttgctgctcgtctccttgtgaatgtctcctcccttcctttccagccatctcaatcctgcgtgtctttgaaggtccagccagaaagttttcttcccctatgaaatcatcctggagtaatcgaatccatttctaaattctaaatgctatttgttactgacctatgctccaccctgcccctcttccaggtaaatgaatggctgtttgctataggcaaaaactgggttttgtgataaatcattcagattttactttttttttttttttttttttttgaggcagggagcggcacatgggagcggcaaatgcgttgggagcggcacatgcgttgggagcggcacatggaggggcaggtgatccgatngagtcgaagtcatacatcatgagctaaaatcatgaancagaacct

SEQ ID NO: 213037 - DNA, 483 bp, Homo sapiens
  misc_feature (43)..(43): n is a, c, g, or t
  misc_feature (451)..(451): n is a, c, g, or t
tgtttatctcatgtagctgtactctccgcttgactaccatcangtatgctcctcgactcttgaggataacccatcgcatgtgccgctccccaactctgcatctggagcctgcatctgtttatgcctctcctcatgttgctgctcgtctccttgtgaatgtctcctcccttcctttccagccatctcaatcctgcgtgtctttgaaggtccagccagaaagttttcttcccctatgaaatcatcctggagtaatcgaatccatttctaaattctaaatgctatttgttactgacctatgctccaccctgcccctcttccaggtaaatgaatggctgtttgctataggcaaaaactgggttttgtgataaatcattcagattttactttttttttttttttttttttttgaggcagggagcggcacatggttgatcctatgagtctgctcatncataaggagataagttcaatagagcgcaacct

SEQ ID NO: 213038 - DNA, 469 bp, Homo sapiens
  misc_feature (437)..(437): n is a, c, g, or t
aggttctgctctcatgaatttattgcttattgcatgcactcgactctttggatcccccaacccatgtgccgctccccaactctgcatctggagcctgcatctgtttatgcctctcctcatgttgctgctcgtctccttgtgaatgtctcctcccttcctttccagccatctcaatcctgcgtgtctttgaaggtccagccagaaagttttcttcccctatgaaatcatcctggagtaatcgaatccatttctaaattctaaatgctatttgttactgacctatgctccaccctgcccctcttccaggtaaatgaatggctgtttgctataggcaaaaactgggttttgtgataaatcattcagattttactttttttttttttttttttttttgaggcagggagcggcacatggttgatcctatgagtctgctcatncataaggagataagttcaatagagcgcaacct

SEQ ID NO: 213039 - DNA, 467 bp, Homo sapiens
  misc_feature (4)..(7): n is a, c, g, or t
  misc_feature (64)..(64): n is a, c, g, or t
  misc_feature (449)..(449): n is a, c, g, or t
  misc_feature (462)..(464): n is a, c, g, or t
cggnnnnctctgctgctcgatttagtaccgtacgtagcggccgactctagtgagccccaacgcngtgccgctccccaactctgcatctggagcctgcatctgtttatgcctctcctcatgttgctgctcgtctccttgtgaatgtctcctcccttcctttccagccatctcaatcctgcgtgtctttgaaggtccagccagaaagttttcttcccctatgaaatcatcctggagtaatcgaatccatttctaaattctaaatgctatttgttactgacctatgctccaccctgcccctcttccaggtaaatgaatggctgtttgctataggcaaaaactgggttttgtgataaatcattcagattttactttttttttttttttttttttttgaggcagggagcggcacatggctcaaacagagtgaagttatactataagttctttancatcaaccaggannncct

SEQ ID NO: 213040 - DNA, 678 bp, Homo sapiens
ctaatcaaactgtaaatatttgaaggataatggaagccaagtttctccatgtcagagaaaggagttacaagcatatatggaaaaagctactttcaatcctgtgatactgatttgtaataagcagtatcagcatgaacttaacagttttcaatacgtaacatggagaaataaacagatatatgtatacatgtatgtatacacagatacacatatattcaacacacacacacacacacatgcacatacaccctagctctgtccaactaatggacctgaaaccagcaacatcccaatggtaatgagaaaaccaaatgccacgacttcataaataccacctactactaaaaggaatcaggactctttaggaaaatggccaattccaaggctaagcaggaaaagtataagattagcctggaacattttgttgtgccagaaagtaaggaagttatcaaaaaaaatgaaatggtatcaaactgacccacagaagtgatatcaaaagggttcttactggccaaatcaggacattttgagcatcaaaataatgaaattaaaagaatataccccatcgaataaaataagccatgagtccatacagattacaaatcaatgttaatttcttaaatgttatggttgtattgtgatatggtcctggtttgttaaaaatacacactaaaatac

SEQ ID NO: 213041 - DNA, 338 bp, Homo sapiens
  misc_feature (1)..(1): n is a, c, g, or t
  misc_feature (3)..(3): n is a, c, g, or t
  misc_feature (18)..(18): n is a, c, g, or t
  misc_feature (23)..(23): n is a, c, g, or t
ntnttgaaaaccgtttcnaatcngctcggtaccccagtctagtgattttaggcggtgggacaccgaatttattcttaatacatgtatttgtagtaaagaatccaaagtccttattctaagaaatttgacagaagagtacaaggcacatctatatacccaccacctagaatcagccacggttaccattgccttgtatttgctctgtgtgtataacatgtttgttgttgcactattggaaaataggtgcagaggtgccgaccttcacccctaataaatactccccctctgtctcctgcgaggaaggaaatcctctcattttcacctaaaatgactgccaa

SEQ ID NO: 213042 - DNA, 445 bp, Homo sapiens
cagggaggcatcatccaatgggagcggccagcctcgctatagactttccaacactaatgaatcgggaactccatgctgaatagggtttagtttgatgggtccctgtgccagcagaaggatgtatttttcttgaaagaccaaggtgccagaaatctccatgattacgttactggagaaaggttcttttttgtggtttgtgaagttgagcgtcaggactgcaggattctcttgctctttctcactcttattttttccaggtcagaaccagagcttggggtggggaggaaaatcctgctgaatgagcaagttctttcttaaaaagctctctccaagtccaaaaagacttcagtggacttaggagaaagaaatttaatacattgccatagaatcgtcattaaccaagttaaagcaaagtccacagcatctttgtcttataaaagaaagc

SEQ ID NO: 213043 - DNA, 413 bp, Homo sapiens
gggtaagggtgagggtggggtccctccagtgtttcagaaataaaagagctgttcccaggggtaagcgatgcttgattggaagtacaaagcctttcttgtcttcataagcctgttgatgtctctggtcctgatcctgaaatcacagatgcagacagactaacagacacaggcttacaacttgcagggcaggctcacagagcaggtaccacagagggcctggggtcactgtgcacttggaagggccagagcttctgtcccctacatctgatatctctcctctgcctggactctccatgcaacaactgggcctccaaactccaagcccctcttgccttgggacccctccagcccagggacaccagcctgagttgtacatattgtagtccctgcccctagaggtcaaaaaaacaaaa

SEQ ID NO: 213044 - DNA, 458 bp, Homo sapiens
ataatagttttaaatttctgagtgagttatgtaatcttgtaattatttaatgctattattcttagattttaatagtgtatttttcttatatttatttttaccttgttaccgtattctttaaacagtaatatctcactggtctgtaaagttttcaagttgtatttagctttagttacctttgaaagataaataagtatgaaaaaaatcgtacaattagggctataattttaacttcttgtattccctagaggatatattttatatgtaagttaaactgtaatgtatttatatttaattgcaacatcttgtatacaagattttattattcttgtgttgcactcttagacgtggttaaatgtattgttacctaaaaatattactctaatgaataaaaaatcatattgaggttataagtctgctttatgatacttcatatattaaacttttgctcactaaag

SEQ ID NO: 213045 - DNA, 735 bp, Homo sapiens
tgcaaattaagaaattatggattaacttattgattattgctcagaaaacgtaccttatttttactctgaaattcactttatttataatactttaaaacaatttagctaaagtagtgtttataggatgttacttctctggttagacatgtttcacacaacagttttcaatgctgaaaattcatttgataattttaatcacaatttatgattgattgatggattaatcagtaatttagatgccataagaaccattgaaaggaataatctgactattgctcattgtacaatcttgatcattagttataagccaagaatctgatatcccactcttgaattacatttttcaatgtgtgtatttggtcaacaacaggtcacagtgagccgagatcatgccactccactccagcctgggtgacagagcaagactccatttcaaaaaaaaaaaaaactgaaaataccaaatattgacaaggatttggagcaagtggaaccctcatacattgctgatggaaatgcaaaattatacagccaatttggaaaaataactgggtgtggtggtgtgcacctatttttccaacaacttgggagactaagctcctgccatataaaatgccggctcctgctttgcctttcaccatgagtaaaagcctcctgagaccttctcagaaacagatgctgccatccttcctgtacagcctgcagtaccgtgagcaaaataagcctcttttgtctata

SEQ ID NO: 213046 - DNA, 645 bp, Homo sapiens
tgcaaattaagaaattatggattaacttattgattattgctcagaaaacgtaccttatttttactctgaaattcactttatttataatactttaaaacaatttagctaaagtagtgtttataggatgttacttctctggttagacatgtttcacacaacagttttcaatgctgaaaattcatttgataattttaatcacaatttatgattgattgatggattaatcagtaatttagatgccataagaaccattgaaaggaataatctgactattgctcattgtacaatcttgatcattagttataagccaagaatctgatatcccactcttgaattacatttttcaatgtgtgtatttggtcaacaacaggtcacagtgagccgagatcatgccactccactccagcctgggtgacagagcaagactccatttcaaaaaaaaaaaaaactgaaaataccaaatattgacaaggatttggagcaagtggaaccctcatacattgctgatggaaatgcaaaattatacagccaatttggaaaaataactgggtgtggtggtgtgcacctatttttccaacaacttgggagactaaggtaggaagatcccttgagcccaggagtttgaggttacagtgagctgatggc

SEQ ID NO: 213047 - DNA, 262 bp, Homo sapiens
aattgtgtgtacaatacagatgccagcgagagaaaacaggaaaatggttggcatgtggaaacaaacacgtgaaaacaagcaaaggaaactaagcaaaactactacactccttgcttccgtgacagttgggagccgaggcttgaagtccatggttccttctcccatcactcatcctggattttcccctccctcagccgggacctcagctagttggtgatctttacttgatgaaacaactaaaactttcatttcagaaggttct

SEQ ID NO: 213048 - DNA, 679 bp, Homo sapiens
tccaaatatagaaagaaatttactaattttaaaggcatcacttcaagtcagttgagaaaaaaatcatcagtagtcttcatcaaaatatacatttaagagttttttgaagtagacatgactatttctctttccttcgtttaatgaaatgttttgagagtaaaagcaaaggaattataaagaaaaactgtgttagattaaattacatacatttgaaaattaagagcttttgaatgccaagaaaacagcatatacaaaataaagaaaaacactaaactagcaaaaatatgtaacattatataacaggcaaaggattagtgtccctaataaataaagcattgtacaaatcagtaagaaaaaaattgaagcaggctgggcacagtggaccacgcctgtaatcccagcactttgggaggccgaggagggtgtatctcttgaggtcaagagttcaagaccagcctggccaagatggtgaaaccccgtctctactaaaaatacaaaaattagccgggtgttctggcaggcgcctgtagtcccagctactcgggaggctgaggcaggagaattgcttgaattgcttgaattgctccctcctgggagacgaggttgcagtgagctgagcttgcgccactgcactccaacctgggcgacagagcaagactctgtctcaaaaaaaagaaaa

SEQ ID NO: 213049 - DNA, 246 bp, Homo sapiens
aagtacaaaaacaagattttatatatctagattataccaggagtgggagggggctgccctggcaagtggagtggatggtaataagagggtaccaggaaagtatgagtgatgacgctgatagctggcattaggtgctacactcagaaggtcactggtgtttgcccctaatcactcaggtagcaatggctgacccaagacctgaatgtgaacggctttgttcccaagctcttgctcttgttgcagcag

SEQ ID NO: 213050 - DNA, 460 bp, Homo sapiens
ctcagtgctgctcaatagtctcataataggctgctggcttttcaccgagtaatctaagagaggaaggttgaagccaaaagacttatagcctagctttggaaggctcacactgtcatctctgccatactctaaatagagtcagacaagcagaactgatttcaatacagattatatgagagcatgactatcagaaggcaagtattattggtatcatcttggagattggctaccacagggagaaataagaaattttgtttttgttttgagagacagtggtatttttattcatttgcatcttccctggcagtaggtctctagtcattacttttacaaatttagacaaatttgagatagttggtgcttcttcatgacaaaatgttgagttaacatttgtgggattacaggcatgagccactgtgcccagccagtaaagttagttttaaaaaagagaggaatctaa

SEQ ID NO: 213051 - DNA, 528 bp, Homo sapiens
ttaaattttgaggctgccaggatgaatttatcctgaaaactccttctgagggtatctcacaaaaatataatgacttacactgagcagcaggagtggtagggaacttacaatctgccttagaacaaaatggacagttactgaggagttagtgacaagtgtggtaccacgcagtgccttactccaggtgattttgaatgaatgctttattagccattgttctcaaaacagcagtgtaaaatcatagctacacctagtgggcccagatggacacagttttaagatatactctaagaagagtcacagaataattgaacttcttaattgctaaccagatctggaagttatttccagagttagtgatacttaggagtctaggtaaagaattacgatatggattaagtgagaggcttcaccagaggctttccctagaaggtaaaatgtgtcagggtgtgagaaaattgctgtctggcaggtctgcttttcctccatccctacctgcatcatctatgggaaaatggtttccctcta

SEQ ID NO: 213052 - DNA, 514 bp, Homo sapiens
acactccagcctgggcaacagagtgagactctgtctcaaaaaataaataaataaattttgagatttatgtgtgtgccagacacacacacacacacatatgtacacaagcaatttttgtgtgtgtggctcaagccaggcagagaaagacaaatactaaatgatctcactcatatgtgaaatctaaaaaagttgatctcaaagaagtagaaaggagcctggtggttatcagagtctggggagggggttggggagatattggccaaaggatatacaatttcagttaggtaggaggaataagttcaagaagtcgattttgactatagttaataatgtgttgtattcatgaacaaggctaagagagtggatgtaaagtgttcttaccacaaaaaggataactacatgaggtaatgcacatgttaattagctagatttagtaattccataatgtatccactgtgtccttcaaaacatcgtgttgtaaatagtaaatacatacaattttatctgtgaatta

SEQ ID NO: 213053 - DNA, 188 bp, Homo sapiens
agagagcgcacgaggccagggaggaagtggtatctttggctttcgttctcatttgattactaataaggtgtaaaattgctgctgctgtgatgattggacactcagcacagtgcttagcacacagcagctgctcaacagatatttcctgaacaagcaaaaaatgaatgaaagagcaaagtcgttaaaag

SEQ ID NO: 213054 - DNA, 286 bp, Homo sapiens
gaatcccccctcccctctctaaaccaaagtataaaagaaaatctagtcccttcttcggggccgagagaatttcgtgcgttagccatgtctcagtcgctggctagtaaaggactcctgaattcgtctcaatgcgtggcatttctctctaactcactcgggtacgacagtttcaactatggtagaagactcgagtaaggcaaatacagtccccctaaatttgactattattcaggttaatggtgagtttagaagaaataaggctacacagagtgggctaaagtgcaaa

SEQ ID NO: 213055 - DNA, 493 bp, Homo sapiens
ccttgccccacgatgtagagcttttatgtcatagttggtccaatgttctgtggaccactaaagagcaaggatggactgccccaactggtttttgtaatttcctaaaaccatacattcatttaactagaggatcatagaagttaaagaggtaaaacaaactttggcaattaagacaggatagcaagatgcaaatgcctggttggaatagatcaaatatttgtccacatgttaaacaaaagcaattgttatgcttgtgcacatggcaggccagaggcccaaattgtcccctttccactagagtggtcctccagttgaccaggtgtgggctgcatgatagctcttttccaggattctacagcctggagtaataggtcatgccaagctctctctgctatatcctgaagtctggcaccctgtgggtcagcccctgagggccatccagcttctaagttcacttcgtgtctctcatgacagggagaaaacttagtgtttc

SEQ ID NO: 213056 - DNA, 308 bp, Homo sapiens
ctcccatgaaagaagtcgccaagtagatgccatgtcttatcccctctctgacacagagcatgagtgtttccacttgctgttatttgagtagagaaagaagtcatcccatggattgaaaacaggactcagtacaggttgaatatctcttatccaacatggttgggaccagaagtgtttcagattttgatttttttttaattttgggatatttgctgaatacatccctgttgagcatttctaatgcaaagatccaaaaaatggaatgctccactcaggatttcctttgagcatcatgtcagggctcaaaa

SEQ ID NO: 213057 - DNA, 619 bp, Homo sapiens
ccccaagcaggatcttcttctcaccttttcttcctcctctagcacttctctttccaagtgtcttaagcagatgcaatgtcttaaagcagatgcaaatgcatttgccatcttctccattaggaaaatgatggttatgtgatatgttatatttaggaagtagtgtgtaaggtatcctgaaaaggtttgctctcaagctagaaggacatttcaccctgtgggtcactgtcaccttgtcagcgtgccggctctcagtggtccccaggaggatggggatagctgagatcgtggagaatgggaaataccattgcatctctttgatttaacactcatggctcacctttagtagagttgttaataagttagaaacttgtgtccctaaggcccaagagaaaagatgagcttcttgggaggattctgggtttgttttcccctcagaattaaaaaatagtttttaattcagctactttttcccctcagttaaaaggtagcaggagctattggctgaaatttgttacagtgaatgaatgtggagaataaataagaacaaaccctgtaggattcttgttgacgtaactttccatcccacctctccgcctctccttcatcaccagccttcatc

SEQ ID NO: 213058 - DNA, 351 bp, Homo sapiens
caattatgttcttctcttcttgctagtcactggtttagaagtgggcatgtaatttaggaataaccaatgagacttgagtggaagtcttccagaatctcataggaaagccttcctgggtcctaaagagttacacaaataggcttctttctcaaaacactgtcaagtctgggtgtgacatctagaactgctacagccataaggtccccatcctcaggataaaccaatacggagatgcacatagaacagagagaatcacagagcagccaagtcccccgataatgttttccagatgcccccacctgtggaattcttatcatgttaactaatatgtttccctatttcttaagccaa

SEQ ID NO: 213059 - DNA, 408 bp, Homo sapiens
agaagggactctattaagaacataagcttgaaagcagtgttttacacattgagaacttaaatgtgaaaacaggcattttcaagaccttagaaacagagagggggaaaaaaaaaagcagaccactgccttgcattgtagagtaaaagagaactgaccgggccaggcacagtggctcacgcctgtaatcacaggactttgggaggccaaggtgggcggatcacctgaggtcaggagttcgagaccagcctgaccaacacggagaagccccgtctctactaaaaatacaaaattagccgggcatggtggcacatgcctgtaatctcagctactgaggaggctgaggcaggagaatcgcttgaacccaggaggcagaggttgtggtgagctgagatagcgccattgcactcc

SEQ ID NO: 213060 - DNA, 126 bp, Homo sapiens
cctgcaaagatgtagatgagcaaatcaaccggcatttcacagtcagacacagctctcagcacaccgcctgttaaaatacaaggtgttagggctgggcgcagaggctcatgtctgtaatcccagcac

SEQ ID NO: 213061 - DNA, 985 bp, Homo sapiens
aagctggaatatctgagggagtagatgtctgtgttggatgaaagaaaatttcagatttagtttagattaagcaaaaaaaaacttgtagaatatatatgatcctagttatattaaaaagaaaggatgttcttaaaaatcagctttattgaggtgtaatgtacatacaataaaatgctctcattttaagtgtgatggttcagtgcattttttttttttttctcagagtctcactctgtcacctaggctggcatgcagtggcacagatctctgctcactgcagcctctgcctcccaggctcaagcgattttcttgcctagtctcccaagtagctgggaatacaggtgcgtgccaccatgcctggctgatttttgtatttttattagagactgggtttcaccatgttggctaggctggtctggaactcctgacctcaagtgatccacccagctcggcctcccaaagtgctagtgtgagccaccatacccagccacattttgacaaatgtatgcatctgtgtaaccaccaccatagtcaaggtagacagcatttccatatgcccccaaatttccttacactcctttgccatcaatacaattcatgattttagatgcaattgtaaatggacttattttcttaatttcatttccagttactagtatatagaaatataattgagttttgtattttgaccttgaatcgtttttaaaaattttgaatccttggtgtcctacccaatggtgggcgggaatggcctggttacctgtaccagggtgaattctggttaccgtttggaaatctgaaatctactatgcaagcggatcacggagtgtgtccctgagaccgaaaccgggggcgcccccgccatagagggaccggggtaacgcagacacgcccaactgcccactggatgacggcccgaaggaatttttgcgcagagacgcaggtgtcgaccgcgggcggagcggagtagcggagcggcggcgac

SEQ ID NO: 213062 - DNA, 356 bp, Homo sapiens
acaggcgtgtggatgtggaaccctttctgggacggcgaaaccagctcttacgccgcttccgcgcgccatcactccctaccctgacctcgcacagaatctgtttcattaatctgctattaatgttttttccccaactcatgttactagacgcaggcgtttaactaccatgttttgttattgaaaactttttctacttgaaggcttttttttttttttggacgattctgtgtttagattttggcctgttcctcattttaaaatcttgcacccccagtattgtactgtacattctgtcctgccacatttaattgatatagatgtagttctttaaataatacagtagtcgtaagacaatg

SEQ ID NO: 213063 - DNA, 815 bp, Homo sapiens
tttcagggagacgtggggttttagcttccagggaacaggatcaactcctgaaaaatgaagctgatggttcatattaactttaattattatttaagctaagaataaaatatagatctctaccaattaaaaaatgtttagcttattatatgtttgaagttatagatgttttctagattcagggatatcctaatagcttgtctgtagtttaattgtgtggaataattggatattaattgttgaggcccagggcttgcccattctgaggtagtttttaaataagctttctttatttttagatgacttcctaaagatatgctattgtctaatcaagttaaataatctcaagacctgtaagtttgcaaatatatataatcactttcctctcctgataaatttggactttcccatctttattgctacctgataataaatcagtggctagtcagtcttcatggtccattagatttcactgaggttgaggcccttcaatcttaactctggattgactgtttaaaacataatggcacttggttaaaaaaaaattgaattttgaacaaagtctgtctggtaagatgtcctaattcatcagagatcggcttccctccctgacattgctggcacacaggctgaatggcggctccctgggtcatggaatcggaggacacggaatgaaccggttaacggggggttcggcccaaaacgaggggcacaagggggcccaagggggccggaaaacccaaagtggtacaggttgcaccggaggtccccacactttggaaccccgataaggaaccgcataactcacacgcgcgccg

SEQ ID NO: 213064 - DNA, 164 bp, Homo sapiens
tggtgaacatggaggattttattgccagtgaaagtgggtctcagcaggaaggagaactggcaaggggatggagctggaaggtgattttccccaagtctagccatctccagctggactcctctccaaagcaacaccatcaagctgcccctctgaagtcaagctgc

SEQ ID NO: 213065 - DNA, 238 bp, Homo sapiens
cttaggcaaccactaatctactttatatatagatttgcctttcctggacatttcacaaaaattgatttacgcaatgaatgagtaaaaccgtcttccaaaggaagagggcctcccaaggcaggtgtgggcatgggcttgccacaatatgtggcattttgtgcacttaatgttattgaggattaatctatgttgtaacatgtggcggtattttgctccttttcattggcattctcttggg

SEQ ID NO: 213066 - DNA, 349 bp, Homo sapiens
agctaccctggaggctgatgtgggaggactgcttgaaacagggaggcggaggtttcagcaagctgagactacagcactgcatttcaacctgggtaacagagaccccgttttgcagtaaaaaataaaaataaatttagggtcgcctaagtgtacagtgttcataaagttgatagtagtatacagtaatgtcttaggccttcacattcacttgctcagaccaattcactgacttgcaagcaacttccagtcctgcaagcgctattcatggttcatattaagtgcccaatacaggtacatcattcattcattaagatggagttttgttcatgtagcccaacctggagtgcag

SEQ ID NO: 213067 - DNA, 220 bp, Homo sapiens
gttgctgctggcagtccttggtttgtggctgcaacagtctggtcttaaggccagcatcttcaaatctctctctgtcccatcttcacattgccttctctgtgtgtaaaatctccatttacttgctttttatgaggttaattgtgattgaatttatccacatattccaggataatctccccatctagagatccttaactttataatatctgcaaagaccttt

SEQ ID NO: 213068 - DNA, 502 bp, Homo sapiens
cacttggtagggcaacctggatgggagggccttcaacaagaggtgttgagaggttagggttaggtgtagtctagggaaggaaacaaggattccgtgagagctgccacgtgaccatgacagagagctctgtgtttggatcaaacagagaggaggaaaacaaaaggtgcttttaagtgagcccaggcagaactgtgagggcggcccatgctgcaggctgtggctgtcagcaggctgcttctccacagctggtcccatcctaggattcacagggcagcagcagggtacactgggtgactgctgccctctcctggtggcacagggcagacctgctggtgaacacagatgcacgcttttggggaggactagggagaaagcaggtattggagaagcaggggattgtttatttgctaaaagtgtggccctttcactcagcaggtctgctactgcctactaaggaacggcctctcgacagtccagaattgcccgatagatctcgtagagc

SEQ ID NO: 213069 - DNA, 745 bp, Homo sapiens
cggatggaacacttactccatgcacacttgcagttcttgtttttttggtaacagagcaatcatcaccaaagttgaattggaggtagcatccattttttcatggggatactttttcaccatcttgcacgctgaagtaggaaatgcctccccaggggcagggttggcagtgccctctggcctcactggctctgggcctcacaggatgggtggggactgatcctcaagtgctcttctcttcctcccataggagacttggcacagaggcctccttttctttggttctttctcagccatttcctgtcacggctactctcggcccagctagtcttggtatactgggtggcaggggatgcggtgaggaccagggtttctgcctccctaagaaacaccctggaagtctgaattccaggcaaatagaaagtagaaggtggactgggcgcagtggctcacgcctgtcatcccagaaccctgggagaccaaggccggcggatcacttgtggccaggagcccgagaccagcctggccaacaatggtgaaactccgtctctactaaaaatacaaaaattagctgggcgtggtggtgcatgcctccaatcccagctacttggaagcctgaggcatgagaatcacttggacccaggaggcgattgttgcagtgaaccaagatcgtgctattgcactccagcctgagtgacagagcaagacttagtctcaaaaaacaaaaaatagcaacaaaaaagtagaa

SEQ ID NO: 213070 - DNA, 504 bp, Homo sapiens
ataattggattgaaaggggagccttgttcaggttattatcattctatctgtaccttttcggtacagatgaagataaatgcagtatttccatctgttctgaagggctatgaacatccgggctatgaacatcctggctatccgggaagcctccacgtagacaccaacattgaggcttcatctcactcgtgcttcaagccatgtttacctgagaaacaaaatgtgctgaatagaggggaaaactggcaaagttgtcctctttgttcaccaggtcattccggtcactgggaacttaatactctacatttataccttcaactctatcaactcatgtaggcccggggctgcccacaggggctgccttccgtattttctcctttatgaaaatcatggagtggcgctcttttaatctgcacctgtcccagagaggggattcttcagctatttcaagtagaatatcttaagaatttatacttagcaaatataaaatacttcaaagacgggagc

SEQ ID NO: 213071 - DNA, 444 bp, Homo sapiens
gttgtgagggtgtgataaggtattcatggcagatgggaagataaattgtgatagttgttttaagggattgtcagattggagaagtacaggtaatctgacagtattctgtactgatagggccttaaaaagtgtcaggtaaagttatcaggagttaaactggtaggcaacaacataaattttccatacaggatatttttcacggaagatggttgagaaagggaaattcttgcccttgaaagtatatgtacatctgccatatatctgcttatgtgtacagatgtcttcataaaatgctttgcttctgagttcatgacgagggttgagaaagggaaattcttgcccttgaaagtatatgtacatctgccatatatctgcttatgtgtacagatgtcttcataaaatgctttgcttctgagttcatgatgagtcatgacatcacatgat

SEQ ID NO: 213072 - DNA, 222 bp, Homo sapiens
tatgcctccatcttgctcccatcagcccagctcccccatctcacagtcttctgccttctgatgggctcaaggccctcctaacgatggctttccttagcaccctcttagtgcctactcttttctgcatcctttgatcccctccccttcaagaggcttgtcttataattaactccagtttgcaatcccccttcctctcactctcctgatgggacgaacatgcgg

SEQ ID NO: 213073 - DNA, 544 bp, Homo sapiens
cagtgcaattgaaggttgaaagggaagatcctccaatgcacaaagaattcatgcttcagaaacattctcttcctgaggatacatttgggaatttaggtagaaattaactgtcttgccttcatatacagtgtagtggagaccactgtaggtctccaactttttgtcttttcttaataacaagtccccagtttttgctaggtacatagctacccagagaaaagattatgtggccaccttactatgttctggccaatgagatgtcagcagaggtaatatgcggggcctctgagaaggccctttcctgctacctggtacctggctggaggctgaaaagccattagggacgagacatgctaaggttggagggtcagcgtattacatggagcctccttccctgatggccttgggctgccataccagccctggattgcctaattcccgacttcttttgtaaaagggagaaataagggtcaatttttaaaaaagcatctattactttgacattttctgtcacacacagccaaatataatcctaactactata

SEQ ID NO: 213074 - DNA, 287 bp, Homo sapiens
tactgatgtggagaaaatgtcaatgtggatatgaagaaaacaccttagcaaacagagggatgcaatcggggtgcagggtacccagatttgtgcaggtttttggtaaagctttagttcccacatcatgtggttggttcaccatgttccattacattattatgctgtatagagtacacctatgtaacattatgtgatttttccatggatcaaatattatattaaagataaagtgaacttcaaatccctgacaagtagaaaaaaaaagataaaggaaaaaagttaaatat

SEQ ID NO: 213075 - DNA, 161 bp, Homo sapiens
tgacaaaggaaaaagcaaggaggggccttgaagaagcatgacctggtgaggattttcagcctgatggggatgatcagtgcccagaccaaggcaccatagtctagaacttcactgcttaaagtgtggtctgtgggccagcagcattggcatcatctgagagt

SEQ ID NO: 213076 - DNA, 382 bp, Homo sapiens
agctgaggcctctgttgagactgcattccaggcagattcttcctttgcccaaccctgcttccttccctcccacaggtgcactcctaaatgaacctccagcataatcctttccatgtcattgtcttcctgggagccaagtctgtgaagcccacaccagcagtggtaaaacagaacagatactgggatgtcatcttggagctcagtcacctgccaccagagacaggtgcctactgcaaggtgaagcagcgactggccctggcacaaggagccacaccagcatcaaaacttggaccagaggtcagcggggatcacagaccagcaggtgtgatataaaagacatttaagaaatatcgggaaataataattagcagggcccagaatc

SEQ ID NO: 213077 - DNA, 597 bp, Homo sapiens
aatactacctctcatccctttatctcttcccttttgagttttttccagactcatcacctcagcaggatgtgttgttctagcactttgtacattctggcacttgtcacattggattatagatgtctgtttataagtttgtccttcctgaggtgtgatccccgtcaggggagtggtcagagcagtgactttgtcatttaccaattctgtgtccttgggaaagttactaacctctccatactgtttctttctctgtaaaatggagataacagtagtgcctatcatacagtaccaaagtgatgaacaagtgagatatttaataagtctttagaacagtctggcacagagtaaacacctgataaatgttggccattatcattataaaggtactatgcctggcagatattaagcatttagcaaatgtcaggttaaaattgtatgtatcatctaccacacagtgagatgtctgtgaatattgagttcacaaacatttttttcagtttaaaaaatatttcaaaaacattttgaacaaacactcaataaaaccacatttggatggggtgggcctaaataagaaatgagaggatagagctttagttt

SEQ ID NO: 213078 - DNA, 1639 bp, Homo sapiens
  misc_feature (837)..(837): n is a, c, g, or t
  misc_feature (871)..(871): n is a, c, g, or t
  misc_feature (1639)..(1639): n is a, c, g, or t
ggctttataaaactaccatgatgcccccctcagactcacctgacaatttttaactcatctggcagatgctctttgagtttaaccagattagggcagaaacatttgggtagactgggaagggacttcaggtaactctaaggactgaaaatgaatcttgctctaacactattttccataatgtagagtttggtataaggcagggttatcttgaattccatcccacatgatttggctactgatttgcacaattcttctaagaactaggttacagttaggggccggtgacttggacttggattttgtttactaccagagactgtacaagtgtgtcaggaaataaaaatctcttctgttagttgtagttgtctgatcacgtaacactgggctatttatgggacaagtcagttagccaacaatgaggtgtaggggagtgccagttatctattttagactagtgcaatgctatagaacacttgagaagtgtattatttagggcttttaggcattaaggctgggatcactgtagacccaatttgacccaagacatcaaatttcagtggttgtgagttcaccaaaacacttagataaaagagctctctccagaagcaattccactttataatcaaacactggaagtcacttaactgcacaatgtattttttaatcaaataaatcatatcgcaagattttggaaaaccagaacagataccaaatcatgatttttggatgaaggataaggaatggatggccaggcatggtggctcacgcttgtaatcccagcacttcaggaggctgaggtgggtggatcacctgaggtcaggagttcgggacaagccnggccaacatggcgaaaccccgtctctactaaaantacaaaacaattagccaggtgtggtgccatgcgtctataattccagctacttgggaggctgaggcaggagaatcgcttgaatctgggtggcagaggtggcagtgagccgagattacatcactgcactccagcctggcaagagagccagattttgtctcaagaaaaaaaattatataagggatggatgaatgaaggtgcttaggcacttaagtatatggaagagtgataaaagaatgaagagaagaatctaggtgttagtattcctaagtagtaaagagtaagaagtaggccctcaccatagctctcaatgaatatgtgagtgataccaacagatacaaaaattctcttgcatctgcattcattaggtgaattgacttcagagacaaaagaaggaaagctatgaaaacttttatctccccagagactccttcccagcccactcaaataaaacggcattctggtcactctctatcctcttaatctgctttatttttcttatcatttatcaattcctgatattgatcatatatttgcttactgacttcccaccagggtgaaatcaccatgaacacaatgactttgttttgttcaccgtgctttctcctgggtctagaacggtacctggcacataagcatcataatttttttgttgcataaataaatgtatacacacaatttgaccgattctattggctcttttcaaagttataattgaacaatatatcagtatgaaacaccaaggcatgaaaatggaacagatttccattn

SEQ ID NO: 213079 - DNA, 303 bp, Homo sapiens
acttctctgctgacaggatgttggtaagttcttaagtgcctgtggctggggtattgcattcatctgtggcagagcttgcaaatagtgtcctctggatcagattccatctaaagaactctggctcacacaatttataaaaataggaaatttactttaaaaaacgtttctgactattgagaaaaacagttcagattccactggattccagggtctgcattccatcccatagtggtgttgcttgcctgcggctgggtagttggtattccggttgagggtggttgcaggcaatgtcagtccttcctc

SEQ ID NO: 213080 - DNA, 430 bp, Homo sapiens
ttcactagcacatgaagcagtgaggtgacacactgagcagacaagataatggagagatgtcgtaacttctgaagctctcacactccaccaaggaaagattgcaggtccaaagaggacaggaatcagttaatgctgactcctaagcagtacacttccaaaacgcccttgaggcagccagactcttgaggttaagcgaattaccttcagaagtagaaaggcttattctgtttggaaccataaggacagagaacagtgagctgagggctaggcaacagtcaatccttttaatactctatattcaagttcatagatggcaagatgaaataaataggcccacaaatctacatagggcaagaactttggcaaagagtaagagaacctaggagaccaaaaaggcattcactcaatgttctctcatgttccaactgac

SEQ ID NO: 213081 - DNA, 565 bp, Homo sapiens
catcttcccatcttcggtgataaaggtgtccttctctctgagtatcaggaaggtacctctcatgtgagggtcttatgtcgtatttcaggggagaagaaagtgtcagagtgtcctttctgtacctgccatttttcagattccttcagcttaaaatattcaatatggcaagctgccatattttggggtagtatgtcctaaaccccatcatttcaatagttttactgtttaatttctgtttgtcattattactattttttgccccattggatttggagaattctgaaagacatatatcgtatatatttctaaatgaagttctccttgcatttctaacactttatatatttagctgctgtatctaatacatacaaagtaattactagtatatcttttacctaaattgtactttttggcccagcatggtgactgatgcctgtaatcctagtgttttgggaggccaagataggaagatcgcttgagcccaggagttcaaggctgcagtgaactattatcatgccgctgtatttcagcttgggcaacaaagtgagaccctgtctcaaaaaaa

SEQ ID NO: 213082 - DNA, 204 bp, Homo sapiens
taaatttggctggcttttaaaagaaaaataaaataaaataaacaaaagctggaaaggatgaaggaggcccttggatgaaacaagttactaagtgggctttaataattcattcatattctcaaagtgacaatttactctctcaggccagcctaagcttttgagccaccccagtaggcttattctcctcccttcagtatcaaaata

SEQ ID NO: 213083 - DNA, 680 bp, Homo sapiens
gagaatgctggagtgcgaaggagtcatcatgcttgcaagccacagataaagagacgagtgggaagagatgagtgagaaaagaagggaaggaagtttgaaaacaaaaggaaatgtgaacttagttaaggaagaacacatcttcctctcagaaatatgaaggagaaactaataggatagaaagataaagaataagtgaaaatagatatgactatgagatgaattcctcagacaacactgtaagaaatgtcttcttcattgaccaattccaagaacatcatgcttctatttctcagctggacaagtggctgttaggggtgcccagcccatcatccacaactcttctagctccagctgggagataacactggctttgaagggatgacagcccacccatggggaaagaaagatataacaaatatctgaaaattcagccctaaccccttaaagtttggctcactgaatgatggctactgtgaggtttaagggaggagtagtatagaaagctcctaacatcaactctttaaaaataaaggcaatttacctggggaaaatgtattaggaacatcttgtgtcttgggggccaactagattttaaaacctttggttttgaggaccatataagcccagcagagtaaaatgctatgaagactcatggctgttaataactgaggacgcaaaga

SEQ ID NO: 213084 - DNA, 439 bp, Homo sapiens
tgtatggagtcctctttggggtagggatgctaagtcttcatgcagaaaagctgcatggtttctgcagagcacaattggctagaaaggctgtaacattaaatgtttatctagaattaacatgagtaggagtaaaagtggctgtggcatcagggcgggcagcaaagcattctggagcgagggggctagggtgactggggaagaggctgatgaaaaaaataaatcaattaaaagagttcagggacttaacaaaatgagatttgacctgtgccaaaactattttgagaattttaaatatgacatttttcctggtatgaataaatttatagcaacaaacaataataaagatacaattgatcttgtatgttatgtatgttgacagagaaatttgattttgctctaaaaaagataatagtgatcaacatagatggagaacaatgcc

SEQ ID NO: 213085 - DNA, 515 bp, Homo sapiens
ttcttttcttttttgacaatttccttaatggcttgcatctaggccaatatgctcatagtcgtctgctcctgcctgggaacacaccaactttccaggcaggtctggttccttttcatcagaaaatggtacttacaaattaaactctagataccaactgctagatacctatgtacaaattaagctctagataccaactgcctagataactatgtacaaattaagctctaggtaccaaccgttagacacctacattattggggtcattatttttagacattctcagtgcacagaacttggaaatatatgtgtatataccacatcaatgctcacacacacatatctctattgctacgcctatctgtatgtatgtgtctaaacttaaaacatatatacaagacgcatggtggctcagctcaagctgtaatcacagcactttagggggctgatgggggcagatcacttgatgtcaggagtccgagaccaactggccaacatggtgaaaccccatctctact

SEQ ID NO: 213086 - DNA, 403 bp, Homo sapiens
catcatgtctccttgcttttgcctgtgccccttcactgttatgtcttgtcctccttgggaattctctacagacctcaaaattcacctcatccatgaggtcttcctgaactacattgtctgtactcaaatggctcattgtccatgttatttatataaaatatatcatttttagctgtatttatatatttataccaaccaaattaggagcattttgtaagcattccatgctcaattcttaactgtgcctagttcatattgtaggttttcaaaaatgtttagtgaatgaaaaaaatatataaactcttggctaaaatcaaaacatttgaaagtgctcccaaaattgattaagttttacatataatcatgattaatgtttgtttttcccaaaattgtttaagtttta

SEQ ID NO: 213087 - DNA, 335 bp, Homo sapiens
aataagtacattctaaaactatgataaacagtatagtaacataactattatcattatcaaatattgtatcctgtacataactgttcatgctatacatttatactactggcagcatagtaggttcatttacaccagaatcaccacaaacacataatgcattgcactatgatagtgtgattgctgcgatatcactagatagaagatgggaaattttcagctcccttgtagtctcatgagtccaccatcatatttgcagtcagtggttttgaccagaacatctttatccggcgtgtgattacttttctgtctcccagtgtccccttctctcccaagcc

SEQ ID NO: 213088 - DNA, 135 bp, Homo sapiens
cgcgcatgcgcgcacgcgtgtgtgtgtatttaaacatgctcccacttagtcgttctgtttgtattgaagtacaagctctttgtatgccagctacccgctcttatactgagaatcatacataggaatacctcacca

SEQ ID NO: 213089 - DNA, 355 bp, Homo sapiens
ccatctttgaatgtacacgtgactgtactttcatccaactagaaatattgcatggcaatttgaggtggcctgtgaagcattagtggaaaagtactaccctctgtctaaaggggtgcattatttagggaagttagaggtcaacaactgcatcttcaattaattttctatttatactgctttcaattatagttatattattactggagcattttcttgattatgttctctgcatttcatctatggaacgcagatcactccagccagaaatgttcctgctgaaagagcaaattggcaaatagggatgagtaaacttagtggtggatcacagaagagtttttgacctttgcttttaatg

SEQ ID NO: 213090 - DNA, 887 bp, Homo sapiens
acaatctgatttacacaaaaatttgctcagtcaatcctgttttctctgccaagagcatccaccctgatctcaagggtattattccacaataagcagcccataggactactgaaaaaccaggaagttacatttatgccaaagctgttcagaggttgtgcctcagaagacacacagcaggaaccgtgtgggctctgatcaaagcaagaatgtcatcccagagttgctccagtattgcttcacaaatattacaaataaaacacgatgctttttgagtcgtcatggctcacacaaagggtaggtttcaacatcagcctctggagagccacattcccagagtggccgtcccggataagaaggccactacagcacgactcacagcaccatggaggtttcctccacctgcgggacacagcaggatggagacggttgggcggcctcccttcctgggacactccatggccagcccctcagggactacttgaagaacagaacccccaaaagaccagtttctgaaaagggactcaaagtctaagggaggcagcctccttttatccccaggggagggcagctctggggcagacaggttcatctggatgtcatattcactcccgcacagaaaacctaggccaagcaattggcgaaccccctgaaggcaggtgggcgccccagggtggcgccacctgtttcgtagcagcggctgttgtcccgaacaaagctgcggccccagaacagcggcgcgcccaattggggaagagaaacgccaccaccgtggtgacgtcctccagcagacgccgagcccatgggagaagcagcaccacagagcgcacacgcagcgtacgcgacgacaatatatctcttcaacactaatagctagcggggttgtgcgc

SEQ ID NO: 213091 - DNA, 264 bp, Homo sapiens
tactgtgtcctggggatgtggggctgtgtctggggctttctagtgcatactatgttataggttagaatccctggtagaccaggtattgttaagtagtactgctgcatgttgcctgggggtggggtgactggctggagaatagagagacggctgcgtacaaaagtaaagtgaaaggaaaaaagaaaagtaaacaccaggacacagggcagagaatatgcttctaaataaaatcagttgtctcttctcagttttaagggactccaa

SEQ ID NO: 213092 - DNA, 864 bp, Homo sapiens
  misc_feature (10)..(10): n is a, c, g, or t
  misc_feature (31)..(31): n is a, c, g, or t
  misc_feature (72)..(72): n is a, c, g, or t
  misc_feature (83)..(84): n is a, c, g, or t
  misc_feature (86)..(86): n is a, c, g, or t
  misc_feature (88)..(88): n is a, c, g, or t
  misc_feature (95)..(95): n is a, c, g, or t
  misc_feature (100)..(100): n is a, c, g, or t
  misc_feature (103)..(104): n is a, c, g, or t
  misc_feature (131)..(131): n is a, c, g, or t
  misc_feature (226)..(226): n is a, c, g, or t
  misc_feature (228)..(228): n is a, c, g, or t
  misc_feature (237)..(237): n is a, c, g, or t
  misc_feature (252)..(253): n is a, c, g, or t
  misc_feature (258)..(258): n is a, c, g, or t
  misc_feature (270)..(270): n is a, c, g, or t
  misc_feature (273)..(274): n is a, c, g, or t
  misc_feature (279)..(279): n is a, c, g, or t
  misc_feature (291)..(291): n is a, c, g, or t
  misc_feature (312)..(312): n is a, c, g, or t
  misc_feature (324)..(324): n is a, c, g, or t
  misc_feature (356)..(356): n is a, c, g, or t
  misc_feature (364)..(364): n is a, c, g, or t
  misc_feature (376)..(377): n is a, c, g, or t
  misc_feature (383)..(383): n is a, c, g, or t
  misc_feature (390)..(390): n is a, c, g, or t
  misc_feature (392)..(392): n is a, c, g, or t
  misc_feature (403)..(403): n is a, c, g, or t
  misc_feature (429)..(429): n is a, c, g, or t
  misc_feature (433)..(433): n is a, c, g, or t
  misc_feature (822)..(822): n is a, c, g, or t
cttctctcgngggctctttcccttctgtatncctttgtctgtttgttccccctcctcccgggtcctggagtncgtcgtgttcnnanantttttgntcttnttnncgttgggctgcctgggcctcctttcanccgtgagacttggagcggcccctggggtcttgggtgtgcagcacggatcacgcgagacccctgagacctcaaatcatctaacgtgaagccacagncntcttgggcnattttaatcatcaannaaganatatgtcattanganntagcngggtattttganagagttggaaaacatcatgantttgaatacttnaagtaatactggtgatacccaaaggttgaagnttgcctcnttggttgtaaanntaatanttttttntntttctgagttnttttttttcttttttttttttttttntttntccattgggctaaaaaagaaaagttagaaataacaaccaaacacaatgcagagctggcaagctatgagagccagattgccaagctacggtccgaggttgaaaagggagaagcattgcgacaaagtctggaatatgacctagctgttgctagaaaggaagctggtcttggaagacgggctgctgaagaaagattagccgaggcacataggatccaagaaaaactctgtgcacagaattcagaacttcaagcaaagacaaatgagactgagaaagcatttcagacttctcagcaaaaatggaaagaagaatgcagaagatttgaacatgatttggaggaaaagagacaatatgatccaaaattgcaatcgagaatatgatttacttatganagaaaaagcagactagagaaactctacaggagcaagatactg

SEQ ID NO: 213093 - DNA, 483 bp, Homo sapiens
gagccaatgcattcaccacgtctgcatcggataccaaaggaccttgggcctgctttataaaagcttttagagatcctttgagattgcaatgagattagtgttctgctcattagtgttctgcctctccagcttgcagaacacggcggttccctaattcaaccgcaggcgagattacaccagggtagttgaggctgacgcgaaggccagccacagaaaggcctagctctgggccgggcatgctggctcacgcctgtaatcccagtactttgggaggctgaggcgggcgaatcacgaggtcaggagatcgagaccatcctggataacacggtgaaaccccgtttctactaaaaatacaaaaaaatagccaggcatggtggcaggcgcctgtagtcccagctactcgggaggctgaggcaggagaatggcgtgaacccgggaggcggagtttgcagtgagccgagatcacgccactgcactccagcc

SEQ ID NO: 213094 - DNA, 613 bp, Homo sapiens
cttcttgggaggctgaggtgggaggactgcttgagccaggaggttgaggctgcagtgatccttgatcatgccaatacactagcctgggtgacagagtgagatcctgtctcaaacaacaacaaagagaaatgtaatggtgaagagcatactggaaactttgaaaagcttggcaatggttgattgacctctacaggctagaactgatgatggaagatgctgtcatgacaatgggctctgtggtatcaatgtagatagatgatgggatgctgaaattttgaaggccaagttgcagaacttaactgtcaggggcccagtggacctaattaacttaatgggcacctaggcatgaatctgtgaacaaggtaaagttcatgatgttccaaggggcaagacagaaggacagctgattaggatgttatttgagttgtataattgacttgttatataatgatgttgattgacttgtattatttgactcctctcacccctcaaaaaagaaaattgagaattggcaaggagaaggctgacatcaatcttggtaatgaaaaaccatagttccccatccagtttccagatctaaagctcatgatgcaagggaaggcccagatcccct

SEQ ID NO: 213095 - DNA, 404 bp, Homo sapiens
tgggtagggtgggccagaatcaggagtgactgctaaaggtacaagatttcttctaggaggaacaaaatattccaaaattggattgtgatgatggatgaaaaaccctgtgactctatcaaaaattaaatcatacaatatagatgggcgagatgatggcatgtgaacgacatctcaacaaagctgtttaaaaacataagacaaatccagcatgtattttttttaacaaattttatggattcctaatagttgtacatatttatgggctacacatgacattttgatacaagcatacaatgtgtaatgatcaaatcagagtaacagaaatatctaccacctcaaatatttatcacttcctgtgttgggaacattccaaattttctcttccagctattttgaaatatata

SEQ ID NO: 213096 - DNA, 428 bp, Homo sapiens
ttctccccccagtccctggcaaccgccattctttctgtctataaatctgactactttaggtacttcatgtaagtgaaatcatacacttaatgtccttttttatctggcttatttcaattcacaaaatgtcctcaagtttcatccatgttgcagcatgtgtcagaatttcctttctatttaaggctgaataatattccactgtatgtacataccgcagggtgtttatccattcatctgtcaatagacactgggttgcttctaccttttggctattgcatgatgatcattttaaaaatatgttttcagttgcaaaaagcaagcagatatctacatggtaaacccctggactttgttgtgggtcaatttactggtttgtgaaatctctaagtctgggacttacacaattttgtatctgatgtagagatgtg

SEQ ID NO: 213097 - DNA, 456 bp, Homo sapiens
atggagggcaggtagccaaggcagttgctttgaagaactggaaaaggagtctctttctcagacactggtgggaaaattgtcatgagaaatgtacagttctggaaggtgtatggtgtgaatggtacaccctgagacgtggtgttgtgcggtgcacaagacatacaactgaataaggcactcttggtggggctcgcagaagagggccagcatcttatttatttatttattaattttgagatagagtgtcactctgtcacccatgctggagtgcagtggtgtggtcatggcccactgcagccgtgaactcctaggctcaaatgaacctcctgcctcagcctcccagctacttgtgaggctgaggcaggagaatcgcttgaatccgggaggcggaggttgcagtgagccgagatcatgccacttcactccagcctgagtgacagagtgagtctccgtcta

SEQ ID NO: 213098 - DNA, 400 bp, Homo sapiens
atggagggcaggtagccaaggcagttgctttgaagaactggaaaaggagtctctttctcagacactggtgggaaaattgtcatgagaaatgtacagttctggaaggtgtatggtgtgaatggtacaccctgagacgtggtgttgtgcggtgcacaagacatacaactgaataaggcactcttggtggggctcgcagaagagggccagcatcttatttatttatttattaattttgagatagagtgtcactctgtcacccatgctggagtgcagtggtgtggtcatggcccactgcagccgtgaactcctaggctcaaatgaacctcctgcctcagcctcccaagcagctgggactacaggtgcgcaccaccacgcctggctaatttttctattttttgta

SEQ ID NO: 213099 - DNA, 655 bp, Homo sapiens
ctactagaaatgaaaatttgaaatttacaaattattttcatttgacttatcgggtgatttccacatgctggaaatatcaagaaatatttggccggctgcggtagctcacacctgtaatcccagcactttgggaggctgaggtgggtggatcactggaggtcaggagtccgagacctggcaaacatggtgaaaccctgtctctactaaaaatacaaaaattagccgggtgtgggggtgcacgtctgtaatcccagctacttgggaggctgaggcaggagaatcacttgaacctgggaggttgaggttgcagtgagccgagattgcgccactactgcactccagcctgggtgacagagcgaaacttcatctcaaaaaataaaaaatttaaaaaattaaaaaatatatttaaataaactgtctgtgatggccattatttcttgaattctatcttattccacttattccacattactaaaagatccctgaatttctgactgaagtttaaagagaaacatcacaactagatatcagagtccaaggaagagacacaaagacctcagtggtactgacaggcaatagcaaagtcattcgaaagacaaagattttggctggtcgtggtggctcacgcctgtaatcccagcactttgggaggccg

SEQ ID NO: 213100 - DNA, 510 bp, Homo sapiens
taggcagttcttcctggagttaggaatatctgatacacatatgtttaatactagaattctgtatgcagttatattagtggttaactttaaatgactgctgacttttttgtactttatagtttacagataactttcactcatatttttcatttctaggcagggtaacattagcacaatgtccttatttctaaatactctaataatcccatgagtatttttcagtcagtaataactgcacaatagcaactaataaaaaatgctcctggtgaacagagatttggacagcatacacataaacactaaccactgtattctttttttaaaaaatggcaattatctttaactgacataatttttattattcacctacaatgtctgccatttcttagtggggatatatcaagaatatttcttaaccacctggaaaattggttagggccctgtgtgagagacattagaagtgtagtgatgagaaagaaaaagaataaagaaggagaggaaggaaagaaa

SEQ ID NO: 213101 - DNA, 350 bp, Homo sapiens
aagaatagcttgaacccagaaggcagaggttgcagtgagccaagatcataccacttcactccagtggcaggggtaggggatgctaaagccatctgagtgaaaggttggggtggaaagaaaacacgtggagtaggctgaccattccaccatccccaaccttatcactaaaagagggtcattcacacaccatatactacttgattatgaagcaacaagaaactagcacaacacctattaagtattcctgaccaaaagataaataatccaaatctagacctacctactaactgcaagttactagggaaaatggagagcaagcagttaataagtcaaatccagaacgtaggtgt

SEQ ID NO: 213102 - DNA, 324 bp, Homo sapiens
catttgacaaaattcaatatgcctttttaaaaacatttacagttcagacatggtagctcacatctgtaatcccagaactctgggaggttgaggcgggcaaatcgcttgggctcaggagttcaagaccagcctgggcaacatggtgaaaccccatctccacaaaatatacaaaaattagccaggtatggtggcacatgcctgtaatcccagctacttgacaggctgaggcaggagaatcacttgaacccaggaggcagaggttgcagtgggccaagatcacaccactgcactccagcctgggtgacagagtgagactctgtctcc

SEQ ID NO: 213103 - DNA, 1240 bp, Homo sapiens
acaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaaacttatgaaaacattcaatgtagaagacttttaggaaaatatcagagaatttaatgaaggaaagaagctgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaacatttgtacacacaggctt

SEQ ID NO: 213104 - DNA, 1836 bp, Homo sapiens
acaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaaacttatgaaaacattcaatgtagaagacttttaggaaaatatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcagttcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcttgaatgcccttaacccagcttcttccaaagataacaacttacataagcatggttcattaccaaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaacatttgtacacacaggctt

SEQ ID NO: 213105 - DNA, 417 bp, Homo sapiens
cagtctgtaaatggacccggccaagtcaatgacacgtggattttgagtgtctaaaccagttgtctctctatgcctttaggcctcactgcctcaggtccactggactaggaagactccaagtttggcgatgtgactatctggcacccccacccctcccacagcaggcactgttagaatgaattctgttggaggtgactccccacttcctggaatcagccaacaactgcattcacttaataagaatggcagtttctgtcacctccagggtagacaaaaaaaagaaacagagagagagagagagaagaaggaaggaaggaagaaaggaaggaaagaaagaaggaaggaaggaaagaaagaaagagagagagagagaaagaaggaaagaaagaaagaaagaaagaaagaaagaaagaaaga

SEQ ID NO: 213106 - DNA, 737 bp, Homo sapiens
  misc_feature (8)..(10): n is a, c, g, or t
tgggattnnntttttaaccatgatgacgatagcaagcagcccgactctttaggatcccccaacgcatgtgccctccctatgtccttgaggccaccagccctcccaatcctcatcctgatctcactcagcaatttcctcccacttctgagccctaagccgcgttcattctcacctcagggcctttgctggtgcccggcaccctgcctggcatgctctggctcccccatctctttcaactacccatttctcaagattcacctcttctgggaagccctccctccagacttcacttgttcccttccctgagctcatgtcttgttgtttattgctgagaaaacccactcggggagtgtatgttgatttggttcattctctaattgtttcctgggagcggcacatgcgttacgcatgtgcgctcccaacgctgtgccgctcccaacgcatgtgccgctcccaacgcatgtgccgctcccatgtgccgctcctggtactcacgcagctgccgcgccatgttctgcttggcccgctgcagggcggtcttcagcttggacaacttggcgttggcatccttaatggccagcttttcacgctgctcggcatctgcaatggcggcctccaggaaaccctttggcctttgaggcccttaaatctaggctggacccggctgatgttccgggtcaattcaaagaacctaatctttgggcgcccgaagtaatccccgtgctttcaaaccagct

SEQ ID NO: 213107 - DNA, 461 bp, Homo sapiens
  misc_feature (8)..(10): n is a, c, g, or t
  misc_feature (452)..(452): n is a, c, g, or t
  misc_feature (457)..(457): n is a, c, g, or t
tgggattnnntttttaaccatgatgacgatagcaagcagcccgactctttaggatcccccaacgcatgtgccctccctatgtccttgaggccaccagccctcccaatcctcatcctgatctcactcagcaatttcctcccacttctgagccctaagccgcgttcattctcacctcagggcctttgctggtgcccggcaccctgcctggcatgctctggctcccccatctctttcaactacccatttctcaagattcacctcttctgggaagccctccctccagacttcacttgttcccttccctgagctcatgtcttgttgtttattgctgagaaaacccactcggggagtgtatgttgatttggttcattctctaattgtttcctgggagcggcacatgcgtgggtgatccgattgagtcgaagtcaactaacatgagctaaatcattaancagtnacct

SEQ ID NO: 213108 - DNA, 299 bp, Homo sapiens
agctgtgtagcccgtagggtcccaaggagacagcccagcagtgaaacgctcagatggggcgggccccaggcacccggcctgcctccagggcaggtcctaggggcccctccagggccctagccaacaggaaccaacagggccaggggctccagtgctgaagctccaagaagaggggacccacagggtccctgggtgcccagctcttccttcatgagaacgaaactgtcctttcgggtttcaccatctatctatactgggttgaagtgtcccccaaaggctcacattcacccagaacttca

SEQ ID NO: 213109 - DNA, 961 bp, Homo sapiens
aaaatcctgctggatccttttttctccctctctcttaacttcctaagaatgacttattcatttaatgaattttttttcagttcctacacagtggtagatgtatgccaagtgccctgctaggcactggggttacagtggtggaatgtaggcactgggtaggcaccaggattacagtggtgggatgtaggcaccagggttacggtggtgggatgtaggcaccgtgtaggcactgcagtgacagtgtggaatgaaatggtttctttcttcgtgaagcttatatctaatgatggaggccaaaatgacaattacaaactcgtataaatgctttgaaagaaaggttcatgtgctgtgagagggtttaacaggcacaactgctgtcagtttattgggtaggagcatcctggaagtgaagaatgagtagtccacatatccaggcaaggtgggacaagaagctagggcaagggtattctagtcaagggaaaacccacagaaaggaggtacagtaggaaggagcagaggatgctggaggaactgaatgaagctagggtgacaggaactgggagagctggagatgaagtcagatgaaaggaaagagactggccggcagaatccaggtcacgtaggacctttagactatgtcacaggttttggtcattagctgaagggtaagagaatgcatggatgaattttaagcagggagtgatattcaaatttacattttctaaaaattatgctgtattctcatatcctcaacttaccttaaaatgcttcaaaaagataagatgattaatagatggatagggggatgcagagataggtgataaagaaaatgtagcagctgggtgctgtggcttgcacctgtaatccgagcaattcagaagggtgaggtggaagggttgcttgaggccgggagtttgaaaccagcctgggcgacatagcgaggctttgtctctggtacaaa

SEQ ID NO: 213110 - DNA, 885 bp, Homo sapiens
  misc_feature (153)..(153): n is a, c, g, or t
  misc_feature (228)..(228): n is a, c, g, or t
  misc_feature (238)..(238): n is a, c, g, or t
  misc_feature (272)..(272): n is a, c, g, or t
  misc_feature (344)..(344): n is a, c, g, or t
  misc_feature (352)..(352): n is a, c, g, or t
  misc_feature (437)..(437): n is a, c, g, or t
  misc_feature (471)..(471): n is a, c, g, or t
  misc_feature (491)..(491): n is a, c, g, or t
  misc_feature (877)..(877): n is a, c, g, or t
cgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcantcgtctcagccgtgactctcgccaggccggggctggcgcgcccacgtctgaagagcgatgccccgggagatcatnaccctgcagntgggccagtgcggcaaccagattgggttcgagtnctggaaacagctgtgcgccgagcatggtatcagccccgagggcatcgtggaggaattcgccaccgagggcantgaccgcnaggacgtctttttctaccaggcagacgatgagcactacatcccccgggccgtgctgctggacttggaaccccgggtgatccactncatcctcaactccccctatgccaagctctacaanccagagaacatctacctgtnggaacatggaggaggagctggcaacaactgggccagcggattctcccagggtgagaaaattcatgaagacatctttgacatcatagaccgagaagcagatggaagtgacagtttggcagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaanccgttctt

SEQ ID NO: 213111 - DNA, 910 bp, Homo sapiens
  misc_feature (153)..(153): n is a, c, g, or t
  misc_feature (228)..(228): n is a, c, g, or t
  misc_feature (238)..(238): n is a, c, g, or t
  misc_feature (272)..(272): n is a, c, g, or t
  misc_feature (344)..(344): n is a, c, g, or t
  misc_feature (352)..(352): n is a, c, g, or t
  misc_feature (437)..(437): n is a, c, g, or t
  misc_feature (471)..(471): n is a, c, g, or t
  misc_feature (491)..(491): n is a, c, g, or t
  misc_feature (902)..(902): n is a, c, g, or t
cgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcantcgtctcagccgtgactctcgccaggccggggctggcgcgcccacgtctgaagagcgatgccccgggagatcatnaccctgcagntgggccagtgcggcaaccagattgggttcgagtnctggaaacagctgtgcgccgagcatggtatcagccccgagggcatcgtggaggaattcgccaccgagggcantgaccgcnaggacgtctttttctaccaggcagacgatgagcactacatcccccgggccgtgctgctggacttggaaccccgggtgatccactncatcctcaactccccctatgccaagctctacaanccagagaacatctacctgtnggaacatggaggaggagctggcaacaactgggccagcggattctcccagggtgagaaaattcatgaagacatctttgacatcatagaccgagaagcagatggaagtgacagtttggagctccagaacagctccagagtgatcagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaanccgttctt

SEQ ID NO: 213112 - DNA, 403 bp, Homo sapiens
cattgtgtattacggtatagataagatatcctagagaaggtatagttaggggaagagtataggtagtgcaaaggttacaaattggctatcactgacagagggtgctcacagactaattttgggcaacttgggcaattttattatgcccaccttgtgctttaaaaagcagtaggacccagcagatgtgatacttggttaccatacaaataggtttatacctattacatcctacctaccactttatacatgtgtttaaccactgcaggcatttgagtttttgagcctttgttcaaagaaagtattaaagggatgtggggaatggcaagagaaaaccacaggaacatttcataggcagatagaatgtgatgagtcagcaagggagtataaagagaattaaggccac

SEQ ID NO: 213113 - DNA, 145 bp, Homo sapiens
caatttgtcctagcacagccgtatgactctcttaatgtttggggaaatccatggttcaacagcgccgatgcccgataaacaacacagcaccagtaacctgtgccaggggctgtggacgggggcaacacaggagcaggtcacgggg

SEQ ID NO: 213114 - DNA, 593 bp, Homo sapiens
ttagcaaatgtccatttgtagcagtgctctatctttaggtcaagttctttcatagactcctcttatgtggcacagagctgcagccattcagttgctatgatgagcagccttttgtagagagagccacttctccactgtgccccttctctttgccaggtatcttagaaagtcccagggaacacagtttgcaaccacagccgcctcctgatcttagaattgaatccatttaaacctcagcggagttggtcacttgcgaagtcttaccttcctgccaagacggagccaggactggaagctgtctccagatcccatcccagattcatgccctgtcatgctgggaccaggactggggtgttcctgtagcctcggctatgtcctagtacatctggactttgcccagacggcccagtgtagacaacgcaggaaaggacagaagcccatatcacagatgttctcagtagaagggacttaggtgtcatcaaagccagcctcctcgtttacatggaaagaaattgagatctagaaaggctgaaatttgtccaaaatcatatagttgcttaatggtccatagctcattgttcaacatgagaaaa

SEQ ID NO: 213115 - DNA, 582 bp, Homo sapiens
aaaacacagatataaaagaaaagcatgaagatcagctctaattgcgacatccagagataaatattttaacgttttgagattgattatgcctttttacaaaatgagattatagatcttctcatttttataaaaaggcagaatctctgagacacagcaatagcagtattaaatgagaagattatagtgctaaatgcccacatcaaaaagaaagacctcaaattaacaaactgacatcaaacttggaggaactagaaaaacaagaacaaaacaactccaaagctagcagatgaaaagaaataatcaaaattagagctgaattgaataaaagtgagacatgaaaaaccacacaaaagatcaacaaaaccaaaagttggttatttgaaagaataagattgatagaccactagctagactaattaaaaaaatagagaagatccaaatagacacactcagaaacgacaaaataccatcgacccacagaaatataaaaaaccctcaggaactattacaaacacctctatgcatacaaactagaaaacctagaagaaatggataaattcctggaaacatactaccccacca

SEQ ID NO: 213116 - DNA, 440 bp, Homo sapiens
tagtctccttttcaaagttgttttggttaatctaggttctttgcattttcatataaattttaagatgagcatgtcaattgctataaaaaagcccactgcaattttgattgggatttcatggaacttgtaaacaatttgggaaaattgccatcttaaccacattgagttttctgatctatgaacatagtaactctccatttatcttgttctttaatttctctcagcaaggttttcaggatacaggtcttatacaactctcaacagtttattttcatatcaacttgtatttatgtatggctaatatataagaaatgcagttgattttttttttaattgatcttatatcctgcaatcttgctaaattacttgttagttctgtttttgagacagagtctcgctctgtcacccaggctggagtgcagtggcttgatctcagctca

SEQ ID NO: 213117 - DNA, 192 bp, Homo sapiens
tccctgtgccgtgccccctccccactcagggcctggcactaggtgggtttatgcaggtgcctggtgatgtatgaagagccccaaatgcagcctgggctcgagtctgcggctgggtgtggtcacacatagtgtgtgcctgtgtcccacgttcagggctactcagggactctgtctgtaggacagggtggaagg

SEQ ID NO: 213118 - DNA, 543 bp, Homo sapiens
ggggactggctcaggggccagtcttggtccatgtgcctggagctgggctctcagagctagtgtggatgggagagcaccatcctgctagggccaccgggattctgataactcagccagtgagcagctgtcctggggaaatcaaggccaccagaagcagatgctggagccatgcatcttacacagcctgcagaaccatgagccaaataaacttcttttcttgcaacacaaaacggactaaaccagagggttctcactgagaaggacccatgaccaccatgtacagttgcataggctgctgactgcatatggatgcccagccaagagggtgagcagaagctgaaaacctgcctactctccattcctcaaatatgactgtgactacttgaagaggagatgcctttttccaattcacaggaaggctctgtcctttggcccaggactgccactgggaaccaagacaggtcctacctgggcaagcagcatgccccctgcacttggtcccaagaaaatcccaccctgacctttgtcctgaatcctcaggct

SEQ ID NO: 213119 - DNA, 864 bp, Homo sapiens
tacccaggtgaatatagtctaatttctgtgctgattatagtgtcttacaagatatgcatttagttgctaatatttaatataaagagtgtacagagtgtaagagaaaaattgcttaacatgtgaggaggcccagtgctgtgaaagagagaaaagagtttagcaaatggagtaatctgtaagggcattctgatagataaagggaaaaaaaaagtgtgttcatgaaacaagataattttgagaaaaaaattaaatggagaaactatgtaggcccggcatggtggctcacgcctgtcatccagacactgtaggagggtcaggtgggaggatcgcttgagcctaggagttcaagaccggcctgagcaacatagtgaaacccctgtctctgtaaagaagaaataaaattaccaccgtgcccagcctttgttgctgtctcttcctttgtgcagatccaggttttcatctggtctggatttcctgctgaccgaaggatttctgtaaccttgcttgtagtgtaggtctgttacggtaagctctttcagcttttgtacattgggaaagtctattttgccttaatttttgaaaaatattttcactcgttagggaattctaggttgacaatttttttttaaagatgtttcacctcttttgggttccattgtttcccatgagaaatctttcattattatttttgttattttgtacaaaagtggctttttttctttgcattttaagattttttctttcttttttctttttttgagagagtctcgcactgttgcccaggctgggttgcagtgagccgagatcgcgccaatggcactccattcagcttgagtgacagaggtgagactcccatctcaaggt

SEQ ID NO: 213120 - DNA, 901 bp, Homo sapiens
gtttttggtgttcttaccacctcttaatacctactattattacaactcttagtgaaaattagatagttatcaggtcaaaggaaactattagtttaccattgtaaacgaattggtaaaccattagtttaccaatttggggaaggaggtaagtagaggatagaaaatgagagagaatttgggcttataatgggatggggtaggtgagtcatttaggttgggccttaaattcatgatgtgccttaaatttaggtttttgcctctaatcccagctacttgggagcctgaggcaggagaatcacttgaacccaggaggcggaggttgcagtgagcccaaaccacgccactgtactccagcctgggtaagagagtgagactccttctcaaaaaaataattaaacaaaaatttttaaatatcccctattcagtttttatatacacttgtgtttttttgtatgtgtattaaagacattaaactataaaatatactacaaattattgtgactcttattttggcttttttccccccttttatatgtagggaaccagagcctctcttgacctttgaaagggacaaagagaattttagatagaaaatagcatcagaaaggtctggtgtggtggctcgtgcctgtaatcctagcactttgggaggctgaggtgggcagatcatgaggtcaggagttagagaccagcctggccaacatggtgaaaccctgtctctactaaaaaaaaaaaaaaaaaaaaaaattagccatatgtggtggcgcatgcctgtaatcccagctacttgggaggctgaggcaggagaatcacttgaacccaggaggtggaggttgcagtgagccaagattgtgccattgcactccagactgggcaacaagagagaaaccacatctcaata

SEQ ID NO: 213121 - DNA, 1137 bp, Homo sapiens
aactgaagtgccctccctcttccagcccttggacttcagtaccttcattgggtcctacatctgacccaatacctttcagtgtgtccaggggtctgatcggccactgcctgactcctgaccccttcgatcctgatgtccctgatactcttccattgcaaataaatactctcgccaagatggtccagcttttccaggcagtctgctcaacaaagcttgtatattttttgcccttcagaggctggcttggccaataagccaccaattgcaggctggcttcacagggcattctctgtgtcccagacagccatgaggtctctcttaacactggctctacttatcccttagatgtgtgggtcctcctttccccctgtccatccccaaataagtgcccaggactggcctcagtgaaagagccatcagaagtgtgtagaggtttgtgctgaggaagatgaagtgtcaaattgtatcctgaagttaaagtcaatgccctgccaaccttccagaatctttatgagataaagagtttgttcgtacgaaaaatgtgtttgttcttattattttgccaccagcttccctagtatttgatgtaggctacatatccagcatggaaaaaagaggaaaaactcttagctcttaaacacgcaacagtgatggtggaatttcagacaggaggggcaaggtactctgtgcatgagtaggtattattacagggtcaaggcatcacccagcagtgagtcccatccacagcagcatgtcttacccaataccacccccaatcctagcaagcatgtagccctgcagtgaggggcctagacatacctgggtagaggtgaggggtggtgtcaacctgagagtctctcctgcattcattacagatcgcaaaagaggatgctgtcctaccagtagctctcttcccatctctctgcgagttcgtctttcataacaaccctctggtggcccatacacgaggtatagtgcccgcaaacctgccccctctcaacccagtgcccaaggagcagtgtggcaccctcatccccacctcatcaatgccaagccctgggatctactctgtgtcggggtggacaaggttcatggtacattgaggaatggaggaaatagctctgtaccagcgcttcc

SEQ ID NO: 213122 - DNA, 486 bp, Homo sapiens
  misc_feature (452)..(452): n is a, c, g, or t
gcattgcagagacctcatgttgaattcgtgtctgcttgtccatcatctgagcacagtgctcatcacgttgcccccatcgcctgctgaattgagtactaagtccccactcagagtgtccctccattctgactctctgccgcctggtatcttggctccagacaaaccaagccgcactttctcttctggacttttttccagcctgggcgacagagtgagactatctcaaaaataaataaataaataaataaataaataaataaataaatagtatttttgagccttcaagatacagttcctgaatattctaatttaaattgttataattggattacctaatattcttttcaagactcctgatgtattaacttcatgttattgtcacttttcaaaaaaggaatttttttcaggagttaaataaagtcagtcttttatatccaagggtttcaaacccncagattaaaccaacaacagatcaaaaatagaaaa

SEQ ID NO: 213123 - DNA, 440 bp, Homo sapiens
cacacccattccagttccttccttcctgtattctgctacaacacgtgacaaaaaacacatgaaaaaagtggcattaggtattacagcctaccaccaaatcttcatgtctcttgagctcatgacaatttgaacacatcagattactagaaaagttagttatttacaatgcaaaggacacccagtccccagaccaaataattatacagctcaaaatctcaatggtgccatggttggcccttggctagaacaaaggctgaacacttgtgtgatcttggctcactgcaacctccacctcccgggttcaagcaattctgcctcagcctcctgaatagctgggattacaggcgcacggcaccacgcttgactaatttttcgtatttttcgtagaaacggggttagccaggctggtctcgaactcctgacctcaggtgatccacccg

SEQ ID NO: 213124 - DNA, 1107 bp, Homo sapiens
aagtctgttcttatacatacataattttattccgactgattgtcaccttggtttatagtcttacaagtagaatttctgcatcaaagtgtactcaaaatgttgactttggtacatacatattgccggaataccagcaatttacactttcagcatttcactgtgccttttacactgttacaaatattagatatagtcagtctttttaaaacagctttgccaatctgagaggtaggagataattcattcttattttcatttttaaattctatgttactattaatggtaagtatctttgtagtatccattttacatttctttgaaaatgtaaactgcctatttaagtccactgcctctaatcctactcagatatttttctcttatcaatttgggaaactaaccttttgtcatatgatacagatgctttcctccaattcattatttaattctcaactttttttgttgccaaatgcttaaaagccttaccaaaaaaaatcaattatttccttataatttttagttttttagttatgctaagaaaaactttccctctacatcaagattacaagaaatactcctgtattaattctagtgtttttatgtatttttctaaacaatgagtgaagctgtctaccttggcaaaagaagtgaagtggaaaacttcccccgacccttcctcgctggtcagtagtgttcagcagttgtccaaatgagatcaactcaacagttgcccttttctttgaaaatctgaaatcttatctttaccacagataccttctatacttgaattttcctctcttccacttacccatatgcaggtccaatctggtgtaagtaccaaagatctgtcatatgtttttctaccaagcaaggcaaatactcccttgtttctttctacagcattttcctgactgctcttgcatgtggattctttcacattgaccttagcatcatttgttcaaatacttaaaaaaaattatcttactaaaatgatagcttaatctacagaaaactgacatctatgttaacttcctattcaagaataagatgtttccatttatataaatattcttaagcatatttcagagatatatagtttcttcatgtaag

SEQ ID NO: 213125 - DNA, 295 bp, Homo sapiens
gtctctaaatcagtcaatgagatcactggaaggcgctctctgcgtctcactttccaagagggtctctttgggccaagcaggcatggtgcctcacgccagtcatcccagcactttgggaggctgaggcgggaggaaagaaggaagggaggaagggaggaaagaagaaaagaagaaaggcaggaaggcaggaaagaaagaggggaagagagaaaaagaaagaaagaaagaaagaaagaaagaaagaaagaaagaaagaaagaaagaaaagagaagcaaaaagaagaaaagagaaggg

SEQ ID NO: 213126 - DNA, 558 bp, Homo sapiens
gagctctcattgtgccactacactctagtctggccaacaaagctgagaccccatctctaaaaagaaaaaaaaaatgcctttggtgtggagaatagactgggcttcggggtcaacccaccacagctgtgatccagcaatcagaaaactgctgctggtgaaatagccatcccacacttaccagacacctaaataaggaaactgtctactgcaaaacctcactcctgaaagagcttgtcactgctgcaggaagaatggcgtctatcccttctaccttccagattttgctcaaggcattccaacatttaagaagaggatgatagaacagaggagaaggacggctaatgaggttgtggaaaatctaggacaaagaggtgtcccagaggtcaaagtaaattaaatatttctaagagagtgattaattgaatcaaatattgatggctgggacatggtggctcacgcctgtaatcccagaaatttgggaggctgaagggggaggattgcttgagcctaggggtttgagaccagcctaggtaacatagtgagaccctgcctcagaaa

SEQ ID NO: 213127 - DNA, 449 bp, Homo sapiens
gagctctcattgtgccactacactctagtctggccaacaaagctgagaccccatctctaaaaagaaaaaaaaaatgcctttggtgtggagaatagactgggcttcggggtcaacccaccacagctgtgatccagcaatcagaaaactgctgctggtgaaatagccatcccacacttaccagacacctaaataaggaaactgtctactgcaaaacctcactcctgaaagagcttgtcactgctgcaggaagaatggcgtctatcccttctaccttccagattttgctcaaggcattccaacatttaagaagaggatgatagaacagaggagaaggacggctaatgaggttgtggaaaatctaggacaaagaggtgtcccagaggtacaatcttccggagagatccaatcattccggagaggtccaatcttccggagagtccgatttccgg

SEQ ID NO: 213128 - DNA, 556 bp, Homo sapiens
aaatagaggggagacctccatctggatcacagccacaaaaaaagatcttgtggtggtaaacacttaagagacagtggtgaggggtagggataactggaggcacactttctgcctcagtagcttgttcttgcacctcaaaaaagtattcacaaacagaacagtgtaccacacttctccagtgtttctccaggaaaatatctccagaggagttgatcaagaaaagtctataaatcatgatagactgtgattgtcaggtgagaaaggaaagcctttttcagtctgaaagcctcaggactctgcagattttcaaccccatctttcaagaccaggctcagtcttcctctactgcacgagcctgaagtatccctcccttgaatacccggcctcactcctcggagcacctgatgcttgctccaccttatgaacaggtcccaccctgctctgctttacatattttttaactgactttatatttgaaatttgaaattaccaatcccacaaattttggatttttttgttttctttaaatatatacatatatataaacagaaaaaaa

SEQ ID NO: 213129 - DNA, 283 bp, Homo sapiens
agcatattggtaaagctcagtagaagctagctcccgggattcctatgtgttatgcagaaacctgtgggtatccagcagattttatcacctagtaaaagaaatgagcatcttatggtgactggactcagaatgataggttttgttgaagaaaggagagatggaattaagaatgtaacaacacctgtaggtggtcaggactttcaggtgagctctgcacgggaagggccaaggcaggacaaaatcagccagattatcgagtgatcttgctgagataaatacaaat

SEQ ID NO: 213130 - DNA, 611 bp, Homo sapiens
aagtgctgggattacgggtgtgagccaccgggcccggccaagttctgcaataatctttattggtttccctaaaccttttgcaaatgatccctttgctaaatcgcctcaaattacccagtttgagtgtaccatgtcctttcttctaggactttgatacataggagaagaacaatgtttttttttcaggaagattaattttagtagctgtataatattctatagtgccaatataccaacaataatagcaattacttaatgtgcatgtcaggtgctttatagacatcattttattcagtaattagcacctccagagattcgtattttacagatgaggaaagtgacttcagggaaggctgaaaacttatttgcctgaggttacagagctgacaagcagcaaggtcagtcttcagaatctgtattcttcccactaaacccagtggttccaaagcccagctaatcatgaaagagaaaaatctggctggcacggtggctcacgcctgtaatcccaacactttgggaggctaaggcaggcagatcttttgagcttttgaccagcctagccaacctgggaaaaccacatctctactacaaatacaaaacttagccaggtg

SEQ ID NO: 213131 - DNA, 573 bp, Homo sapiens
atcttcaaatatagtcaaatgcctttttattttttaattaaaaaatcctttgtaaacaacaatgagataccagtgtaccttttagaatggccagatccaaaacactgacaacaccaaatgccaaggaggatgtggagcaatgggaattcattgctggtgagaatgcaaaataatatagctaatctggaagacagtttggcagtttcttacaaaactaataagcatactcttaccatatgatccagccatcatgctttttggtatttacccaaatgaataaaaaacttatgtctacacaaaaacctgcacatgaatgtttatagcagctttattcataattgtccaaacttggaagcaacccagatgtccttcagtaggtgagtggataaataaactgtggtacatccagacagtgatgtgttattcagtgctaaaaagaaatgagctatcaagctatgaaaagacatggaggaaacttaaaatgcataatactaaatgaaagaacccaatctgaaaagactacacaccgtatgagtccaactaaatgacactcgggaaaaggcaaaactatgg

SEQ ID NO: 213132 - DNA, 459 bp, Homo sapiens
tcaccccctggataatttcagtcagtgtcagtgctttaaatactcttggccaggtccatggatcagcagtctccagcagtctagcagtaagaacagtgtttttctcccaagaataatttcttgggaatacgttgttgttttgggattgggagaatgtctctctaaaattccaagtaagcaccatgctttgctgaatttcagcaaatggagcctgtactgcctttttagtgaggattttgccttactaagctggattcctgctggttctttttcattattgcagcagaactggttcacatggaggactttcttccatgtaacattgatctcttaaagaccgaatctaatgtgcaaccacttgacataatgaccacaggagaagcacagaaagcaaatggagagctttgcattcctgctgtcactggtcatcatcatccaggctgcctaagcctccttgga

SEQ ID NO: 213133 - DNA, 478 bp, Homo sapiens
atgttaagtttattactagtattcaaaaacttaagaccggataatggagatttggcaaattacctttaagtgctttctgttgtatgttccatattgtggaaaagatacaatcaaattaggaattgatattgcttctttaaataaagaagctattaggctaccaagagtaatttagatgagtattccagatgttcagtacagtgacaagcttttcagtaaagaacactttgtgtctttagaagcttacagaaattagcgtctgtcttacagctgtagttttagattgaactgcggaaagtggtttttatgaggtgttaccgcaggcagtgttatgatggcagttggattgcttactcacaatttattatttgcctagtcttgagtaaatttctaaaatataacacctgtatcctgtaagcaagcattgctttaattaaggaagaaattatttgctcatttacatttgtgtaatataaca

SEQ ID NO: 213134 - DNA, 226 bp, Homo sapiens
taagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttt

SEQ ID NO: 213135 - DNA, 253 bp, Homo sapiens
ttttttttgagacagagtctcactctgtcactcaggctggagtgcagtgatgtgatcacggctcactgtgccttgacttcccgggctcaatggatcctcctgccgcagcctccctagtagctgggaccacaggcatgtgccaccatgcctggctaattttttaattttagttttgtagtttcttacaagttgctccttaaattttctcttggtcgctctgctttttgctttttaacccttctgtcgtcttctc

SEQ ID NO: 213136 - DNA, 835 bp, Homo sapiens
gtgtttttcaacttcaagtatgcttggaaaattattaagccaaggctattgtgattatacctgttagacttttattctatataaattatctaagccaaatggagtccaaaatactgacccttgactgccagttagaatagtccctaatcctcaatcatgtgctaaaagagacaaatgagctagatttgagtttgaaaactaccacctctgaataaaaaaaaaaaatgaagctgaatatgcattttggaaagacacagttaatgcaaatggtagagaaatgtggaatactattctaaactgcttgtgttcactgcttcccgagtacagacacttgcaccaagatacagagacacacacttattaactcacacgtatggatcagaatgactaaacattttaaaatcaggaaaaacaaaacccagtagattctgccccacagtctgtatagtgcacacacacccactaatacacacccttgaccagtgtaagatccagaagtgcttaaacaattttgtaggcataaattacaaattaatgaaacctgccgaaggcagacacgtaaagacacaatgttcaagatataagcattgaagcaaggcagacacctgagaaaaacagtcagaagttcccaaactgaaaagattgtatcctggacatccaagcagatgaaggattcagggcgaacagatttgtatcctggcaccagagcagatgatgggtttagggaccgcagcggtccctaaagaccattccctctagcatccaaatttctaaaaattaaagcttaatggttccaattctttataaggttgtcctttcagtgggcaaagcattg

SEQ ID NO: 213137 - DNA, 335 bp, Homo sapiens
atgattgagtagctttgctcaagctctggcaaaatttgatcatcctagaaatgagatcgctcacttgtcccactcggaggaagctcaattaacggcgtcaggcgcggtcagcccttcaccagtgcaggaaggcggcagccctgagccacacagcagtgccaggcctgcagtcctgacaagggggtgtcagaccccagccccgagggaccacagacagccctctgacagatgattcagtgtgggaccaccgcaaaaccacgcaggctgggcaggctgggtacctccaaccttttcccatttgcctaaaagtaagtgaacataaaattgaaaactct

SEQ ID NO: 213138 - DNA, 621 bp, Homo sapiens
aaatgactgtattttcaatgtgtcctggtttcttacaaaacctcaaaagcactaacacttgaaactgaagatgaatcaagcatcatccagtcatgagccatatgttcgagtctagtatggccggatgacacacagagccaagaggggctgtgtgctcctggacaaggtgctgccctgcccacctcgaccagatgagatcaagtttttttcccaagtgtgacatacacacatggaaaattttaagggttatctacaccttacattacaccctgaatcacattgagaaagttatttcctttgattctcttgtaaacctgatgacttcaaagagaaagtctctgcgtggtgctggtgggtctttaacacctcaccaacacttgccaatccctttctaacaaagggagcaggcctcaagcctggggggccttcagcccgagtggtaaccacctggaaacaacactgttttgttttcaatgtgtttatttttgcagtttccttctattatatttatggccaggggagctgggttttccagttgccatactcttgtcagttttcctttcaaaacttaatttaaaatgcaaactgattcaaaggaaattattatggggtgtgctttca

SEQ ID NO: 213139 - DNA, 277 bp, Homo sapiens
ccacttggtcaagttcatatgtctgggtttgtggaacctgttcctgttactgtccctacgcatcttgcttttccgaaggaccttctacccatccaatgttagcccagtctgctatgaggacatgggcaacaatacagcaaactggtggatgctgttacggatcctgccccagtcctttggcttcatcgtgccgctgcgatcatgctgttctgctacagattcaccctgcatacgctgtttaaggcccatatggggcagaagcactggaccatgtggg

SEQ ID NO: 213140 - DNA, 610 bp, Homo sapiens
tctgtgctggaaggtacaagacctaggtagagtcaatatcaaggtgaactgaaagttagaattgtctcattgtctcagctccctaaatcacagatggcccagtggacattcttagtaggtcccacgcccatttggtgtctttctgctgtccatacattctatgtgtacctcctgaaaggaagaggcctgtgctctggccctttaagaaccccagtcctatcaaaatttacttgtcctgagttccagaccattcttctttattgaagaagaagctagattgcaggttaggaaactttcaccaatgtgttgacatgcacattctcccaggcaactgtgtgtttttcgtaggggtcttcagaagccactgcccagatcgggggaaatatctataataatggaattttagacccatgtggcaggtggcataatacaaatttgggtgaggatggtttatgatttttcttaaatcctgtcatgaaggcagccacccatcctgtctgtgggtaaggccaactttggcccaaacctaaaatttccaggctgcatggaggggtacaggactctttctgcttcttttattggcagatcctgaaagataagattaagttgg

SEQ ID NO: 213141 - DNA, 537 bp, Homo sapiens
taccaacatttttttctatattttttataataaccatactaatagatgtgaaatttccttgtccatttttaatatcagggtaatacttgcctcataaaataagttgggaaatgttccttgcttttctattttttggaagactgaaggattgatgttagttctttaaacgttttgtataattcactggtgatgccatctggtcctgggctttcctttgtgggaagttcttgattacaagtcattctttttacttggtacaggtcttcagattttctgtttcttcttgagtcagttttggtggtttatgcttttctaggaaatgttcattttacctgggttatctaatttgttagcatacatttgttagtagtatatcttaccatatttatttctgtaaggtcagtggtaatgttttcttggcctggcgaggtggctcacacctgtgatcccagaactttggaagcctgagctgggaggttcacttgagcccaagagtgtgagaacaggctggacaacatagtgagtccctgtctctac

SEQ ID NO: 213142 - DNA, 253 bp, Homo sapiens
tttccataggcgtgcctgtggacactggagctattattttgcctatgttatagacactatgagaaatgacggtcagaacgtgtaatcagcttccgttctaggacactatcatcttgaacccaaattaaaataaatgatctaccagcatccagacttaaacattttctccactgaagccttgcttaaaattcttcagtatttcctcactacttgattattttgtgagatcgggtctcagtctgttgcccaggct

SEQ ID NO: 213143 - DNA, 684 bp, Homo sapiens
tgagaatcgcttgaacccaggaggcggaggctgcagagattgtgccagtatactccagcctgtacgacagagtgagactctgtctcaaaaaaaacttctcataaaatactgatgcgtcttgtctgagtacccccaattctgcagcagaaaaggcccaaattttactgagataccttccgagttacatattcttgtgcctcctcacttaattcttctactgtataaaaattggttctccaggttttagaatctacagctacatgcttttccttgcatttcattaggctgccagcagggctctgctttcatgagttggcagaagttgtaagcactgtttttgtggtcctccatttctgattaagagggaacagctttcctacactggagtaggtattatatagcatattatattgttattaacagttagaaaacaataataacaaaaaacactaacctttgtattttgttaattcatagtcattttcatttttttccaagtcatcttttttaaccatggttaattttgatcttgggtaatttattgcagctttatcatgtgtgcttgttcattttacaaagatctttgcaacgagcaaaaggctaaccttttaaggagggaaggattatcgggacatatggaggggtattataagaattacgcagggtacacagtttttaggggcc

SEQ ID NO: 213144 - DNA, 376 bp, Homo sapiens
tgtgcaatgtgtctcccatgactggggctccttctctcccttaacatgtcatgcgattccatccagattgtcgaggccagaacctcttttcagaagaaatttttcttttattatatatcacgaataacagagaattcaggctaatcgtatcctatttatttgtgcacagatagaaagttaatatcttgcagctatttttccttgtcctccttttttcgaccttacagagacaattcaaggaaccatttgctgttcattagtttccttaactttattctttactttaaaaagttgtttgtttgtttatttgtttgtttattttgagatggagtctcactccagcatggtgacggatggagactcttgtctcagaggg

SEQ ID NO: 213145 - DNA, 233 bp, Homo sapiens
tgtgatataaggaaatagagattagctcactatcctggccattttcttgctggacatttattactcggctcacaaacacagtgctgccagatgccctgattgtcatgacacatatattttctaggacttatttatgatcctgccccatagcttcccccacaaagggcttttgtaaacttgtagaaaagatgaagccagaccagtcccagagactcttttcttgtaggagcctt

SEQ ID NO: 213146 - DNA, 672 bp, Homo sapiens
ctgggggaagacagccatatgaagaatgaaaatgtagaaacagtggtgagggatgagaccctcagtggctgagaattataggaggctccaggtcagaccttgggaaaatatccacaatttgggctaggaagagcagcagtgatttcagatagaagaaacaaccagagaggtcagagtagaatcattacagtgacataaagcaaggtgggtagcttaagtgtcattgccaaaaagagggtaaggactggccaagcatggtagctcatacctgttatttcagcagttcgggaggctgaggtgggcatattgcttgagctcaggagttcgagaccatgctgggcaacatgatgaaacctcatctctaccaaagataacaaactttgctgggtgtggtggcgcgcacttgtagtcccagctacttggggggctgaggtgggaggatcacttgagcttgggaggcggaggttgcagtgagctggtattgaaccactgcactccagcctgggtgacagagtaagagcccgtctcaaaaaaaaaacaaaaacaaaaacaaaaaaagggtaaggactttggtgggggatcatatgatttggaacatagattttttagtttttgtttttttttgtggtcttcaagagagcagttcagagaccagggtgcatggtggtttac

SEQ ID NO: 213147 - DNA, 583 bp, Homo sapiens
ggtatcataaaatatgcttgaacttgggttaattcctcttggactgaattgtagtgccataaaccaagcttttcaaaaagattggatgcaaaactattatggcaacaggaatttttatcaacataaagcaggatttaatgcagggtgaaggatttctactgtaaatgcttcaaatcatcatcatgggggagaagagcacagcagtatttccttccaaaataatcccaagctacattggttggtaataaataatgtggttaaagaaggcagattctaagatagaattttggacctggatcacctgtagcctgcctagcaatgaagacctcatcagtggtgatagatggagaacagatacaccttggaaccagagtccaccacggagaagatgccctatacgtgtatgtaaaatgctgaattaaataacattgtttaaccattttgccagccacagaaataaactaacttaaactcatatgtagccctggtacataatgcagtgtctggtatatagtaggtgctcaataaaggtctgtttaataataataataaatgtctgatggataaagtaaagataagcatt

SEQ ID NO: 213148 - DNA, 515 bp, Homo sapiens
agccattggagagcagacagctctgggtggtcatgttctagtagcagaaacccttcaggaattcagacagtacccacccattgactattggaagaaaaaaaaatctgggtcaagatgagaactgacagagaaaaaggaggaaagaagacaaatggagctcagggcagtggtgatggtggaagtgcatctattaggacaattacccaagcagcaactctggattcctccacttgcttacacggtgtctccttcctttccttccctccccagcccttgtctctactgaacatctgtcaacactggcctcaaccactagattctatcattgtggttaaaagctgagataagcttggactcaagtcctactccctcctcttgcttgctagctgtgtggccctgctgtgtcagttaacactaagtctcagttcctcttctattaaacagcgttaataatgcttattgtttccaaaaaattgaaatacattttgtacataaagtgttgaacccaatgccta

SEQ ID NO: 213149 - DNA, 324 bp, Homo sapiens
catcaggtgacagtatgagttggaaaagggacgggtgtagccacaccaggacaacttgtggtcagaaggtcaggtttcaagggccggctccgttactggctggatgcatgttggtaacctcataatccttagattctcacctgtaaaatgaggacagtgggaaagctaccacatgagctatgagagcatctatttatattcttttatagcacttttatagcacttgctgtgtgccaggcactgttgtaatcactttacaaacatgaactcatttcatccttcttaccacgctatgccgtagttactattattatccctatttta

SEQ ID NO: 213150 - DNA, 451 bp, Homo sapiens
atttgtctgaatcctgacaaaatgtatactgagggtagcaaaacatatttgtgtatacaggtaagctacacttcattgattcatttctctatttaacaaatttttattgagcatatgttatgtgcttaaaacaggagataagtagtaaacaagaaaaatgaagaagatagtgatgatgttgataatgataataacagctagcctgtattgagtgctacccatgtgtcaggtatttatgtcgattaatcctcacgtaacaatatgagtcagattctaatatcattccactttgcaagtgagggaatagatttagagagctctcacagctaggaaataatgcagcctgactcaaacactgcaattctgactcccagggccagattcctaactaacaacatgcaaatacattcattttcctcatggagcatatgttccagctacccatttattt

SEQ ID NO: 213151 - DNA, 428 bp, Homo sapiens
ttacatttacatctatggtccatttaattttttatgaagtgtgagatttaagtggagggtaactgttttccctgtatctaaatgctccaacaccacttgttgaaaagactatcttccactgaactgcatctgcatctctgtcaaaaaatcgtttggctgtacttgtataggactatctctagattctctgttctgtaccattcatgtatgtatctatccctcaccaatatcacagtcttgattactgtagttataagtgttgaaatcatgaagagttttgtttttggtgccttcctgtggattatctcaacattttttagaattctacgttgatttatttatagtgtttctgagtgtaactcttgtttgatctttttctaccagttgttctaggcattacattatatatacagaacttatcatagcct

SEQ ID NO: 213152 - DNA, 471 bp, Homo sapiens
tgctccttaatgggctctgccctgagctcagtgatccaactggaaaacagactaaattaaaagctacttatctaagtgaaataggtctccttataaaatccaatgatagattcctgtgattttgtattaccttggcatccatttttaattttcttccaacacacccaaactcctccttgaaaaggcttaaattctttctccttgtactttgagatataaagttactactgcattttctctaaaactcagtacgagcttcagccatgtggaacagataaactttaaacttttccatttacaaaggtacagtttgaatccaactgtccttgtaaaactagtgagttttaccagtctcatgactaaaatttttttctctgcttggttttgttttgtttttcttacctcagttcaccagcagtttcaatgtggctaaaattttttaattaaagctatgaagtcataaaatgtgtc

SEQ ID NO: 213153 - DNA, 233 bp, Homo sapiens
agagagcagatttatggtgggggagataatataagtttggcttgagttataaaatgattaaatagcttcacatgcttttttaaaaaaaaggtactgatagagctgaagctagtttcttatttcatctcctttctttcatctccagaagtaactgctgtcctgaagttatgtgtgttgttcctgtttcatactttgaccatatatttatatatccataaacaatgaaaagcatt

SEQ ID NO: 213154 - DNA, 542 bp, Homo sapiens
tattgtactgaggaataaagctttaatttagagcatgtctcagtcaacaaggcacctgtgtaaacagccccctgctcaaaaggctgctgtctggactctctccacaaacactcagaggctccagccagcaagggaaagccaccctgtacagtttggaagacagctctttgaaaacccattgtggatgtcacagtgatgcattgccttatcttagggatggagctctgccgaggacaaccagttgctgagaggcaaagctcatcattttgaagggctaggtgaaggcccatttaatttcctccaggagaaaatgtcaccaccaccattggtaagcacaggggatgcagagtgaaatttggctacatcttcatacagagttgctcctagaagagaaagacatgatttatgactgaagagccagtattttcccctaggaaatttatttcatttatgaataaaaaaagggaaagatatttaaacaagaaatttcctagttttgttgatgatctgaaaacctcccctgccacttcggctgtaataaa

SEQ ID NO: 213155 - DNA, 123 bp, Homo sapiens
aagctttctgagcaaactcccagagcacccagggcagaaacaggcggctagaagccgggcaacgcgggtgcagagcacagacccacgtccatggttttcctaccagacgggcctggcagcgga

SEQ ID NO: 213156 - DNA, 487 bp, Homo sapiens
tgtgaaccgcacaccgtagtagttttatagttttgggtcttacatttaagtctttaattcattttgagttgatttttgcataaggtgagagataagggtctactttcttccttctatgtgtgaatatccagttttcctagtaccatttattgaagagactgttttccccagtgtatattcttggcatcttcgtcgaaaatcagttacctgtaaatgtggaggtttatttctgagttctctattctgtttcacttgtgtgtttttatgccagtgccatgctgctttggttactatattaatataaggagagtcttgcagtatacactgttttgtgtctgacttattttgctcaatatcatgtgtaagaatcattatgttgttatgtagaattatagattgttcgttctcatatttatagtgttccattgtatgactagattattgcagatgaactttttagttgttttctggctttggttattatgaa

SEQ ID NO: 213157 - DNA, 257 bp, Homo sapiens
ccactatgttggtggtaattttttacagcaacaacaggaaactaatacaatctctgacacctttttaatctcctgcagcttctaacacagtgtgttgcacagagtcagatatctcttgtagctgatcgctctcatcacttcctctttattctctcagtgtttaccaccctgcccatgctggaacaggactgcagtggtcaggatttctctatttgcaaatgacagaaatctaacacgaactagcttgagccaattta

SEQ ID NO: 213158 - DNA, 443 bp, Homo sapiens
gcctccgggattgggaggagggagaggaagtgggcagggcagctcccgaaacaaggtctacagtttaaggatcagtagttcatttattctgataatcactgtttagttttatgtgacattcttgtattcgacctagaaatagagtaatggagattttaaggaaacctaaacttgttattgctacaactcagaagggtctgtggaagagccctcggaacctagcaaaactactttggttttggggtgtgtgtgtgtgtgtgtgtgtgtgtgtgtgtgtatgtataacatttaaacgaaaaaaaaatatatgtgtatgtatatattttatatgcatatataaacacatatatattcatacacacacacgtatgttttctgtttaaatggattcaattttagctatattttggtgccctgagctctgaacgttaaaaaaaaaaaaa

SEQ ID NO: 213159 - DNA, 171 bp, Homo sapiens
cttgccaagagttaagtggatacagatctcctaatagctgaccttctagttgactgaatgggatcatgtaagaaagacacctgctacgttgtcccagtgaataagtttgtcatacaatacagaggtctgtggaccctcgagaaagaaacatttattacttggcacatcatt

SEQ ID NO: 213160 - DNA, 429 bp, Homo sapiens
cctgtatggaaaatgaggatgtgctttgtccttctggggaccagattctgggactcttatggccattctgaagcacttacccttgggtgaaactgcagtgtcctcactatgatatgggcataacagcagggacctgtgtcactgaattactttaaggaacaaggaagccatgaacataggttgcagctaaaggtgagccaggctggctttggccagctacccacacttcccctgccctttctctttccttcccccttctcacctctcagcagccccctcatcccccctccaagttaaagattgctgtttaggctgtgcacagtgactcacacctgtaatcccagccctttgggaggccaaagtgggagggtggctggagctcaggagtttgaggccaccctgggcaacatagtgagaccccagtctaca

SEQ ID NO: 213161 - DNA, 342 bp, Homo sapiens
tcttctctcctctcaaccattaatagctcctttcctttctccccgatcccagtgctgatgagagaataaaaatcaaccagaaggaaatgtctaacctttctccctacctggtctactaatgtacctatatctgtacccaggtactctgctggacttcagttattaatatgccctgttattatctaaggacagtcctcacttattgaattcacatcctgccttccctacttattgccacctctagcagtcatcccttctctcttctgcattgttaatgattcctctttctttaccagatcattcctatcagcatactcacatgttgaaatagctcccatcttt

SEQ ID NO: 213162 - DNA, 366 bp, Homo sapiens
atgagctctttcaactatctcttgtccctgtgagttatatggaatacttgtagtatgagtaatatttcactgctgttaaaatgcagccatggctgctgggcgcggtggctcacgcctgtaatcccagcactttgggaggccaaggcgggcggatcacgaggtcaggagatcaagaccacggtgaaaccccgtctctactaaaaatacaaaaaaaattagccgggcgcagcggcgggtgcctgtagtcccagctactcgggaggctgaggcaggagaatggcgtgaacccgggaggcggagcttgcagtgaaccgagattggtcactgcactccagcctgggcgacagagcaagactccgtctcaaa

SEQ ID NO: 213163 - DNA, 426 bp, Homo sapiens
aatagtatgaatagaatttccgtagataaagatttccttgatctagtatgaggaagtgagaccttgtaccagctgttgataccagatatagaattttggttgagttttaagccctatttataccagaaagctgtagttttaacttaagatgacttagacaatgaaaacgctactgggaaagagatactaaaatgttcacagttttgactgacagaaaaactcaggagaattgtagaactttgaaataagtcagataaatcctttctaggatgatgggacagagaaattgtaaaggtttaggattacctgtttactgcttagaaaaaaataaaaaatacacttttaccaaggccagtaagaactattttctggaacaaacggaaaaagctggataatgctactgactgagttaaggggataagccac

SEQ ID NO: 213164 - DNA, 401 bp, Homo sapiens
cagaggcacagagaggctaagctaagttacttgcctaagactttacacctggaaagtgaaagagactagatttgaactcggataatctggctgcagagccagcccattcctgactatcactctatgctcaatgaggtttataacagatataggggtctcaaacagtctaatattacctacctgcccttataatgtttaaaacttgtcttggctggaaggttaagttttcatatctcttacctaggtttggaagcaagggcatactgcttctttagattttcaccctctttcaaatgaattcccacttttaagctccaaagtgttttcccctcccccaccggaagaagaacaatctaaaagagtgacagagcaaacattaaagtattgtaacttcccacttt

SEQ ID NO: 213165 - DNA, 195 bp, Homo sapiens
gtattatttaccctccaccaattcttttatctgagctcacacagacatcactgcacccaccatataggaaatgaagacactgctgtcgttctagaagggacagggatatacagttctaggagtgtgacatggcagcagcagagacgacaggaagcagaggctggctggggactacatctctggcatatgtcaatc

SEQ ID NO: 213166 - DNA, 823 bp, Homo sapiens
cctgagcctgaaaagtgctgtcacgtcagcggaaggaggcgtcccagatcttctcagctgtcttggtgccagccttcctagtcttcctacccacactcctacctgctgtcacaggccacagccatcatgcctcggggtcacaagagtaagctccgtacctgtgagaaacgccaagagaccaatggtcagccacagggtctcacgggtccccaggccactgcagagaagcaggaagagtcccactcttcctcatcctcttctcgcgcttgtctgggtgattgtcgtaggtcttctgatgcctccattcctcaggagtctcagggagtgtcacccactgggtctcctgatgcagttgtttcatattcaaaatccgatgtggctgccaacggccaagatgagaaaagtccaagcacttcccatgatgtctccgttcctcaggagtctcagggagcttcacccactggctcgcctgatgcaggtgtttcaggctcaaaatatgatgtggctgccgagggtgaagatgaggaaagtgtaagcgcctcacagaaagccatcatttttaagcgcttaagcaaagatgctgtaaagaagaaggcgtgcacgttggcgcaattcctgcagaagaagtttgagaagaaagagtccattttgaaggcagacatgctgaagtgtgtccgcagagagtacaagccctacttccctcagatcctcaacagaacctcccaacatttggtggtggcctttggcgttgaattgaaagaaatggattccagcggcgagtcctacacccttgtcagcaagctaggcctccccagtgaaggaa

SEQ ID NO: 213167 - DNA, 1481 bp, Homo sapiens
gtgcctccaaaaaccgtttgtggagacagcagagtgcccgaggcaggaaaccgctccggcctggaggcgcccctgcccggactcgtggactgcagcgctgtcccgctcggaagccgatcctgggagtccgagcggggccgcggggcctgcgtggcagccgagtcgagggcttcgggccgcggggctgtggagcgccccttggcgctgggccgccggcagccgtgagcgcatcactgcatttccctggaggaattcctcatctgttgaatgagggagttgaggcggacacgctgggaaatggcttcgagctcacacactgattttcgtgagtggaaagagaagccctttcttaggcgtcttccataccactgcatgttccagggtcctccctgggctctctgtctcccacgccaccgcgagcacggcctaagcgggcgagcgaaggcgcgacggcgccgagagccggctgtggtgggtgccgggcgcgtcaccgcgggctggcgggggaggggacgctgggaagctctccagaaagaggagccgccaccgagcaaattcccatctgccacgcaccgcagagcctcgccctccgccgccagcattttctttctttgttctcctagccctacaaacgctgggtttcctttctcattcgtggacttttttccctggatccttcttactgctcctaccctgtggccgcacgtctggcagatgcgcggcgggcgctgcctgaacccccgaatcctcacaagcctctgtgcagcggccacggccctcagctagcggcggggagactgaagccgcagggtcagggttagttgccacatgttttaaattcctatccaaacttccattataattgtttttatttatttattcatctattttttgagacagggtcccgctctgtcgcccaggctggagtgcagtggagcgatcacggttcactgcagcctccccacctccgactccagcgatcctctcgcctcagcctcccgagtagctgggaccacaggtgcatgccaccatgcccggctaattgttaatattttttttggtagagatggggcctccctctgttgcctaggctggccttgaactcctgggctcaagcgatcttccagcttcggcctcccaaagtgctggcattacaggcgtgagtcaccccgcctggcaagaattgttgttttgaaactaactgaggttctcccatcaatggatttaaattgttactttttaatgatttttttttaagtagccaaatactaaatgtatgtaatttgaatgtggagagaagataatgcatgattcaaattatgtggctgatcatgggtgatacactgggatatagttgtaaaataagtagttctcctagggaaaatattaaagtacaactgtgttgggtttaatatcagaaaaatgtaattaaaaacatttcctgccaataatttccaatctgatacttaaacaaaacaaaa

SEQ ID NO: 213168 - DNA, 451 bp, Homo sapiens
actagacttcatggtcaccctggccacaggtaccctatcctgcatcctgagctccgctcttcctggagtcatgggctggtctttcctcctggtggccttgcgccccagctccagcttcctgacttttctcttctggaaatgggaatgccaagtcctatttcatggagttttgagaatgaaatgactggtgtacggtgcaaagtgcctgtgagtgcccaagaaatctcttttattaacaagacacgaattcattccaattgatttgacgggccactgttgtcacagcagccgcactgccccaaaggcagcagtgatgtttgagcgccgactccccgacggcacttggtcctcacaaccaccccatggagttcatgctaagatcctcgcatttcatttgtgtggcagggacttgctgaggtccggggaggggcagagaggaggggtgcggccg

SEQ ID NO: 213169 - DNA, 366 bp, Homo sapiens
tgattggaggcattgaagtcggcctgtcccacttccccttctttgcctgcctctcgtcggagttccagctggtcagctccatcttgggcttctgctactctgatctggtttgctgttaccattctgatgttggagcggccgccaacttttttggggttttcagtcctatcaccatggtcaagttgctgtgtgatcttgaacaagcctctgtcactactggggctccactttttcatttgcataaaaaggtagttgttgtcgttcgtgatgcttccatttgtagagcaccccatgttcatcaaggtgtgcattcacagacaggtgttttctcatttactcctcagaagtaaagcttctgttccattg

SEQ ID NO: 213170 - DNA, 516 bp, Homo sapiens
ttttgattaatccattctcttcaaaaataaaatagttttaaggaaaaaaataagatttataacctgcactctttataagaatcaacatatattaccatgtaaatctcacttcattacaaaatatcctggcgagtctgtacatttggttaaaggtaagcacaaaaaaactacaatctcttaagtgttcataaaccaatagtttaaaaatatcctcaaatttttttactgaagttatatatgcattaataacaaatgaaagtatttatactatacgcatgataaattctgaataaaatgtaaaattttcttaattaaaacatgtctggcattaagtgatccaattagatcttagctaactgatctcagaagaatcagatgataatggaaaacaggataacctcatggttttttaaaattatgtatttaacttcatttacctaggtttaatttgatagactacctgtcaaggaaaagcctctggggaggagaaagaggggctaaatctcaagttgatca

SEQ ID NO: 213171 - DNA, 334 bp, Homo sapiens
aaaaagaagagatagcaatacaataaagttttgggtctgaatccttaaggattttttagttttattttatttgctttgtgttttaaaattattgaatgtatctgatcagagcagttcttcctaaggccacagaatttagacttgataaactaaacatacacctaaatcacataaaccaatttctttgtcttacaaatgtaaaaagtgaagctctagcagaggtctgctggaggtggctcatactggcttgtgagtgtcaattgttaaattttcaggagtcttatgagggagctgatttgcacagccatcattaaaaattgttatgtaaatttat

SEQ ID NO: 213172 - DNA, 815 bp, Homo sapiens
aattttcttaatgacaggaaagtaaactggtaactaaaattcattttgttctgtaggtttgtggcattttatgtggggaatgtagatgctaagtgttatgagttgtccacctgtataaaactacttcccagaagccttgatgttcccataaagagctaaagacaaaaccaaatcaactgctaacaccttttatgggagatcaacttgtgtgggttatgaggcccaccttgactaagcaggatatgtaggtaaacctgcccagttggaattagtagctgatactctaaaaggagaatggtgaacaggaggccattagcagaaacagcctcattcatttatagagatcatcttgttaaaagggaaatcagcttccctagatcccaagggggtattgaaaatgctaggagagagcctagaaaacttttctgtgcagattgtcagaaaaaggtgaaaatattttcttttactgtaaaaagaaagaaattcttttccttcttccaaagatgccttaccacctttgaaaaagatttttaaaagtctcagagaaaatgaaatatagattcttaaagtggaaagggaccttaaaaatccatctggtctggttcattttatagatagaactgagaacctcaaaaagttatgtaatttggcttacatcacaagagctagtttgaagcagaagctacgattttcttactgtgtccagttgtttggaagtatgaatagtcatcattaaaatgtagggagtttatagggaagcttatgacaactattagttaatttacaatttgttcactgtagctcatctgctttgt

SEQ ID NO: 213173 - DNA, 395 bp, Homo sapiens
ggatgcagggaggaagattccagaagaaaagaagagttaatatcaaatcattctaggcctcactggtaaccccttccccagtcccatttaggacctctaacctcaccaccccctaggtggggggaagggcctgagcctcccaggctaggtcttgctgggagcgcatcttaacaaccagtggagagggcaaggtggcagtgaagaagacagaaaaacagcagggtcccagagcctgagccatgagggcaggaggaccaagcatgacttcctgaggaccagagtgagcacacctggcctgctgtgctctaggtcctatgcaagacacttggctgtgttctttaattctcacaataatccatttaaatctcactacaattgcaatttcacagataagg

SEQ ID NO: 213174 - DNA, 168 bp, Homo sapiens
caataaggcatctgctatgcattcaaaaacaaatatcaaatgtaattctccagaaatttcttatggattttatgtagactagagactatttgtatcttttaggagacatctttcttagaacaaaggtatatacatgtttattattttggtgcatgaactttttcaaag

SEQ ID NO: 213175 - DNA, 1166 bp, Homo sapiens
  misc_feature (1166)..(1166): n is a, c, g, or t
agcgggggtggggccaagcccaagcctggcgcgcagagtgcaccttcctgagctcgagcggtccagcgccaagttcggggtttggggttggagcggctggtcacgtggctggcccgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgcttgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggtacggaagattgcgatgagaacggggcgtatctcatggcggacatggctcacatcagcgggctggtggcggctggcgtggtgccctctcccatttgaacactgccatgtggtgaccaccaccactcacaagaccctgcgaggctgccgagctggcatgatcttctacaggaaaggagtgaaaagtgtggatccaagactggcaaagagattctgtacaacctggagtctcttatcaatctgctgtgttccctggctgcagggaggtcccacaacacgcattgctgggttgctgtggactaagcagcaatactn

SEQ ID NO: 213176 - DNA, 1146 bp, Homo sapiens
  misc_feature (1146)..(1146): n is a, c, g, or t
agcgggggtggggccaagcccaagcctggcgcgcagagtgcaccttcctgagctcgagcggtccagcgccaagttcggggtttggggttggagcggctggtcacgtggctggcccgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagctggagtgcagtggtgcaatctcgtctcattgcagcctcaaacccttgggctcaagcgatcctcctgcctcagcctctctgtagctgggaccacaggctcccctgcaaactttgcttgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggtacggaagattgcgatgagaacggggcgtatctcatggcggacatggctcacatcagcgggctggtggcggctggcgtggtgccctctcccatttgaacactgccatgtggtgaccaccaccactcacaagaccctgcgaggctgccgagctggcatgatcttctacaggaaaggagtgaaaagtgtggatccaagactggcaaagagattctgtacaacctggagtctcttatcaatctgctgtgttccctggctgcagggaggtcccacaacacgcattgctgggttgctgtggactaagcagcaatactn

SEQ ID NO: 213177 - DNA, 486 bp, Homo sapiens
tagaaaacagctgctaccatgatgacgaagctgctgaacgaacgtggtagaccgaatcttccttcaggatatcaagaaaccagactgggatgctgggattacaggcatgagccactgcacctggcctaggattaactattttaataggcatttaggaagtagaatgggtagatatgggaattcagggagaattaggggaaggtggatagaaaagaggctaaactgattttcttctataatctttggaatcaaacgaagaagggcaaatcgattattcttctcaggaaaagattttctttatctttaaacgtataggtaaattagctgtcttctacctgataaatttgttttctgtaagttttgtaccttttttaaaaaaagaaattatttgtatcattaaggacttaaataatatacatggcatgaatgtacatctgcccatgaatgctgaatttattctagaaaatattgctttgcactctttga

SEQ ID NO: 213178 - DNA, 435 bp, Homo sapiens
  misc_feature (433)..(433): n is a, c, g, or t
cgactctagaggatccccgaatccagcaaaacattactgtgtacatatttatagagtacacagtgatgttttgatacatataatgcataatgatcagatcagggtaattagcccatccatcatctcaagcatcatttctttgtgttgggaacattcattaccctccttttagttatttgaaagtatgtaatatattattgttaactacagtcatcttacagtggtataaaacaccagaacttactcctccttatctagctataattttgtactggatttttaaaaatatggtaactagctgccatcctggggtatctcttttccaccttctcctcttttatgaggaaatgcctgtcatgtcttccctgttttgttttgttttggtttggaatgttttgctggattcggggatcctctagagcgaccgcagggngc

SEQ ID NO: 213179 - DNA, 665 bp, Homo sapiens
ggatgagttatgatgtgtgtaaatcctattccattgctgaaatgcagtgtggaacacaatgaactgaactctgagttatgatgtgtgtaaatatgtacatttgtctttttataaaaagtaaattgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttttgggccctttggcccaaattatttttaaatttggaaaattttttcattgggggccaatttggggctacttgggcaaattcccctttaggggggggttttaaaaattaaagggcccggttttaaaaaactcggtgtgggaaaaaccgtgggtttccccaatttaatcccttttgaaaaaaaccctttttacccgatggggtaaattccaaaaggcccccaccatttggccttttcaaaaattggccaacccttatgggcaatgggaatttggaggcctaaatttttggtaaaaatccgggtaaattttgtgtaaaaaccccttttttttttaacaaatggcgcataattgggaaaaccccttttttactatcccccgtatattgtttgggggttt

SEQ ID NO: 213180 - DNA, 378 bp, Homo sapiens
ctcctgtgggctgagctgcatctgaagcttacagcccgtgggggaagtgaggcccttcggagctgctgcttgtctgtggcttctgcctcccaggtggcctctgcacagtggtggtgacagtgatcaaatgaaagagcattgggataataacacttggtcacagatgttctgctgctgcaaaaatgaataaaagttactgttgtgaataaaaaaccaccccctctctgtattctatgtcaccctgtatactatttcagggtattttgagacagtttttcatcaagggatcctcccacctcagctactccagagcctgaggctgggggatcccttgagcccaggattttgaggctgcagtagtgagcccatctaaaaaaa

SEQ ID NO: 213181 - DNA, 749 bp, Homo sapiens
cctcccgagtagctgagattacagacatgcgctaccatgcctggctaatttttgtatttttagtagagatgcggtttcgccatgctggccaggctggtccccaactcctcgcctcaagtgatcttcctgccttagcctcccagagtgctaggattacaggtgtgagtcactgtgcccggcctggatcttttattgtttgtatttctgttcatttcttccctaagaaaccccacgtttttgtgggcaggacctggaatcctattcagttatacagccccgcttcgtccactgctccccttcagagtctagtgccctggacatcataggtattcagtacctcttgctggcttaggaacaggaggatgcctgatggccagggtgttcctctgaagcaggggtggctgagctttttgaatatctgcattgtgctaagggttaactacccaggcagtactggtggggaagggccccagaagcaggcccagactcaggtattgttaaagcagagtcatctttgctctgaagttttttcttttatcttttcttttcttttttaattgggggaaaccttgtcctaattggcatctttattgtggcaggaataggccaggcagggctgggggagtgtgaagtctgtgaagggaggtggcctgggggcccccccacacaatgcctgattgtgcaggcataggtatgaacacattgcagcctgtgtgcacccacagggtgaccacgagcaaggcctgggg

SEQ ID NO: 213182 - DNA, 245 bp, Homo sapiens
gctaatcttgtttcatctatgtctcctgctttcattctccctctccctttttctccccctctctctctcactggagtattttaaataaaatgatatcattttattagcaaatgtatttttctaacagaaaaagattagaaaaatatataaccacaatttcattatcactcacaatacattcaacagtagtccttgaatatcatctaacacccagttagtgttcagattttcctgatggtttcata

SEQ ID NO: 213183 - DNA, 413 bp, Homo sapiens
gtcaaaccagaaacacttgctttgctcagcatttaagtttttgaatgaggaaaatggcccttttccattgtatcttgaaaagcgttgttccctgggaaaacgctcccaaagttttcacaccttttgatgatggcaacttaaatgttcaattctggactttttttttttttaaataagaaatgccctctcgttggggcataagctctcacaacagtgtggcaggatggcttttcttaacacagaaccatagaaattagagcagaggggagactaactattaggtaatttcttccctgccccatttgtggaggtttgtttcctatagcaaattctcctggtgttttgtccagcaaggttgaaatgattcaagtaatggggcttccagtagggacatatggttattttatccagtt

SEQ ID NO: 213184 - DNA, 175 bp, Homo sapiens
tagagtctatgggaatccacaaaatgtttagatttgccctgggagtgatgctgaccacaaaagagacatagctgtggaagttctgaaactttctgtatactctcatcctatatagccatagtatgggaacatctgagcatgtacctttagaagtggcacatcccaggccaggtgc

SEQ ID NO: 213185 - DNA, 287 bp, Homo sapiens
attttaaggacgaggctagattccttttgctagtcaacctatagtatatgattactcagatatatttaggttaaatcctgtccccttccatacataagtatagtgtgatatataccataattagcctctaaggcagctctgacctctcttctgagttccatacctgtgttttgagctgcctctttgcgttcccacttgcatattctgcaggtgaaataacctcacgggtaagaaagcaaattcatttcccccagctcatatatgttgctgtaacaacatatgcattg

SEQ ID NO: 213186 - DNA, 843 bp, Homo sapiens
tagaactaagatgtagcttctcttagggcagaatccaggctttataggacttaagatgctattttgctttaaaaattttgggaggagtgagagtcttatatgtgtaaatgggtatatctaaggtcatgatatcataatttactaagtagaccaacttttatcaagtatcacaaagtagaatttggtagctaggacaactcccctctcccattcttatcttttttttttttttaatagttgtaaagtttctgggaatttatgggaacatacttttctttctttttaaaaaaaaaaccctttatttccttcttcctcattttgcttcccactcccccttaataaaaatagtaacttttgtgaaagagggagaatgatgttatgaactcagcaggttcagacaagtgttgtgagtgtggaggccaggaagccatgtgtatgtaccaggaccatgttactgcctaagaagaaatgagagtgtccagatgcaagggaggtgaatagagagtcaatttcagttccccttgattattgtgatttatgtggttcttctgggactgatgtaaagaatgtttcacgacttactgggaagccctctgttttgtgtcccttgtaatagtgattttacatcagaaataagccatctgatagagggaaagaatagtgtttggatttattgcttagttacagtgacatgtgtgcggttaaagtgatgaaattgtttagtatgagttagcatatatcttaattctaatgaaactagctctaagtctatgtttatgcttgtgattttagcttttactatggtaacctcatttctatcattaaaaacagtaaaaactctac

SEQ ID NO: 213187 - DNA, 497 bp, Homo sapiens
gcgctatcatgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggctgcctacagcatcgtggccctgggcgaggagccggcccgagcggtgcacccgctctgcccctcggacacggagatcttctctggcaacgggcactgctaccgcctggtggtggagaaggcggcctggctgcaggcgcaggagcagtgtcgggcctgggccggggccgccctggcaatggtggacagtcccgccgtgcagcgcttcctggtctcccgggtcaccaggagcctagacgtgtggatcggcttctcgactgtgcagcgggtggaggtgggcccagcgccgcagggcgaggccttcagcctggagagctgccagaact

SEQ ID NO: 213188 - DNA, 569 bp, Homo sapiens
tgagtggcttcagggttcaaatcactgttttctaacttgtgtatattgtaaattatccagctgggacactatcctggtgagttttgcccataggccttagccttgtcaaaagcacttttaccagcgagagctgggaagagatgattcggcctgtgggaaagacttgaagagagcatcagagcctgcacactgatgccagcgtattaagctgaagtgtctgctcttggaactgacccaaaaaactggcctccctgtactcactggctggcaggaagagagcatccagtaagagagattgggagcagtgtaattcagttcttgacataccttggaaccttggcctccatgacattgctttgagtgactgagtggggcttggcttggaaaaagccagtaccttttctgaaagactcttgactcatcttgtcttttctagatagattattttattttattttaaagaagaaaaggtaatgtgtgctaacccaaacatctggatttgaattctctctcaggtcgtgcaactcacagccaccagcaatattcacacaaccaagcttgcattaaaa

SEQ ID NO: 213189 - DNA, 355 bp, Homo sapiens
gttctcacaaattaagaaaaacagggagacaaattacactctttatttaaaaacaaaaacattacagaacatatatctgtggacaaaacggaggctttcatctctttttctatgccttgaattgaatcacacttgttaagtacatggaagatttcataatagccaagaggtcctaacctgttgttcctaacatacaagaagagaaaatgaagaaggtggtggagaggagagaaagtgaggagggaaggaagaaaagaggaagaatgggaggaagtaaaaggaaagcaagaacaatggagggctgtttacttgtacataaagaggggcaatgataactacctgattgggttgtcat

SEQ ID NO: 213190 - DNA, 579 bp, Homo sapiens
tagggtggaggggctgctgtggcccatggtgcgctcaggagcttcagtgtgaagggttcatgctcaggcaggctaggagtgtgcaaaacttggctgagcaggggtgtctcccaggagctcatgcccctgggcttttctgccacaggactggacactcaatgtgcttgggggggtctgtttgtttttccctcctgatatgacattttggggaatctccctgaaacctctatatctaaggactttttttggtaataaaatgattttggtgacctttccctttgactctgaaagtagccaatatacatttattgtaaataccatacatttgcatgtgatttctcatagttttcactatagtaatattggacctattgtacagattgaagacattgaatcacacagcaagtccagtgcctgcttacaaccaacagcaagtcagtggcaaagctagtactggaccccattcccatctgtttctataccacacctggcaggcagagctggggctcttaccactactagcccaaccccgggatacctccactgagatcctgtaccacagagccctgatataggggt

SEQ ID NO: 213191 - DNA, 252 bp, Homo sapiens
ccatagaaggcatccagttggtgaaaaggcatatggaaaggtgctcagcatcactgattatcaggaaaatgaaaatgaaaaccgccacgagtggtttagaccatagcggcatgcatgaaagttttcagacctccagttgttgggagtggctgaggcgggaaaattgctttactctgggaggtggaggtttctgtgagccaagatcgcaccattgcactctagcctgggcaataacagcaaaactccgtttca

SEQ ID NO: 213192 - DNA, 425 bp, Homo sapiens
attctcttcttgtcctcagaaccctttttttctaagcccaggaaagagagaaactagattctacccatttctaccctatgattaggtgcttttggtggaatacatcctaggtctctcactccctctcacagtcccgctctgtcttcaaatcagagtcaacttcaggattggaaggaatcttggcagtcatctaattaaactggccctccgattcttagcccatatgattgtgtgattccatcttggatagctccactttctctttggctatctagtcttttaaatttgtgatgtgtgggccaggtgcagtagctcatgtctataatcctagtgctttgggagtctaaggcaggaggatcccttgaagggccaggaagttcaagaccaggctgggcagcatagcaagaccctatctctaccaaaaa

SEQ ID NO: 213193 - DNA, 382 bp, Homo sapiens
tctttaaaagcagctgccgacataattgtatagcttgcattttctgtcatgcctcagattgccttccaaagcagtctggaagtattgtatttattaatgaagcctccactgctgcacactgaggtcgcctaagtcttgctatcatagagtatatcacacagacatctgtacacaggcatcttgcgacttctgtgactgttttctgggaatacatccacagaattggaattactagatcaaaggggatgtaccgttgacagatttctgatgtcaattgaacgcatcacttccacgtaccccgatttttaaaatctttatcaatgtgacattgaaaattgttgttttgatttaattattagttttggttcatgcttacaagcta

SEQ ID NO: 213194 - DNA, 1061 bp, Homo sapiens
gggttacagagattttttatggagtaggcaaggttcagattcagggcagtctttcaccccatgggaaagtggaaagggtggttgaggaggtggggattaaatgaggtggatttagtgggattaggtaattaataaaggtaacttaattatttgaagtcaaggcagttgacttcaacccttagatgatgtcaagggctggagctggtgctaaggaggctcggtggggaggtttgttggtatcagggaaattaaggatttggtgaaacagcctgtggatggatagccacaggcctgctggagttgccctggatggtgacgtagttggcaaggggagaaaaacctgagattgttagaggacagcagagggatagagcttgtgaccagaaggtctgaacttttaaaaatgtcatccagagcattcatatgtgtggaatagctcatttttcagttctgccatgaactttgtagaatattagcgcaatgaagagctttgtactcacacaccactggagaagacataatgagatatgatgatgggactgacaaaagttggctgttgtgatccatacttttggatcccaaagcccccaggagcccgtgtgaactctgaagtggtttgacatctgggactgggctgctggtgacgtcactccatccagtcctcctcaaactggtggcctttgaagttgtttttgagcatgatgataaatcagccatcagttggtatttattgagcacataccatgtgcccaagtaattaggcacccgtttctgggatggtctgggaaataggaatgcggtgtagcctgcagccctaatcagaatctagttgtggagagactaatagaactttcagcccacccaagggagaccacagtgtacagacttcctgaaggtgggggaagtcctggactcttgccctgctgagttcttaccctgccaatttgcctcgaaaaagccactgggctccctggtccttgggtgtctaaagtgtttaacaaccaacaaaaatcacaggcaaatctgctttgttttcattgttcggtaagagggctaggagg

SEQ ID NO: 213195 - DNA, 310 bp, Homo sapiens
gcagttttgggtctcgagattcaagaggaaagcctggttatttcagtgattgtggaagtggatcaaggggaagatgtgatgatcctggatggagtgactatgatggtattggcagttatggtgacagaattggctttggcaaatttgaatggagtggacacagtcattggtgtgacaagtcagataaagattattggtcaaaaccacttccaccaagtgaatgcttggagcaggtactcttttctggagaaaacactgggattaactttgagaaatatgattatctaccaatagaggcaaccagcagtaa

SEQ ID NO: 213196 - DNA, 141 bp, Homo sapiens
ttagaaaatgttcagtacttttagtttcacaggtttcatctactgtagataaaaaggtagtgaaaaatagccaggaaattattactctaaaattttagctttctctgaattttgttctctcttaattgggatcctattcag

SEQ ID NO: 213197 - DNA, 404 bp, Homo sapiens
gttgtggctgtttctaagagaaagcattctcttaagtttgtgtggcataacaggtttttaaacttttaattctttttaaccaaatttagaagtcagggaaggcttagcaggaacgatatctcctttcaaggtgaaccaagattctctgagtaaaataacaggacacccaaagttcagttttagaagttctacattagctcctcattaaaaaaaaataaaaagtctaatttatctccaaaaaggaagatattaaattaagaaatttttgaggaatggtgattttcttacttttgaatatatgaatacttcttagttttattatatgaaggaaatccctaacttcaagccaaacctaattttttaaaaattccaaatttgctatgtctgtctatatttatagacga

SEQ ID NO: 213198 - DNA, 350 bp, Homo sapiens
agtgctgggattataggcgtgagctactgtgcctggcctggcctgtgtattcttgtagtttaatttttttcttagttttaatttataatgtaagtattgctggggtggaaaaacttcacttcatactcttagggtcctagctgggcacacaaattaaattgacataagagatcaacaggagaaaagcataattacttgtatactggattggacaaagaataatttgtgaagaagcaactaaattatatgtgaagccttaaagatacgagttattttaacaaggtctgtacagaattctgttggtttcaacttctcatccctgaggagaaagatattttcgctttctagta

SEQ ID NO: 213199 - DNA, 477 bp, Homo sapiens
ctcaagccttgacctcataagctcagtgaggtcataaaccccattctcccacctcagccttacacgttgctgcaactacaggtgcttgcaaccacaccaaactaattattactattattattactatgtgtagagatggggtctcactatgttgcccaggctgtcttgaactcctgggctcaagcaatcctctcaccttggcctcccaaagtgctcccagacagccaccacgcccggcctatatttgcagttttgagtgcctttcatacacttggcatgtacaaggcattttatacatatttatttaatatagttttgcatatacttcctgtgatgcatttacaaggaattaaaaaaacagtgagaagttcatctcaatcagtgcaattgttcttagtttttatcctctctttgttgatttttagtatctatgaagtgcccacatttgcagtttaatctttattagattcacatatt

SEQ ID NO: 213200 - DNA, 119 bp, Homo sapiens
ggtagagacagaactagtagcacgtgcatgtcaatggcaagtcattctttatagtgttgccagtaggctccagaataaggtataatgatttcagttatttccccttctgtcgtcttctc

SEQ ID NO: 213201 - DNA, 729 bp, Homo sapiens
aactaaaattatagagctaaaatataataactgaaataaaaaaattcaagagaggggttaaacagcagacatgatcaagcagatcctcaagcttttattctggctttaagctaataaattttctgaactggagaagaaattatttagctttttggaagttttctcatttaatattaataagtttttttaaaatacactcttgttttctaaaaaataatttataatcaacttatagcttcttttaagtgaaaagttacccttttgctgtaatggtgttaactttcaggcatactccaaaatgcagcttgacgcattcaagtggagctcacataggaaagcagaacagagatgctcaactgaagcctgtgcaaacagcaaaaccaaaacattctataaatgcacaaagatgaacatggcatgtcagagacatttagggagctttgggctccttcatatagaaatggttagtctgaaaagagctaaggagaaaccagtcttagaaatcactatgttaaaaacaaacatatgaaagtaaagtagcccattcctttattctttctcttaaatattatattgtgattttaaagaatataatgagccaactggactttcgttagcagctaccttctgtagatctatcatcccacaatttctcccaaataagaggactgtgtaatatattgaataattttaaagtaataacaaaataatattttgagatgttaactg

SEQ ID NO: 213202 - DNA, 504 bp, Homo sapiens
cagggagtctgctgggaggagaagggaaacagaggtaggaattcccctgtaaagcgccttatgtgctataccagggaggctggggcagttagctgacagcctcagaggtgccaggtgtagggcatggctggaaagcaacacataaccactcctaggagggatggggactcctgcatctggctgtccattgagaccagccagacatttaactggctctcagctagttccaaacaaatgaaggacatatgaaagacctggaagccacttgaggaagggatgtctctaccacccaccttcagaatccctccttcccccacgacatgcgggggcagcaagcttatgggagctttctggggagagatgtggagaagcagaagttggtgtccctcagcacaatgagcaccctgatgtcggggcagggggatgggctgctgggggttgggggacagggatactggctctgactttgtggggcaacaagctagtctctgagctctcttatga

SEQ ID NO: 213203 - DNA, 460 bp, Homo sapiens
cttgttgtctctttccctggctttgctcattttcctgttaacgagggatgatgcttagacaagggttggggtcaggagagtgatgggaatttatttgttctagattttggctaacatttttggaaactaagaattgttaaaatgttttacaggtgttatatttcaaacagaattaagtacttatgtatttaaaaattatttagctttctttaccaatttcaagttgactcctgctgcgtaataccaattttggaagtttaaaattctgtatcatactttattgattgatctttctacagattcttgtcagagtaaatgtctcagtggggcttattttactctggctactgtttcattgaagaataggataacctttttgcattttggttctcatcatgttttttttttatgagacggattcttgtccagcctgggcaacagagcaaaactctgtctctca

SEQ ID NO: 213204 - DNA, 873 bp, Homo sapiens
gcttttcccatagagaagcagatgatgatgggatattggattgagttgggagaatgggaaaggcatttcagtccccaagtccagctggggtggagggaaggggttgtccaggttgcctcactcttgctgaatcaggtcacaggtggaattggaagggagtaaaaaggcattggcattgagggtgaggtggtgagtagaagatattttgaaaatgggaggatttcatttagaaatcttttatgagagaaaatttgaattattgatcttcctaattgtctttcagtattccaagaaagtccacttaacttggaggaatgaagtttcccactgataaacttctttaatcctgtcacactcaaaacttcagaaacaaccagaaagccactatcttccttgtatttttgtttttatttattttattttttgagacagagtttcactcttgttgcccaggcactccaggctggagtgcagtggcgccatctcggctcattgcaatctctgcctcctgggttcaggcgattctcctgcctcatcctcccaagaagattggattacaggcttgcgccaccacgcctggctaattttgtatttttagtagagacaggatttctccgtgttggtcaggctggtctcgaactcctgacctcaggtgatccacctgcctcggccttccaaagtgttgggattataggcatgagccactgcgcccggcctcttccttgtatttttaaagaaaatgcattgtcatgaccagaattttcccttggttggttggctgatgagagtgtatatataaatgcatgtatttcaagtcttacttttcattctttcctgagttgtgtatctctttttctcacccccatctcccat

SEQ ID NO: 213205 - DNA, 3164 bp, Homo sapiens
gaattccacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacactcaccccggacacacactcagcacacttttcctccatttgattaacagtgctgcacacacaatgattacgggaaagcgcaaataaatacggaaaggggtgcttattttgactactggaagagctttgctgggtctcagcgcaacttttgttttttattcctgagaaggtgatctctccatgcggttctctcacacaaggattctttaaaagaggaagagagacaagcagaggggggaggacagtctttcactttaagaacggctgggctcaaagataaaaggaagggaaaagcagcagcagcagcagcagcagcagcagcagcagcagcagcagcagcagcagcagcagcagcagggaaaccaacgctgcagcacttccgaaaggcatttttgatccatttctgagtgttgcggcccgtttctccaccgaagttggctccagctctagcagccgcattggatcccacagcttactgcgagactccggtgtacaatccggatctctgccccaacatgattgcggcccaggccaagctggtctaccatctgaataaatactacaacgaaaaatgccaagccaggaaagctgccattgccaaaactatccgggaagtctgcaaagtagtttccgacgtactgaaggaagtggaagtgcaggagccgcggttcatcagctctctcaacgagatggacaatcgctacgagggcctcgaggtcatctcccccaccgaatttgaagtggtgctttatctcaaccaaatgggggtgttcaacttcgtggacgatggctcactgcccggctgcgcggtgctgaagttgagcgacgggcgcaagaggagcatgtccctctgggtggaattcattaccgcctccggctacctctcggcgcgcaaaatccggtccaggtttcagacgctggtggctcaagcggtagacaaatgtagctaccgggatgtggtaaagatggtggcagacaccagcgaagtgaaactgagaatccgagataggtacgtggtgcagatcacgccggcctttaaatgcaccgggatctggccgaggagtgctgcccactggccacttccccacatcccctggccgggacccaaccgggtggcggaggtcaaggcggaaggtttcaatctcttgtccaaggagtgccactccttggccggcaagcagagctcggcggagagcgacgcctgggtgctgcagttcgcggaggcagagaacagactgcagatggggggctgcagaaagaagtgcctctccatcctcaaaaccttaagggatcgtcaccttgaactgccgggccagcccttgaacaattaccatatgaagactctggtttcctacgagtgtgaaaagcatccccgagagtcggactgggacgagtcttgcctgggtgatcggctgaacgggattttgctgcaacttatctcctgcctgcagtgccggcggtgtccccactactttctaccgaacttagatctgtttcaaggcaaacctcactcagctctggaaaacgctgccaaacaaacgtggcgactggcaagagagatcctgaccaacccgaaaagtttggaaaaactttagaggatgatttaatcaagagccgaaattattacccttctcaaagtccttattaagtgtaaacttctgttcaattcctaatattccactccgcagtgcaaacaatctcttcctttaaaaaggaataataatacaatatttaaacatcatctcacccacccccacaaggggagaaaaagtaggggaagcggatggagaaaaacccaaagccactagtattagaagacttctttccacacgatttcctatctcccttgaaaagtacaccgtaacactccgtaaacagcccagctgtaacgccagaccgagacgaacactctgcctaactatcaaaggattatagcaatcctggtgatttaggtgcatctgtctgtgagtaaacacgatttggatatgccatctgaaagaaactgtaatgtatattttgatttgtaacaaatattgtgatctcacattgtctttgaaagtgtggatgttggtgttttgtgatttggtgaacagaacttaaattgccattctggatacttccagacattttccactaacaaagatatcatttaaaggtagatttcttcctggtacttttatctgtctttgaaagtgtctgaactttaaaaagtttacattttgtttcaaatattgcttgttctatttctaacattccataaatatacttgaaatgttatttaaatatattcaaagaaatttgaattcagcttatataataacgcttgaatatctgaattatatatttgaaaaatgcacttgaaatacactggataattacttttgtgatttagattttaatttgttgctggtttttatttaattagatggtaataaatgaagtaaaataaaagttgttgtgtctcactttaaattgtttcctatcacaagatgtaatgatgcattttgaaaatcaaacccacttgaatatcttaaatattttgagaaatatgctaatgaaatccttaaaaataaaacattggagaaaagctctttctgtataggtccataagataacaatctactctcagtctctaacttacttgtaagacaattcctttctacaacagaaacaatttaaatctacctttgaaagcttgctcttcttgtagcatttttgataatataagaaaaaaagtctatcatgacagtagagatgactgagttaaaaatctgactaattcagaggaaatgaacttaacaaagtcataatgaaacttcgaaaattatgtatgaaaactaataaaacgatcctttctgacc

SEQ ID NO: 213206 - DNA, 3146 bp, Homo sapiens
gaattccacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacactcaccccggacacacactcagcacacttttcctccatttgattaacagtgctgcacacacaatgattacgggaaagcgcaaataaatacggaaaggggtgcttattttgactactggaagagctttgctgggtctcagcgcaacttttgttttttattcctgagaaggtgatctctccatgcggttctctcacacaaggattctttaaaagaggaagagagacaagcagaggggggaggacagtctttcactttaagaacggctgggctcaaagataaaaggaagggaaaagcagcagcagcagcagcagcagcagcagcagcagcagcagcagcagggaaaccaacgctgcagcacttccgaaaggcatttttgatccatttctgagtgttgcggcccgtttctccaccgaagttggctccagctctagcagccgcattggatcccacagcttactgcgagactccggtgtacaatccggatctctgccccaacatgattgcggcccaggccaagctggtctaccatctgaataaatactacaacgaaaaatgccaagccaggaaagctgccattgccaaaactatccgggaagtctgcaaagtagtttccgacgtactgaaggaagtggaagtgcaggagccgcggttcatcagctctctcaacgagatggacaatcgctacgagggcctcgaggtcatctcccccaccgaatttgaagtggtgctttatctcaaccaaatgggggtgttcaacttcgtggacgatggctcactgcccggctgcgcggtgctgaagttgagcgacgggcgcaagaggagcatgtccctctgggtggaattcattaccgcctccggctacctctcggcgcgcaaaatccggtccaggtttcagacgctggtggctcaagcggtagacaaatgtagctaccgggatgtggtaaagatggtggcagacaccagcgaagtgaaactgagaatccgagataggtacgtggtgcagatcacgccggcctttaaatgcaccgggatctggccgaggagtgctgcccactggccacttccccacatcccctggccgggacccaaccgggtggcggaggtcaaggcggaaggtttcaatctcttgtccaaggagtgccactccttggccggcaagcagagctcggcggagagcgacgcctgggtgctgcagttcgcggaggcagagaacagactgcagatggggggctgcagaaagaagtgcctctccatcctcaaaaccttaagggatcgtcaccttgaactgccgggccagcccttgaacaattaccatatgaagactctggtttcctacgagtgtgaaaagcatccccgagagtcggactgggacgagtcttgcctgggtgatcggctgaacgggattttgctgcaacttatctcctgcctgcagtgccggcggtgtccccactactttctaccgaacttagatctgtttcaaggcaaacctcactcagctctggaaaacgctgccaaacaaacgtggcgactggcaagagagatcctgaccaacccgaaaagtttggaaaaactttagaggatgatttaatcaagagccgaaattattacccttctcaaagtccttattaagtgtaaacttctgttcaattcctaatattccactccgcagtgcaaacaatctcttcctttaaaaaggaataataatacaatatttaaacatcatctcacccacccccacaaggggagaaaaagtaggggaagcggatggagaaaaacccaaagccactagtattagaagacttctttccacacgatttcctatctcccttgaaaagtacaccgtaacactccgtaaacagcccagctgtaacgccagaccgagacgaacactctgcctaactatcaaaggattatagcaatcctggtgatttaggtgcatctgtctgtgagtaaacacgatttggatatgccatctgaaagaaactgtaatgtatattttgatttgtaacaaatattgtgatctcacattgtctttgaaagtgtggatgttggtgttttgtgatttggtgaacagaacttaaattgccattctggatacttccagacattttccactaacaaagatatcatttaaaggtagatttcttcctggtacttttatctgtctttgaaagtgtctgaactttaaaaagtttacattttgtttcaaatattgcttgttctatttctaacattccataaatatacttgaaatgttatttaaatatattcaaagaaatttgaattcagcttatataataacgcttgaatatctgaattatatatttgaaaaatgcacttgaaatacactggataattacttttgtgatttagattttaatttgttgctggtttttatttaattagatggtaataaatgaagtaaaataaaagttgttgtgtctcactttaaattgtttcctatcacaagatgtaatgatgcattttgaaaatcaaacccacttgaatatcttaaatattttgagaaatatgctaatgaaatccttaaaaataaaacattggagaaaagctctttctgtataggtccataagataacaatctactctcagtctctaacttacttgtaagacaattcctttctacaacagaaacaatttaaatctacctttgaaagcttgctcttcttgtagcatttttgataatataagaaaaaaagtctatcatgacagtagagatgactgagttaaaaatctgactaattcagaggaaatgaacttaacaaagtcataatgaaacttcgaaaattatgtatgaaaactaataaaacgatcctttctgacc

SEQ ID NO: 213207 - DNA, 633 bp, Homo sapiens
tttccacacgagtgcatctgggctcttagacaaaccaacagcagcttcttctgacatatacacacgcacactcaccccggacacacactcagcacacttttcctccatttgattaacagtgctgcacacacaatgattacgggaaagcgcaaataaatacggaaaggggtgcttattttgactactggaagagctttgctgggtctcagcgcaacttttgttttttattcctgagaaggtgatctctccatgcggttctctcacacaaggattctttaaaagaggaagagagacaagcagaggggggaggacagtctttcactttaagaacggctgggctcaaagataaaaggaagggaaaagcagcagcagcagcagcagcagcagcagcagcagcagcagcagcagcagcagcagcagcagcagggaaaccaacgctgcagcacttccgaaaggcatttttgatccatttctgagtgttgcggcccgtttctccaccgaagttggctccagctctagcagccgcattggatcccacagcttactgcgagactccggtgtacaatccggatctctgccccaacatgattgcggcccaggccaagctggtctaccatctgaataaatactaca

SEQ ID NO: 213208 - DNA, 3163 bp, Homo sapiens
  misc_feature (2103)..(2103): n is a, c, g, or t
  misc_feature (2114)..(2114): n is a, c, g, or t
  misc_feature (2150)..(2150): n is a, c, g, or t
  misc_feature (2157)..(2157): n is a, c, g, or t
  misc_feature (2175)..(2175): n is a, c, g, or t
  misc_feature (2226)..(2226): n is a, c, g, or t
gaattccacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacactcaccccggacacacactcagcacacttttcctccatttgattaacagtgctgcacacacaatgattacgggaaagcgcaaataaatacggaaaggggtgcttattttgactactggaagagctttgctgggtctcagcgcaacttttgttttttattcctgagaaggtgatctctccatgcggttctctcacacaaggattctttaaaagaggaagagagacaagcagaggggggaggacagtctttcactttaagaacggctgggctcaaagataaaaggaagggaaaagcagcagcagcagcagcagcagcagcagcagcagcagcagcagcagcagcagcagcagcagcagggaaaccaacgctgcagcacttccgaaaggcatttttgatccatttctgagtgttgcggcccgtttctccaccgaagttggctccagctctagcagccgcattggatcccacagcttactgcgagactccggtgtacaatccggatctctgccccaacatgattgcggcccaggccaagctggtctaccatctgaataaatactacaacgaaaaatgccaagccaggaaagctgccattgccaaaactatccgggaagtctgcaaagtagtttccgacgtactgaaggaagtggaagtgcaggagccgcggttcatcagctctctcaacgagatggacaatcgctacgagggcctcgaggtcatctcccccaccgaatttgaagtggtgctttatctcaaccaaatgggggtgttcaacttcgtggacgatggctcactgcccggctgcgcggtgctgaagttgagcgacgggcgcaagaggagcatgtccctctgggtggaattcattaccgcctccggctacctctcggcgcgcaaaatccggtccaggtttcagacgctggtggctcaagcggtagacaaatgtagctaccgggatgtggtaaagatggtggcagacaccagcgaagtgaaactgagaatccgagataggtacgtggtgcagatcacgccggcctttaaatgcaccgggatctggccgaggagtgctgcccactggccacttccccacatcccctggccgggacccaaccgggtggcggaggtcaaggcggaaggtttcaatctcttgtccaaggagtgccactccttggccggcaagcagagctcggcggagagcgacgcctgggtgctgcagttcgcggaggcagagaacagactgcagatggggggctgcagaaagaagtgcctctccatcctcaaaaccttaagggatcgtcaccttgaactgccgggccagcccttgaacaattaccatatgaagactctggtttcctacgagtgtgaaaagcatccccgagagtcggactgggacgagtcttgcctgggtgatcggctgaacgggattttgctgcaacttatctcctgcctgcagtgccggcggtgtccccactactttctaccgaacttagatctgtttcaaggcaaacctcactcagctctggaaaacgctgccaaacaaacgtggcgactggcaagagagatcctgaccaacccgaaaagtttggaaaaactttagaggatgatttaatcaagagccgaaattattacccttctcaaagtccttattaagtgtaaacttctgttcaattcctaatattccactccgcagtgcaaacaatctcttcctttaaaaaggaataataatacaatatttaaacatcatctcacccacccccacaaggggagaaaaagtaggggaagcggatggcgccccccccccngccccccgtcnccgacgcccctccccacccgatcccccacccccccngcaacgncccccgtcccactccgtnccccgccccgccgccacgcccgcccgcgccgcaccccccgcctcccccccnacggattatagcaatcctggtgatttaggtgcatctgtctgtgagtaaacacgatttggatatgccatctgaaagaaactgtaatgtatattttgatttgtaacaaatattgtgatctcacattgtctttgaaagtgtggatgttggtgttttgtgatttggtgaacagaacttaaattgccattctggatacttccagacattttccactaacaaagatatcatttaaaggtagatttcttcctggtacttttatctgtctttgaaagtgtctgaactttaaaaagtttacattttgtttcaaatattgcttgttctatttctaacattccataaatatacttgaaatgttatttaaatatattcaaagaaatttgaattcagcttatataataacgcttgaatatctgaattatatatttgaaaaatgcacttgaaatacactggataattacttttgtgatttagattttaatttgttgctggtttttatttaattagatggtaataaatgaagtaaaataaaagttgttgtgtctcactttaaattgtttcctatcacaagatgtaatgatgcattttgaaaatcaaacccacttgaatatcttaaatattttgagaaatatgctaatgaaatccttaaaaataaaacattggagaaaagctctttctgtataggtccataagataacaatctactctcagtctctaacttacttgtaagacaattcctttctacaacagaaacaatttaaatctacctttgaaagcttgctcttcttgtagcatttttgataatataagaaaaaaagtctatcatgacagtagagatgactgagttaaaaatctgactaattcagaggaaatgaacttaacaaagtcataatgaaacttcgaaaattatgtatgaaaactaataaaacgatcctttctgacc

SEQ ID NO: 213209 - DNA, 274 bp, Homo sapiens
ttgttactatcttggtcaaaaatgagacagcccattttttaattgatttgaaaaatgtaataacctaattatataaaagtaggcatagccatagactaaatgaaagaatgctatttaataaaattatctgtatccttccgaatcactaaccctgaatatcatccatgaggactttttttcccattcaatgaagaatttcatatactctgattgcctgctcttcatttctggaagttacttatggtttggagtttttagtgtctatatttgggga

SEQ ID NO: 213210 - DNA, 183 bp, Homo sapiens
gcctacttcctctgttgtttcactgaatgattgtattccttagtctttctgttctctctctgcagtctcactaggggatctgatctcatctatgctcttgacatatgcttatgatgcctccatttatgtctctagactcttgtctgtgcgtcagtttcatgaatccctctgctgtcgatactg

SEQ ID NO: 213211 - DNA, 251 bp, Homo sapiens
ggaaccctgatgtaaaccagggcctttagtgaataagaaaggatcaatatggccaggtgcagtggctcatgcctgtaatcccagcactttgtgagggtgaggtgggtggatctcttgaggctaggagttcaagaccagcctggctaacatgatgaaatcctgtctctaccaaaaatacaaaacttagctgggtgtggtggcaggcgcctgcagtcccagctactcagaaggctgaggcaggagaactgctt

SEQ ID NO: 213212 - DNA, 280 bp, Homo sapiens
ctgagggaatctgatcccagctacagattcctgctaccccacatccattttctgaagtgtaatgattttctggggccaggactgagggctcagagacacttctgtctaactggggctcttgcttgcttgcttgctttgcctctttctctccctctttctctcctccctccctccctctctcccttcctccctccctccctccatgggagtcttgctctgtcacccacgctggagtacagtggcgtgatcttggctcaagcagccctcccatctcggcctc

SEQ ID NO: 213213 - DNA, 712 bp, Homo sapiens
agggggggctagggaatcagcttaagtggaggagcgttcgtttagtatgtgagaggtaacgggatcgatgcctgcattctccacaggggaattttaaaagaaaaaaaaaaaaaaaaaagaaaaaaaaaaaaaaaaaaaaaaaaaaaaaaaaaaaaaataacaaaaaaaaaaaaaaaaaaagcatgaaaaataacaaaaagtatacgcatgaagcaaatataaacttagagaactgaaacgaagaatccttcagataagagtaatttgcctaacaagttataatttagcgacaagaaaattcaatggacctacccaacaaaataccctaaactgaaaaaaccattttaccaggaaactcaatcaccttaacggcaaccaccttcgccagagcgtaaactatgcaaacggctagtataaaggaattttacagccgtatgaaagccctaaaatcctaacgaaaatattccaagataatatcatgtaaaaaccagaactacataaaaggttaaaaaacctcaattctttaacacaaaagcctcgtattggccaaatccactttaatctcacaggaacacccctccatatcttacggaccgagacacccattggagcgggacactactaataaacaaggccatcaaaccgctaaaggtacacataaccgcaatcaagtcttacggacactctctgcctacacctataccagctgtcc

SEQ ID NO: 213214 - DNA, 263 bp, Homo sapiens
agcctcgcgaccctgtctcaaaaaaataaataaaatgcaaagaggtacaaggatggctagtcgtctagtcaaaagtagtaaggatatgtagaaaaaggcaggaccaagaagaaataatgtcataaagacaaacatgttgattcatctaacttgtgtgtttcaaggaaagaaaatatttcaaatcaggtgttcttatcctgagatccactgacttgaagcaaccgggggttgaaatgaagccctgattcctaaaggattctatg

SEQ ID NO: 213215 - DNA, 666 bp, Homo sapiens
agtttcctcatacttacagagttggtttgagtgttaaataggatcatgcctataaaacacttaggtcatcaccttgcatagagcatatgtcagtgaaaattaacttaaattgttatttttattattagcagatttttttcagcctgcacgtgtacatccatgcattgcacattcctttctgttcttgccctccctgtcattgtgaggatactgaaaagttggtcttcctgtctctgggaaggcaatttagtccatgtaaaatgtctcaaattccctgtcctgtcacatggctcatgaactgcctctggcttctgaaggagcctgaaggagttgtcaaacctgccgcagagtgctgacgatatgtcagtgtaggttcatccattgtaacaaatgttctaatctggtgtgggattttgatagtgggggagtctggaggtgggtagcgggtatgtggaaaatctctgtactttctgctcaattttgctgtgaccctaatgctgctctaaaaataacatcttttgggaaaaaaatatatttacacacatacaaaataatgtgagcagtacatgccaggcactgaattatgattccattgaaatagtttgaaaatgtggaaatcattaaaaaaaaaaattgtcccaggtggagcctggtagcactgccttt

SEQ ID NO: 213216 - DNA, 601 bp, Homo sapiens
actgatagaaggttaaaagccatcaatgtatcggtcagctaatgtccatccacttcttacttattcagaagatacaaaagagttctaactggctgacccttcaaagaaggtagttttttaaattaatttttacttatacatatcataaaaataggcatctgcagtatcctggaatgagtgagggttatggagacagatctagctctgaatctcgactaagccacttactaattgcattatcctgtgcaagttagaagccccagtttccctaaatacctacccctgtctcttagggttgttgcaaagtgttaagtgtatgaatgtacataaaacaccatgatttattgcagcggccctagagccagacaggggtttgaatcctggctacacccctcactaaccataggccaacatccaaagctgtgaacctaagttccaaattccttacctataatgtagaaaaatattgtctactccaaaggatagccatatgaattaaataaagcaatatttgcaaagcccctagcagaatgacagacacataataataaaaatcaaaaaagaaaaaaaaatctgatgtttaaaaaatcaagctgcaagg

SEQ ID NO: 213217 - DNA, 491 bp, Homo sapiens
aatccctcaagcatgcctttacaccatgcccaaaaacgtttctttccaacaccctcatctattcagttctctgctcaaactcctcagacagaccttctctgaatactccatctaaaaagacccaccactgccattcctatcccccttctctactttattctgttttacagcatttttttttttttttttttgagacggaatcttgctctgttgcccaggctggagtgcggtggtgcaatctcagctcactgcaacctctgcctcgcgggttcaagcgattctcctgcctcagcttcccgagtagctgggattacaggcatctgccaccacacccagctaatttttgtgtgtgtgtgtgtgtgtgtgtgtgtgtgtgtttgtgtatttttagtagagagggggtttcaccatgttggccaggctggtctcaaactcctgacctcaggtgatccacctgcctcagcctcccaaaatgctgggattacaggcgt

SEQ ID NO: 213218 - DNA, 609 bp, Homo sapiens
taaggaatcagggctattccttactcaggaactctctgacctgaccttttatcatcccatcttcctaaacaatcaaaagaggaaggatgattcctctcacattataaaggtgagacaggctgggtgcggtggctcatgcctgtcatcccagtgctctgggaggccaaggcaggaggatcacttgagcccaggagttcaagaccagcctggtcaacatagtgagactcccatctctactaaaaaaataataataataataaaattagcctagaatggtggcaggcatctgtaatcccagctccttgggaagctgagcaggaggattacttgcacctaggagtttgaggctgcagtgagctatgatcacaccactgtattccagcttgggtgagagagcaagaccctgtctctaaaaacaattaaaaaattaaaattaaaaaggagggtgagacagatatgacaaggaccacatggtgaaacccagtcactactaatacattcgccgggccgtggtggtgtgtgcctgtagtcccagccgctcaggaggttgaggcaggagaatcgcttgaacccgggaggaggagggtgcggtggctgagatccgccctg

SEQ ID NO: 213219 - DNA, 322 bp, Homo sapiens
gtgctcctaaccctagagctgaggggcttgggctttcatgcaagagcagctttcatgcaagatcacctgctggcaacgaaactgagaacgtcagctctgtgaggtcagggattttaatctgtttttagcctggcatataaaacacactcaatatatacatgttaaataaatgagcgaagccaatcaaatgatacataattttaaataaatacccagaaactaggagtttgttccaattcatcagtgtcattttccttttactttgctttcgtgtttattagcataaaaactctattttttttttttttttttttgatatgga

SEQ ID NO: 213220 - DNA, 161 bp, Homo sapiens
ttttggctggacgatttgagttaatgtttttttttttcaagctttgtgatagaacactatctgaaaatagctactttttcctccttatcacatctttttaaagttgttctgtatgattaaaaagattaaaattattatgcccaaagtgaaaatgaggaaca

SEQ ID NO: 213221 - DNA, 150 bp, Homo sapiens
gcacccagccaaatccagcctcttggtgttcactaatgcagaacccacctgctctggttcgggtctgctttatctctgtacatgggccaggcctcacctagcccagggctaagtgcctattctccttgttttcacctggatgggagcaat

SEQ ID NO: 213222 - DNA, 554 bp, Homo sapiens
catttaatcaatttggatggagctagtattttaaaaatgtactaaagaagttggtttacagaattcggatggctaaagaaaaacccctttgccttaccaaattactaatggtgagatccgtgtgcattttaagttatagaacctagttatgtgtaaggccaaggaaaacaaaatcacagacccaaaatgttctgtgattaagcagcaaagtccgttattgcacagagtttcagaagagtaggaaccctgctgtcagcagtaatgctttaaggcttgatcactctgtatttcttctcctgttacctcagtctcaggtgccaaatgagaaggccagcacagctaaggcctgcgcccctgaagcagccaagacagggtcaagttaaggtcaggggttgttctctggaaacacattaacctcggtgacgcctgtatcccaatctcacagactaatctttttgtgtaattttaaaagaaacatgtgaatgtccggatggctattagaattcagccctataatgagccttctagttcactaacccatgcattctcgatgt

SEQ ID NO: 213223 - DNA, 446 bp, Homo sapiens
tctctacaaaaaataaaaaattagctgggtgtggtggcacatgcctgtagtcccagctccttgggaggctgaggtgggaagatcgcttgagctcaggaggttgaggctgcagtgagccatgatcacaccacagcagcccagcctgggcaacaaagtaagactctgtctctaaaaaataagtaaatacataaaaaataaaaaagactatctactaaaagctaatagcaaatagtgccttatataatgaaacaaaaatcatttcagttaatatcaggaatcagacaagggcgactgttatcacctgtagcatgtaactttgtcttggacttcacagcaaatgcagcaagacaaaaagcaataaaataagtggtctaagctttggaaaatgataaattaagcagcacatctttttgctgataatagaattgacccccccccccaaaaaa

SEQ ID NO: 213224 - DNA, 380 bp, Homo sapiens
aaaaaattaagaaaaatccatctacaatagaatatatataaaaaaatacttaggaataaatttttaaaactccaaaactaataatactcccaaaacaacacaacattgttgaaaggaatttcttctttataatcctgcagccattgtcaatatactgtgagatgtccttgcacacctttctccaggctcatacacatgcttgtatgtatgcatacacatcaccacacacacacacacacacacacacacacacacacacacacacagcactccccgtctaatcctgcagccagtgtcagtatactgagatgtgtccttgcacacctttctccaggctcatacacatgcttgtatgcatgcacacacatcacaccaagtgc

SEQ ID NO: 213225 - DNA, 471 bp, Homo sapiens
agttgaagaaatcactcttattccagcccgggtgtggagaggcggccatccttggcgggatcttatttccagtttgttagtgtttcagagattatgggggaaagggggttctatgaatgtcagacactgcgtgaggcacatttggtttcagtaattttagcatcattcattgtaaagtgatgatccctcggaacttcttcacaatgagaaacctgaaaggtcccagcagccagcaatgaatgaaaggtggggtggggccgctggcagggcgaggccttgtgagccatgtgcctgtgctctcaagtccgaagtttgtggggatgcatgcaggagattctggccctgattgtttccccagaaccaggatgcgttctggttggcaggacaactggccttcacttggtggccttcagtgggtgttctcattggttgccttcgtttagtgccctcagttgtttctcttcagttggc

SEQ ID NO: 213226 - DNA, 362 bp, Homo sapiens
tcactgggcggagttgcttgcttggctgggaaccctcaggcccactgggaatctctgccagcctgcctcctaggcccactcatcctctccctcttcctgccatctctctctcagggatggacaccactgtgaccctgatttggcaagaaggaaacttgggtgttatccttgatttcatatctcctacccaaaatatcccatagatgtatcttccttgttatttctggactctgccccctcatcttagtctttatttcaaatactgcagttaaagcagcacaacctttccccaggaattttataacattctcctaacttgtctcctttcctcagatctcgccactccagtccattttccaatc

SEQ ID NO: 213227 - DNA, 399 bp, Homo sapiens
cacatatatgtgcatctattaatattgtgcctgcgatgtttgcacatactattacatagcacatcataaacctttccactgttgatcaggaaacaaaaaagtcattttatgagtatgatgtcattagaagtactattacagggctcatatgaaggtaaaacaaaaaaattaacttttttaatgaaggttatttactaccaaaattgaagccctctaagtgtctacatgataaagaaataccttctgcatcataaaactcaggatttcttcttcccaaattattcatttatcacaagtaacttttttatttttgagataagattctcgctctgtcgcccaggctggagtgcagtggtgtgatctccgctcactgcaacaaaaacaaaactccatctcaaa

SEQ ID NO: 213228 - DNA, 348 bp, Homo sapiens
  misc_feature (263)..(263): n is a, c, g, or t
aaagcctttgggatgtcgatgagtgtggaaggctcatattggcaacttattaacatcaaaattcttcagttataaggattttgatactttattatatacctgtgcagcagagtttgactttatggaaaaagagactccactgagatacacaaagacattattgtttccagttgttcttgtagtgtttgttgctattgttagaaagattattagtgatatgtggggtgtcttagctaaacaacagacacacataaggattttgngaggacaaggattgtctaatcaccagtttgatcatggagagctggtttaccatgcattgcttgttagcatatacagcccttggtt

SEQ ID NO: 213229 - DNA, 224 bp, Homo sapiens
gaggctgtccctacatatttctggtactttgagtaaacatggagagaaagttcacagtgacctaatcagaagcagaaatgaaaatggggcaaaatgccatgtgggggcattttgcaataagaagcaacaggagtctggcacctaaatccagcaactgtgtagccagggttggaaaaagtccaggttaccagcaacatgcctgttttttacggagaatgagtgaa

SEQ ID NO: 213230 - DNA, 476 bp, Homo sapiens
aattaaactgaaaacattgttaaagattcatttaaaaagaataaaactcactacatgttatcataaataatattttttacaaaaaatattttccaaaacacaaacagtctagtgggaaaagtgacattgtttcacatttttgcaagtttgtttcatatcttgcttactagaagacacactctcacacctgcttctgcagtcagtctgttgcgatatcatgcaccatgtagtctctggaaaattccactgtaagcatgtgagaaaatgaaagcaaaaaaatcaaataacatattagctttatcataaaaataattttgacctcattgattcccaagcttctccagaccacactttgaggactattgatcttactcagtgataagagctttcatgtagattgattcaactgcacctcacaaagtttttaaatgcctttgattatccctattacacactcagggaaagtaatccttgga

SEQ ID NO: 213231 - DNA, 402 bp, Homo sapiens
gactgtgacagaaaatcctccccctctcttatggcctaggagcaaaggactttccctctcccaaggctccactttctgtttctccttctcctgctatatctttggcccagtgagcttctcaatcctgttcagagaagcacacaccttccgtgggctcacctgtggcgatttccaggtagtcttgactcttcatcaggctcagtgttgagaggcagccatcacttggcatccatgaatggcacccttacccccatagttgtgtcacctggctgccatgttctgggcttatgtgttccccatcattccttttggccacactaccagtattgtggtaaaatgaagggaggtgaaggggtgtgtatcattctctgtctgccctagcatcccctgcaagcttgttct

SEQ ID NO: 213232 - DNA, 136 bp, Homo sapiens
ctcgagcgggctcggctcacagcgaccggcggccggggagatgtgagctggggccggcgggcgcggccggaccgccgcgatgtggctcaagcccgaggaggtgctgctgaagaacgcgctgaagctctgggtgacc

SEQ ID NO: 213233 - DNA, 178 bp, Homo sapiens
cattagggtggcgacctggatgaggcgtccttgcttctgggtgcaaagactcctagctggaagtctaggaaaaattacctaggaaaaaagacttcaattataactgataaattagagaaagttgacgtttaaggattagcgtcatagatgacttcagggcattaaaatttggagcact

SEQ ID NO: 213234 - DNA, 216 bp, Homo sapiens
tatgatttcaaattatatttttaggcaacagatgcaacttattaataatttaatgctgtagcaaagaactactgaaaatgaatcaaacagaaactcacccccttagggtataatctagggttggtatatatttagctcagtctgctttctctaaccacagaatctttaatatttctataatgctctatgctaaccaaagtgtacgcatgtttcttt

SEQ ID NO: 213235 - DNA, 483 bp, Homo sapiens
aaacagaaatataaagacttctatcatgaaagaagagcctgaggaatgaactaaagtgttaacactctgctcagcagatgtcagctcggaacaatggggtgagggaagtgggaaagtgagacaaggagatcaatgaagcaacggtatgcagtatatgacttcacagtcagctaagtgtgattttagcctactctgcctatgtaggagccattcttatttcctttaatttcctaaaaaaagaaaaacatatatttaaaaagtgattttatatttttcaatggttgcaacataatcaaaagaatcatatgtcagccaagcacggtggctcacacctgtcatctcagactttgggaggccaaggcgggcggatcatgaggtcaggagttcaagaccagcctggccaacatgatgaaaccccgtctctactatctgaggcaggagaattgcttaaacccaggaggtggaggttgcagtgagccaaga

SEQ ID NO: 213236 - DNA, 393 bp, Homo sapiens
tccaaagtagattgtttcctcatgttacacattcttctattttcccatcattatccttcatattgacattcacagtttcattaattatttgtgtaatgatttacattgtaaaaacacaaaaaaatagttcaccactggtcattaatgtccagtgtatatttggcactgagtgaatatttgtggaataaaaaataaataaataaatctgtagatggattctaactttggcattgtccttaaaaatacctttcctagtatacaatattgaattctacttttactgactgtatgatatctttaattctttaacaggaaatatattttgatatgttatttaaaattgtgacttgaccttactgattttttcaaataaaaagtattttttcaaaaact

SEQ ID NO: 213237 - DNA, 315 bp, Homo sapiens
tgagttgtgcataaaagcagttcagactaggctggccatagaggagatgacaggcctggtgcagattcacctgggaagggaaggcagctgatgaacaggggctgcgggatactctcctgggctgccaggagccagtctatggccccaaaagcatagtgtgtagggttttagcctggaatccaggagagactggggagaagccccagtctgccctccacctcctgccccgcccaaccagttcctctagactgatgttctcctctctcctatgactttctaccctagggggggtctctgtaagccaataattgatta

SEQ ID NO: 213238 - DNA, 515 bp, Homo sapiens
aaaatttcccattgtgtgatgatgcgtgaatctttgatctctattggtctgacttcatactcaggctacttagtttattttgagaaagcaatctttcctgttgtttctcaggaaatggaagaacatatttatgaacaatgttttaactttcagtttaagtggttttaattttttaactattttcactttgaagagtatataattatgtggagaaattaagactctcaaaaagaaactagagcaaagaggtggagaggcaattgtatagtcagacttcagctaaaagggtgcatttttaaaagatgcctcacaaaaactgttacaccctgtttcttcctgtgaagaattttccaagcattaagttgtgtaatagcttaatgggggaaaaggaaattcccaggtttctctcaaatcggcatgagcataaagaaagattagaggcttaatttacaaaggagtgtcctatcacctgcttaggcttgttaaattattacaataatctctggagccactca

SEQ ID NO: 213239 - DNA, 475 bp, Homo sapiens
aagacattcaggtatcttaggtactgtggcaaactggaaagaacattcttgtcttgagttggagctccagctcatccccaactgcctgttgtcacagggaagtcaggctgaatgttaccaaatcttctgatttttaaagaggtactggaaatttcagtttttatatgaaaacttctgttttttaaacacaagcatctaattcacattctcttaaaacatttttcaggccaaataaaatccagaagctcagtcctttaagtttccacttgggatttagaccttcataaataaagaccatttcattcttcccagaggttaagaaatccaggtttcagaacacaatgcctaggcttctttgttggaagagacatggaaaaattcctctcattctttgctgatgagcctacaaccttgaacacaagacacagttaactctgtaatcaagttattctgccacgtgaaatttttcacaaat

SEQ ID NO: 213240 - DNA, 296 bp, Homo sapiens
ccaacagagctagtaagagtgggagctggaattcaaacccaggtttgtctaatttggaagccaaaggttttaattagtatattagattttataccgtttaatttatacaataaaaattaaacacatattcttaatcaggagggctgtccccttacaacacattacatgagaagcccagcaagtcatggaaatgactccagtgttttagtaacacagctctctgagagtagcatccaatatgaaacccaaagggggatttcatattttctgcttatacattggctattcatagtatg

SEQ ID NO: 213241 - DNA, 163 bp, Homo sapiens
atttactactccttttactgattctggaaatatctcagaaaaaagtgaaatagacctctaccagaaaaagagagaggtccagattccatgccactcaccctgtatacccagtggctcctccagagtcagttcaaacacaataggttcattctggtactaagta

SEQ ID NO: 213242 - DNA, 471 bp, Homo sapiens
aatagggagtaaaagttatctcaggtacacgaaagaacatgagtcaatgacttaggaaatgctcagacactgtaaggagagaatgatcacctatggagtcttccagattccaaagaaccagctctaatgaggggataccattgcattgtcagataatagacaagacaagcatcccaaacagccttcccctcttccaacagtgggattctagggcagggattaccaggtgtactttggcaacagtctttagtacctttgaagggccaatcaagggtgttttgaaattgtccaaagaaaattgtagctgaaaatcactaaccctggggaagaaagggtgattgggaaacccatttacaatggtatgaacgaatactcaccatgggtctagcgctgtgataagaacttccttctctctcactgatgggagcacacttcacctagcaatgggccatgacaatgggccactcccct

SEQ ID NO: 213243 - DNA, 391 bp, Homo sapiens
tttggctctgtgttcccacccaaatctcacctcaaattgtaataattcccatgtgttaagagcgagaccaggtggagataattgaatcatggtggcagtttcctctatgctgttctcatgatagtgacttctcatgagatctgatggttttataaggggcttcccccttttctcagcactcatcctccctcctgctgccctgcgaagaggtgctttctgccatgattgtcagtttcctgaggccttcacagctatgcggaactacgagtcaattaaacctcttttctttataaattacccagtcttgggtatttcttcatagcagcatgaaaacagactaatacagtaaattggtaccaggagtagtggatcactgctgaaaacataccca

SEQ ID NO: 213244 - DNA, 309 bp, Homo sapiens
acagtctctcatggcttcccttggctagggaagggaaatcccctgaccccttgcacttcccaggtgagacaacaccccaccctgcttcagctcaccctccatgggctgcatccactgtccaaccagtcctattgagatgtactgggtacctcagttggaaatgtaggaatcatccaccttctgtgttgatctcgctgggagctgcagactggagctgttcctatttggccatctttttggctgtatctgttttgatgctagggtcatgcagttttgattactacagctttgtgtattagattttgagat

SEQ ID NO: 213245 - DNA, 358 bp, Homo sapiens
ctcatgtttttccttccatgtctcaatggcttacagaagatattgtggcagataataaatttagttgagcttctaactgtagcatagtttttactgtcaaggagcatatagtttagttcagggaacagcaaagtataaccccacagaccaaatctagtctgctgctcatttttgtaaataaagttttattggaacacagccatgcactttcatttacatatagtctatggctgatgtcatgctacaaaggcagagttgaatcactgcaacaaagaccatatgatacacaaagtctaaaatatttactatctggtctttatttatataaaaagcgtgctgacctttggtctagcagaag

SEQ ID NO: 213246 - DNA, 457 bp, Homo sapiens
ccgtgtaatgttatttggagtactttggcagaaaacttgggactgtcttaattgtaaaaacatatagctacattttactgtttttctcacttctcttgacagttgaaacttgtaactgctcccttcttgaaacttgcctggctcttgtgatgccacagcctcctactgcttgtctggcctttctggccatttctcagcaggttggttttcctcacctgccggttgaatgttttcagtcttgaagggactgttggagttctcttttcactcttccattccccctggacatcctcacggacttaactagtttgagcacctatgcagtgtcggttcccaggtgtgtaccttagctctggttccacctgcttgctgggcaacaccttccttggctgtcccatgggccccttggattccgcatgcccacagcagtccttgtttcttccccacgccgagcccc

SEQ ID NO: 213247 - DNA, 180 bp, Homo sapiens
ttctgccaagtgtttggttgtgtgatctttgcaagtttctttactttcctgggccctagtttcctcagctgtaaattggcaataatagtagtatctgctgtgaggttggaatacccctattcatctgtgtctcttcagccaagtgcttggctactggttgagtcaagtggggttgagtgt

SEQ ID NO: 213248 - DNA, 782 bp, Homo sapiens
tctagagggtgcgatgatggaagaataaaatgggatggaataataccagtgtcctgctgcattggtattcaaattcagtatccaaggctccacatgcctgaaatacagatttactctgaaatacagtggatggccaacaaatgtttcctgattgaaaaaagatggaaggaaagggaagggagagaaggagaagctagggaagtcctgtgtggaacagtagagctgggatcaggtacctcataagagaggcggggcaaggtctgataacccctttttttcaccgttctacagtaccgtgtgcggtggggtctggagtgagccagaacagataagtcgttgccccttgccatcccccaaaactatgcccagggtagctggccaggactctgtctgcatcacactcctgccagtgtatggcatggggcctggcaaataggaggtgcctttaaaacgcttgttgagcagaacattccagttgacctgatagttcttcatgaacatagtcattcattttcattgacagaacttatgttaaatgatacgaagttattttgagaggtaagtgaccctgaccctgtccacaagaattattcagttccgtgaatttggtccagcagagtctggtttttaacagtcatttggcctgagctattgactgcaaacttttaagattcttccaggctgtctcattagaagttgacagcactttggcaccacggagacctacaggtgtccttattcccccaccacgcttctggtaatgagaaatgaaagtcgtccag

SEQ ID NO: 213249 - DNA, 406 bp, Homo sapiens
caggtggcaatggggagagcacacagattcaaggagaatatttagaaggaagaatttggcagatcggtgcccttgtgagatgtgaggggtgaagaagaagctatcaagagtgaatcccatagttctggcctgagagactgaataaaaatatcctttttttctttctttatgttttatagtttcattcctttttattgtaaattgacatttataattgaatacatttatggggtaaaaagtggtgttataatttatgaatacaatgtggaataattaaatcaagctagttaacatatccattacctcaaacatttaacattttttgtggtgagaacatttgaaatttaacaattttgaaatgtacaattctctattattaactatagtcactacactgtgcaaattt

SEQ ID NO: 213250 - DNA, 399 bp, Homo sapiens
catgaattacatcctcttagcacgtacacattctgctgatgttcaaacaactaccttagaatcctgtagctaccttcgcatttgtgtgccttccgtttataaataaagggaataaagggaagtttagaaaatgttgctgtatttacatgttcattcattctaggtatagaaacagaaacttctctcatcacagtttttactcatctccaagttaaatgacattcatctgttctgagagttcttccccactcctttccctaccccttgggaaaaaaaattgactggttttggtggctcacacctgtaaccccagcactttgggaagccgaggcaagagggtcacttgaatccaggcatttgagaccaacctgggcaacataatgagaccccacctttacc

SEQ ID NO: 213251 - DNA, 123 bp, Homo sapiens
taaaaggaaaaacacatatttaaaatttagtgccttttcctgtaataagggaaaaaacttgccaatttttaaatgcttttaaccatctctacaggtccaaacttaagttagttctttaacatg

SEQ ID NO: 213252 - DNA, 418 bp, Homo sapiens
agtctgctaaaatgttccaagaaggctttagtgaggataaatgtggttggtaccatccaccctgcctcttttggctttaaatacaggtaagaagtgagaaaaatgaactcctagtgtttagggccctgtgagtctggtatgatactacttaaagccaaaccggtcctatgtaataaagccaggcagtggtgtaagcactttacaaatattaacacaactagaattatttggggtctatggataatttaagataccatttggcagaatcttatcaaaccactgataaattgtattctatctgctataggattctaccgttccagtggtctaacactgactcagtcttcacaagcttttaagcaaaactaattacaagaaacagaataattaactcacagcctttattctttatcctatg

SEQ ID NO: 213253 - DNA, 352 bp, Homo sapiens
ttgatattttaccagataatcaaaccataaattaataatgggtagcatatctagaaaaagacatattttctacatttaaaaaataggtatactgtttatcaaaattttaaatttgtatttgtttttaaaagggcctactgtttatgtgtcaaacacttcagagtaaagtatttgctttcatacatttcctgaattaggttctataacataaccttctcccaaattctatttctttctgcaccttttattgacctgccgccttaccttgttccctgattttgagtatggcaaacggtctgtggagcctgctgaggtgggctgtattaataaactgtcagaaaatgtagccctt

SEQ ID NO: 213254 - DNA, 447 bp, Homo sapiens
gacgatgccagctggccatcgcaggatcaggtgattcctttggagcaggccagagattctatgtgatatttgttctgcactttcttagaagtcctggaaattctgtgaaattgtgtattcccctggcttttcttcttctccctccatcttctctcctcagagttctgctaccacctagagttttgtatgccatttcctggctcttctgagcagggatgattaatctttttcttcatttttgagcctgcctattctcattgatctccaggggcttggagtggtctctagcaaagaatcaatagctgatggctgcagagatgttgattcacacaccaagggtattttacttaaaaagaaaataggtgaatgcagaacctccctgttttcagatccttcatgttgattggaaccttaaacattactggcacttcatatgttattttaatt

SEQ ID NO: 213255 - DNA, 208 bp, Homo sapiens
tcgcaccaagactccgtatcaaaaaaaaaaaaaagtcactgaataaataatagttcaaatagtaagcacatttgggaaaaaccatgatgttatctgaagattatgtatgggaaagatttttatataccgatgcctacactttggcagaactatttttttttattgtgcacatacttttcctcagtgttttttttttatttttgatttt

SEQ ID NO: 213256 - DNA, 357 bp, Homo sapiens
aactaggtgaaagacataggttggataagatgtgcatgttctgtagaagcagtgtctgagctggggatgctaagctctccaataaaatctgtaaggagttgtgagaagcacgaaaggacaggagaaggtgcttggcaagggcttgggtttggctgacatctacccttagcctgatcccatggggaggctgggagtgtggatggcatcacagagttgtcatcccttctgtcgaggagcccagacttctccactcagtaccagccagtcactggctgaggggctcccccaggggaaggcaaaatctcccaagtgtttcatggttaggagctccccctaccaaccccagggcaattatcg

SEQ ID NO: 213257 - DNA, 271 bp, Homo sapiens
cacacccagctgagattcttatcttggtaattttttgcacagagaactcagctctctatcatactacattttaatgagctacacggtgatttatgacttgtgctctttccttttctaatcagctcatcaacaccatacccattctatgtcagtttactttagaattgaaattttgccttttatataatgctgttaggtggcttgcattcgatttgggggataaatagattttgaatcagcttttgctgctcaacaaaccactccaaaactt

SEQ ID NO: 213258 - DNA, 323 bp, Homo sapiens
cacacccagctgagattcttatcttggtaattttttgcacagagaactcagctctctatcatactacattttaatgagctacacggtgatttatgacttgtgctctttccttttctaatcagctcatcaacaccatacccattctatgtcagtttactttagaattgaaattttgccttttatataatgctgttaggtggcttgcattcgatttgggggataaatagattttgaatcaccgtgtagctcattaaaatgtagtatgatagagagctgagttctctgtgcaaaataataccaagataagaatctcagctgggtgt

SEQ ID NO: 213259 - DNA, 695 bp, Homo sapiens
gcgtgcgctcccggttcagtcttgaaaggcgctagaggcccagcctgtccttggagccctctgctactccccaccttctggccggccctcgaggcggtggctcttccttctcgagcaggtgtccaaggtggaagcacagaccctgtctcttctgctgcgtctccggcagatgtgggtgaggggctcatgggtggtgccctcgaggcacgggagggacctgggtctgggcccccggcacctggggggctgtgttggcaaagcaggagggcacaggtgcccagctgctgatccttccccattcctgctcagatgtggacgaatgccgaacccacaacggtggctgccagcaccggtgcgtgaacaccccaggctcctacctctgtgagtgcaagcccggcttccggctccacactgacagcaggacctgcctggccattaactcctgcgccctgggcaatggcggctgccagcaccactgtgtccagctcacaatcactcggcatcgctgccagtgccggcccgggttccagctccaggaggacggcaggcattgtgtccgtgagtgctgccagcctgggagggaggacctgggggtggaggcaggacaagctgcctcgcctgggctgttgggtggaagtgggtcttcaggaggcccccaaggctgctgagaggcctggtagggatggcacatttgg

SEQ ID NO: 213260 - DNA, 414 bp, Homo sapiens
gccagagagccaggccctgtcaggcacgcacatggaggatgagggaggtgcagttgttttcacaggtgcagactctagagggaccccacgtggactctgtggcttctgccccgacgcactcgcgggaggacacagctctgcccggaagggagagtgctgagctgggtccctgctgctcatctctgtggcatcaccctgtcagtccttccctgtcacacatatgttccgcaagacctgccgtcaaatatttgctcagtcaaacatttgttgaatgggatgagccatggaggttcagacagatgccgtgacctgaagtgtcaaatgaagggatgcgtgtgtgatggccttcaccatttatattgttttaaacttgctaagcactagttaaaataaaaaagccaacacttttcttta

SEQ ID NO: 213261 - DNA, 258 bp, Homo sapiens
agagatcctcctgcctcagcctcctgaatagctaggactacaggtgcatgctaccacacgcagctagctttttaattgccgcacaattttttgtctgaaaatattcacaggattcccagagaacagacttagatagctgttgaggaggatagaaatgaatgcactgaataattacaaatgggaatagaagggcccggtggagcagcgcatgctcagctggaagagattatgggaggttgttaaatttgctgcttcagg

SEQ ID NO: 213262 - DNA, 251 bp, Homo sapiens
ctgagagccgagttgtagcctcctgctggactacaggtgcatgctaccacacgcagctagctttttaattgccgcacaattttttgtctgaaaatattcacaggattcccagagaacagacttagatagctgttgaggaggatagaaatgaatgcactgaataattacaaatgggaatagaagggcccggtggagcagcgcatgctcagctggaagagattatgggaggttgttaaatttgctgcttcagg

SEQ ID NO: 213263 - DNA, 153 bp, Homo sapiens
tatgaggtcagatatcaggcatttactattgtatatgccagtgactagaatagtcctgtatgtttcaggaattcaacatatgaaccagtaaatgaatgaataatgaatgagtctgtttatccagttaaatgttgcacatctgccaggtctcag

SEQ ID NO: 213264 - DNA, 293 bp, Homo sapiens
aggatcactgaagtccagatgttcgaggctgcagtgagctgtgattgtgccactgcactgtagcctaggtgacagggtaagaccctgtctcaggaaaaaaaaaaaaaaaagccaagaaaggaaaataaagagggctgtgacagtattctgggcaagagatgatgacagcacggactaaggtgttagcagtagaggttgctggaatttgcgtatgaggtgcctgggtgggaaagacaaaggtgatccctagcagtggtcagtatggagttggcagctaattcgtgattgttgat

SEQ ID NO: 213265 - DNA, 254 bp, Homo sapiens
tttttgaggtgagctgaatgagaccctttgctagagctggcacagggaggaaggtcgtcctggagggagggtagacactgtggagggaagggagacctgtgtcaggagagctgagaccacctctctgcccctcactactcttgtaatctttaggagtgtaaataatccccctaaggtggggacaggaccccagtccctgctgtgcgcaatagattatgatgatcaaaataaataatcagtgaatgtggatggga

SEQ ID NO: 213266 - DNA, 745 bp, Homo sapiens
tcaagaagccaacttagaaagaagggtctcacgtggctggcctggctcctccgtagacccctgttcttttcaacctctgcccacccgtgcatgtcatcaccaacatttgctcttaagttacaagagaccacatccacccagggattagggttcaagtagcagctgctaacccttgcaccagcccttgtgggactcccaacacaagacaaaactcaggatgcttcttgacgtcaagaagctcctgagttcaagcaattctcttgcctcagcctcccaagtagctgggattacaggcacacaccaccacgcccagctaatttttgtatttttagtagaggtgggatttcactatgttggccaggctggtcttgaactcctgacctcaggtgagccactgtgcccagccaagagttgtcttttttaatgctctaatttaatcaagtgcataggtaataaattctgtaaaagtaaatctgctctttttatatatacctatagcttcctgcaacaagtagctcctggccataggagcatgcccaactcaggtgagacaggctggtgttgagttcacagctctaggaggagccctcagtgatatgtaagagttggtagataaatatggcagcttcctcaagtaggacaactttcaagcacattctgtttagtcttccggagcccaatacccacagctgtaacctgctcataaacgtacctctaaggcttccttcccttctgtcgtcttctc

SEQ ID NO: 213267 - DNA, 330 bp, Homo sapiens
gaggaaacagattagttaatgcttttccatttgccctccaacttcaaaaattttgttgctattttctcttcacttgttctttttgtctttttggatttgttcaataccttctttattcctttactgtcttttcagtgggatcttgggagggagcagaggtaaatgtggatgtatgatattatttttaaactgaaaatctctagttgtaactatacttacattgttaaacatttagtagtctgtccttaggaatgttggctataagtatatatagaacttaaaaaaataatagatttctgtaatatagtatgtaagaacagtggggacgca

SEQ ID NO: 213268 - DNA, 396 bp, Homo sapiens
atgaggtttttttggtttgcttacattgcagaattgtaagcaaaatgttgaacattgtataactcttcttggtgtagatataggttcattgcttaacattttgaggtgataatccatatatatatatatatatatgttttgagacaatttgtctttgagacatgagtcagcttcaagttcctgtgtataggtgtgtaaatttgggttagatatttaatgtctgtaagactcggttttgtcatctgtaaaatgaacataataataagtctcagttttcatgtctgtacaatgagcaacttctaaaagtgttataataattaaataagctaatacatataaaattcttagatatgcctgtcaaaacctaagaataaagcacatgttcacttttctgtg

SEQ ID NO: 213269 - DNA, 614 bp, Homo sapiens
tgtttgtttgttgttaagacaaaggtcttcccctgttgctcaggctggagtgcaatagcatgcttatagttcactaaagccttcatcttctgggctcaagtgatcttcccacctcaatctccaaagtagttgggcctacaagcactcgccaacttacttggctatttttatttttagtggagacaagttctcaccaggttgcccaggctggtctcaaactcctgaactcaagcgatcctctcacctaggcctcccaaagtgctgggattacaggtgttagctactgtgaccggccgaaggcatagtatctttattagatgaccctagtgttagaatttgggagtttgaaaatggctaaagcaagattttgtgtgcttagtattttccagtttactggtcatttaaattttctttacaatggagttcgcccattgagtgatatttcaatttggaagagtataaaggatattgtttgtggtaggtgaagcaaattactcaaagtgaaaggttaatattattttccttgttgatgcttgatcaccagaattatagtttgaggaaggaagcttaccaaaatatttgaaaaatgttgtgcatgtattttgtaagaccca

SEQ ID NO: 213270 - DNA, 102 bp, Homo sapiens
tacaggaaatttaaccgtttgggggctgaaccaggcttctttacataaattaatgttttcttggcaggtaaatgaatgagcccttcaaattcggacgtaacc

SEQ ID NO: 213271 - DNA, 483 bp, Homo sapiens
tcttcaaataactgaatagtataatattggaaataacggagccttattctcttctccaaagtgcagaactaaaaccaatagaaattacaaggcagtatttttaagctcagaaaatcctctaacatttagagttgttctgaaataaatgaaattaggtatttgggggaagtaatgtcatttgaagacagcctgcctgagaggtttgttgaaagctcttctatattaggaaacattaaaactggctgtgtaacccaagaaagctccatctcagtgttctttgcacctgtcttttagcatttaccacgtattttttttttagttatttgtgtatataccattcttatctctcccaataagcaacaacaaaacctggctcccaatgctagatacagacccatgcaaaagaacacagggcagtaaccttccttaaatttgtacattccgctttgttctacttctagcataacctcctgcatagctggg

SEQ ID NO: 213272 - DNA, 649 bp, Homo sapiens
  misc_feature (503)..(503): n is a, c, g, or t
  misc_feature (545)..(545): n is a, c, g, or t
tatgatacataaaagaatggataaacaaacggtggcacatccatataatggatgctactcagcattaaacacaaggatccaacagttgacatgcaacacgtgaatgaatttcaaatgatttacgctaaatggaagaagcctgcctacagtataatttcacttacatgacattctggaaaaggcaaaattaaagggttggaggttggggcagagagggaatttgggggacgatagacctgtatgactgtgacggtggatctgtgactccatgcctttatgaaaccacagaactgaccaccaaaatgaattttactgtatgtaaattttatttatttttttgagacagtctcgctctgttgcccaggctggagtacagtggtgtgatttctgctcactgcagcctctacctcccaagctcaagcaatcctcccacctcagcctcctaaatagctgggactacaggcacacaccacccataagttgcccagctaacttatttattnttgtagagatggtgtcttgctatattgcctaggctggtctcnaacttcgggattccagcaatcctcccaccttggcgtcactaaagtgcatggaattacaggcatggccaccatgcccagtacaaacatctgtgcctggcctgggc

SEQ ID NO: 213273 - DNA, 449 bp, Homo sapiens
tagtcttcagcttagttatctcttctttcttacttgactcattagaatttgtttaaactgttataaaattttacagcttttcaaaaatgcaattaatcagatttgaaaaaaatccatttccatctattaaaaaatatatacacatgttaatatgtgtacacattctttattagaagtaagttgtatctgtgcccagcaattgaaaagtgtgttttctcttgccatgcagtttttgtactgtacatccatgttgcatttttaaggaagtaatattgcctgtgctaggctctgctacaggaagtaaatgatctttgtgtcagtgaaaatagaaggttctatcccatattgatctcttagcacttaaactagtgtgctatgcctcagttgcctaaaataggcagcttaagaattttgtaatttaaaaactcaaaaccccatagtatctgcag

SEQ ID NO: 213274 - DNA, 918 bp, Homo sapiens
gagtttattttctaaatgtccacattctggagtagaggcttacatatttacaatatgtaagataattttttaatggtttgcatggacagatgacttttcctgaaagataaaattccaattctctaaataacagcaaaagaaagcattaaggagtgttctgttagacagattaatgaaattatgttcttaaacactgctcctcacacaccatattgcatttatcagtctagtttctaagggaccacatgactctcttatggctacttttctttcttaacttgaagttgtttacacccgtgcctcttctgctctttatttttcttctttcttctactctgaattaacttaagtttctggccactattcttcaaacctgaggtttattttccagatgtttgagacattattttcacatttctaatgcttccacccattctttaaagaagtattaggggaccatgtgtccatactttgtgtgtgtgtgtgtgtgtgtgtttgtgtgtgtgtagagagagagagagactgagaagtgaatctagtattcaatggagcaatcagtcagaagacaattggtagctcagtatagctgcagattcttacatacaggcatgtgagagagccctcattgcactgagccttggtcattaggagccaaccttagccgaagtagataaaattgcacatagccaaagtacataaaactgcacttcaagaagctttctttgaaaagtcagtagctaacctgaaaactaagggattccccattttctctgaatatatggggattttgcagcccttccttctgtgaatttcagcttaattctaggcagcaattcggaatttgcctggggtactaaccagaaaagagaaggaaatacacacacacacacacacacacacacagagagagagagagag

SEQ ID NO: 213275 - DNA, 408 bp, Homo sapiens
tggggacctgctgggaatccctttccccactgactgacaagaaacccaaaggtgcttgaagacatgatggttttccctgctgaagaggagtggctgccaccacagtatacacctccgcagggctgacctctggggagagggtccttccaggcacatccgtaaagcgacacacctgtcaatctgcctgagttttcatggtcttgtggtgtgcttctgaaggatcatgaaagaaagggcatgcgcgattttagataattgtttcaacacggggcttggtagaaaacaaaactcataactggaactgtgttttatgcatgaggcagctctggggccctgccagctcatggcttgcctaggccatacgtcctcaaacgcaccagcctcaggacatgaggaatcctgagccct

SEQ ID NO: 213276 - DNA, 1348 bp, Homo sapiens
ggggaatcacagatttgaatttgaaagtaatcttaaatgttacctggtacagactcccaccccactcagcccccttttccaggtttcctagcactttgctttttctattagcatatttagattttttctcttgagggggttggtctgttttgtgttttgttaggatggactttctgtttgtagatgtttctgtttgtggtttagttttaatgagagaagcataattggcagtagttaatgtgactataagttatttggcagatggtaccatcagcatttattaaaactaattgtatttttctagtaagcagtcttatgtcccagttgttaaaaattagtaaagttagaagtaaatgttaaagttacacagtagttctaaaaataaaacattaccctgcaatctttgaaagaaaactgtagcagaaatgtaaatctaaaaataaatgttacatcactggctttttaaaataaattcctttgaggttagattaaatatataagtaaaacgattttaaataaatagaagactagtcaagttctaaacaaatggtttcttaagaaaaatttgttttctttgcatgttagctctttgacatgcaaaatatctagctacttcccttgtttattttagacatttggatctgtgagtggcccccaagtttcctaatttgtctgtttatttactctgtctatagtacatgttgtcttcagtatcaatctccatttcatagttctggagttttaatatttatgaaggactgtgtgtattgagttcttgaaatatgttaacttttgaaaggctttgttgacttacaaaatgttaaaacttaaatattgttgctctcaaaatattatagtattggtttcttaattctgaaaatttaaactgcctgagtagctcttctccctacaagtttcagtataaactcattcaatataaagtctgcttgcttttatattatgcattccaaaataaaaatgatgaaatattagtatcagttacacaaatgtaactactcacatttgaaccattttattgtacaattcaactttcaattatgataatcagtctcttgctgaactttttagatctagatgagaattataaatttttgttattttatatgtgttatatgtgtttatatatgttttatattgtgttatttcacaaatcatcacaaaagggcaatttcaaagattcttttgagaggacagcttaaagcttaatccttaaggcttgactttcttctattaaatgagattgatacctaaaatcatggtataaattattaattgaattccacccaagttctgttgttttgttctttctcacagtcattccaaatta

SEQ ID NO: 213277 - DNA, 500 bp, Homo sapiens
aaatccaaaatctgaaacacttctggtcccaagcatttcagataagggatactccacctttataaactttttaaaaaatggcatcatcatagattacatctagattggcatatatatacctgttttctctgggaatttggatttccattattacatgtgaactcgagttcttttcactttggggctcttgttgacttactttagaagtccaagtagaacttttgaaagatggcctttcacacatatgtaaggtcttttcaggactgttagaagaccaaatctcttcctttcttttttcccctgttgtttcttttgggtttgatataaatattttcctcaggaaaaaaaatgtattgctgcaatttgagtaattacttcttttaaaaatttttcatatttgaaattctctttcagattagtttgcatttttttgtgtgtatgactactgagttctggtaaataaagggaatcttctatattataattgagtatgtaatatt

SEQ ID NO: 213278 - DNA, 843 bp, Homo sapiens
gaaaaagagaaaaaaaaactgcttgaagagggcagcgaatgcacctgcagcattaccgggaggactgcagaactttctttgctttaaaacataaaacaaacaaaaatgctcccggatgtaaatagtaagagtgtcaagttcttataaaaatagatttcaccctagctacatataggtttgtttgtatatttgatttttctacactgcatggttcctgggctggagaaccacaggggagcaaataaacaggggtgggtgggaagctagggaaacaaccgttttcctctttaggtgtgtgtaactctcacagattttatttaaattgctttcatttattttttctttaaaaatgctgtttgttcttgttttgtttgttttaatttttttctttcctggtcaagtttctaatacaaaacatgagcattaaagcttatgttgtaccaaaagaaaatgtgctttaccacggaccacggagaaagttgaccacaaagtttgacaaaactactggaaaacccaataagtctgggtgaatgacccttcatgacaaatgccatatatggtacatgatagaaggaattttgttttgtcccattggcagccctcactgtgtaggatgcctgagagagccatgaagatctccgaatgagaagaccagcagaatcattctcatgtggactaaggctataagagagatatgaccatgggctcaatgaatgaaactgccaagctgacaaatttctaaacacaagataatgtgtaacattgctttttaaattaattatcaattagcttttgtgtagtttttatcaataaaagaaaaaatattgaaaaataaatatatta

SEQ ID NO: 213279 - DNA, 1195 bp, Homo sapiens
ccagtgcttctgaatttgaaagtcttcatgcaaatgcccaggttgctggcagctgtgtctcagaaaaagctgtcttcagcaaggcagaagcagaccagggtggtccagagttggtgactattatggcatggctacccagggccagagaggtgaggtttaatgagaaagaagatagatgaaaatgactcctcctcctgctttcactgctgcagcaactcaggcctgcagacaagatccagctctattgcccaagctggagtgcagtggtgagataatgattcactgcagccttgatctcctgggctcaagcagttctcctgcctcagcctcctgagtagctgggaccacaggcaccctccaccatgtctggccaaaattttttgaattttttgtagagaccaggtttcaccatgttgcccaggctgatttcaaattcctgggctcaagtgatcttcctgcctcagcctctcaaagtgctgagattacaagtgtgagccaccacacccagccaaaatataaatacgcctttaatagtaacacctaattacctaacaccatcaaaaatggggtgctccatgaagaagcacataattcaaattattgaagtttatcccttctaatgaccacatagatttctcttgccccattaaaaaattagataatcagtatttctaggatagttgttttcttccaaccaattaaggcataatctatgtagcagaacattcagaggatgatgcctggtcaacatttgaataaacaatcactgtgatgttacctctatttaagatgactccaataaaacttctatggtttgcattattagttgatcagactttaagcattatcttttgatagggtcaaggaacctgtcttaactccccatctctgaccaaaatatacttgttttctataagctataaagccagatagccaattttatgagaattgtccctatactatatccatgtgagcgatgagtgcctggcatgaagatgcataaaggaggcagtaatatacaacaactgaagcataacctctggagccagtcttcttcagacaaatcccaattccattactcactggccacctaaacaagctacttaattcatctgcctcagttttcttcaactgtttaatgggtatgatcaacaaaccaacttcagtgggttatcataaatattaataaatgaga

SEQ ID NO: 213280 - DNA, 994 bp, Homo sapiens
gaaactctgtctctactaaaaatacaaaaatcagccaggtgtgatggaacatgcctataatcctagctacttgggaagcggaggcttaggcaggagaatcgcttgaacccgggaggcagagtttgcagtgagctgagatggtaccactacactccagcctgggggacagagcgagactctgtctcaaaaaaaaaaaaaaaaaaaacctcaattgcattaggcccgatggagccacacaccaccagcagtgccagcagtgccagcagtgccagcagtgcaagaggcaggccgcagggcctagatgtgcacaatcacctcagatcactgtgtccttcattttctttatagagctccctcacttccttttgaaacactgaggccagcaggtttcccagcagggggccccgtgtcagcaaaggacatttgaccccagttttctagatatcctcaagacctctcagcttaggttacaactgacaagaagctaatatttgttttatattgattaatattgcatgtgtccctcatctttcctccctacctcaagtatattctgcttcaggtgtttatctgagtggctgctaaggctctcctcctcctgtacaaacgtgcccagctgaggcaggaggcaggagacaagaacctaaggccaatttgcgctgccttcctagaactgaatcaaaacgaaaaccccacctctccacgcccaagtaaggaaaggatcagaagctactccctttgcaaccccccctttccactgcctcacagatgaaaaatggaaagtacctctgattggtcccctcccacaaccaatctgactggtcgtggggcaggtttcatttacatagggtgtaaccaagtaaccaatgggaaacctctagagcatatttaaaccccagaaaattctgtaaccagggctcttgctgcttgctcgagcctactcccactctgtggagtgtacttttgtttcaataaatctgtacttctgttttgc

SEQ ID NO: 213281 - DNA, 437 bp, Homo sapiens
gtatctttatggtgttctctgtatttcctgaatttgaatgttggcctgtcttgctagtttagggaagatctcctggataatatcctgaagagtgttttctaacttggttccattctccccaacactttcaggtacaccaacctaataaaaatgtgaaagaaaaataaaccttgcccatttctaaaggcatttgtaaatacaaactactgtcactgacaaaccttggcatggtaaagacacataatttccaaatctgctacattccagtgggtaaatgaataatcaggagttatgagtggctccccagtgggaagaaaatttttgggattactgaccacaaaaagaaaaatttcaaaatttccagtatttgttactttaggttgctttccatctctgggaaatctactcttaccagaactagagaccgtttccaagga

SEQ ID NO: 213282 - DNA, 313 bp, Homo sapiens
aagtcaaagtaggcaccttctttgaaggtttgcttacttggtttcctcatctacaaaactgagttaataatagttctctatgtcactattcagtaagtaaaaccaatattgtaaaaattatcttgcattttagatgctatgtcagatattttttcatgtcatgcaatgtaataattttgaggtaaatggcttagtggattgaagtgttcgctggaaactttatgccatatgttttactaatcaacacatttattcgctaaaaaactattttcaaagagaggcaaatagtttgaaataaatctgacctgcattt

SEQ ID NO: 213283 - DNA, 373 bp, Homo sapiens
gcacgcgcctataatgccagctactgaggaggctgaggcaggagaattgcttgaacccgggaggcagaggttgcagtgagctgagattgtgccactgccctccagtctgggcgacagagcaagactctgtctcaaaaacaaacaaacaaccttttttttcaccattcactactaaaatcccattcaatgctatatcactgacctggtctactgcagtagccttgttactggcttgcttattcattgcctctttagcaatattgtccctgatgactcaagtcccactctatcacacttttctattttccttacagcccttactgctttctgaaatagtcttgtttttgttggtaacagagttctttagtgatga

SEQ ID NO: 213284 - DNA, 870 bp, Homo sapiens
gctgacttacaggacttccagggatgtgtgatctgcaactatgtgagagtgtgtgtttatgaggggttctatggtgatttcaataaccagctatcaccactgtcactttcttctctgttctgttatttccatgcacaatgaaaacttctcagttataaaaatgaattggaagatgaaatggttggaaacacataattcctcgtctccttctcatcagatgactgaaagctttgtgctggtcacaggatttggaagactctaactcccctcctatgaaaattctgatttttgagagagttcttggtagctaaatcttcttgggctaccacagtgtcagagcatactggaactggtgtgaggaacctaaagcctggcagatggagctcttcgcaattgacatcccctctctgccaagcccatcttgtgctctagtcacagtgcattagtagctggtcccaaccacatcaacacactttcacacctccagacatttgctcatgctgttgcctctgcctctgttttccctacttgaccaaaatcttttctttcagtgcccaaatgaaccctcttttgtaactgtccttccaatctctgatgtagaatggatggcccccattctgggcttctagagcaattgttaatacttttcacccggcactctggttggtaatttccctttctgcctgctcactagactgctggctttgtgaagatagggactgtatctgtggtgttctgctaagctggctctcctgatttgtagcacttacctatttccatggtataaatactctccaataccatcgccaatttcaagctatcagtgtgaagtcactgaacacagaattaggaagagatgcacacaacaag

SEQ ID NO: 213285 - DNA, 1583 bp, Homo sapiens
cggcaggagcacttgaggccaggagttcaagaccagcctgggcaatatagcacgaccctgtgtccaacaacaacaacaacgacaacacaaacaaacagaaaactaaagacatgcttattgacgtttcaatttcccaatctcagccccaatagacactttaaagctgttactcagggcagtgtattcggggtgatgaggccatgcccgcttcctctcttccaggaaagctctggttcgtcctcacgatgctgctgcggatgctggtgattgtcttggcggggcgacccgtctaccaggacgagcaggagaggtttgtctgcaacacgctgcagccgggatgcgccaatgtttgctacgacgtcttctcccccgtgtctcacctgcggttctggctgatccagggcgtgtgcgtcctcctcccctccgccgtcttcagcgtctatgtcctgcaccgaggagccacgctcgccgcgctgggcccccgccgctgccccgacccccgggagccggcctccgggcagagacgctgcccgcggccattcggggagcgcggcggcctccaggtgcccgacttttcggccggctacatcatccacctcctcctccggaccctgctggaggcagccttcggggccttgcactactttctctttggattcctggccccgaagaagttcccttgcacgcgccctccgtgcacgggcgtggtggactgctacgtgtcgcggcccacagagaagtccctgctgatgctgttcctctgggcggtcagcgcgctgtcttttctgctgggcctcgccgacctggtctgcagcctgcggcggcggatgcgcaggaggccgggaccccccacaagcccctccatccggaagcagagcggagcctcaggccacgcggagggacgccggactgacgaggagggtgggcgggaggaagagggggcaccggcgcccccgggtgcacgcgccggaggggagggggctggcagccccaggcgtacatccagggtgtcagggcacacgaagattccggatgaggatgagagtgaggtgacatcctccgccagcgaaaagctgggcagacagccccggggcaggccccaccgagaggccgcccaggaccccaggggctcaggatccgaggagcagccctcagcagcccccagccgcctggccgcgcccccttcctgcagcagcctgcagccccctgacccgcctgccagctccagtggtgctccccacctgagagccaggaagtctgagtgggtgtgaaaaaaacagcacctggcggtgccccggggctcacgcctgtaatcccaacactttgggaggcccaggcaggaggatcgtttgagaatatatctccttgcccaagagtttgagaccagcctggacaacataatgagaccctcgtctctacaaaatatctaaaaattagctgggcacagtggctccctcctgtagtcccagctacttgggaggctgagatgggaggaccatttgagcctgggagatcgaggctgcagtgagccaagatcacggcactgcgctgcagcctgggcaacacagtgagaccctgtcaaa

SEQ ID NO: 213286 - DNA, 1425 bp, Homo sapiens
  misc_feature (63)..(63): n is a, c, g, or t
atggaaggcgtggacttgctagggtttctcatcatcacattaaactgcaacgtgaccatggtnggaaagctctggttcgtcctcacgatgctgctgcggatgctggtgattgtcttggcggggcgacccgtctaccaggacgagcaggagaggtttgtctgcaacacgctgcagccgggatgcgccaatgtttgctacgacgtcttctcccccgtgtctcacctgcggttctggctgatccagggcgtgtgcgtcctcctcccctccgccgtcttcagcgtctatgtcctgcaccgaggagccacgctcgccgcgctgggcccccgccgctgccccgacccccgggagccggcctccgggcagagacgctgcccgcggccattcggggagcgcggcggcctccaggtgcccgacttttcggccggctacatcatccacctcctcctccggaccctgctggaggcagccttcggggccttgcactactttctctttggattcctggccccgaagaagttcccttgcacgcgccctccgtgcacgggcgtggtggactgctacgtgtcgcggcccacagagaagtccctgctgatgctgttcctctgggcggtcagcgcgctgtcttttctgctgggcctcgccgacctggtctgcagcctgcggcggcggatgcgcaggaggccgggaccccccacaagcccctccatccggaagcagagcggagcctcaggccacgcggagggacgccggactgacgaggagggtgggcgggaggaagagggggcaccggcgcccccgggtgcacgcgccggaggggagggggctggcagccccaggcgtacatccagggtgtcagggcacacgaagattccggatgaggatgagagtgaggtgacatcctccgccagcgaaaagctgggcagacagccccggggcaggccccaccgagaggccgcccaggaccccaggggctcaggatccgaggagcagccctcagcagcccccagccgcctggccgcgcccccttcctgcagcagcctgcagccccctgacccgcctgccagctccagtggtgctccccacctgagagccaggaagtctgagtgggtgtgaaaaaaacagcacctggcggtgccccggggctcacgcctgtaatcccaacactttgggaggcccaggcaggaggatcgtttgagaatatatctccttgcccaagagtttgagaccagcctggacaacataatgagaccctcgtctctacaaaatatctaaaaattagctgggcacagtggctccctcctgtagtcccagctacttgggaggctgagatgggaggaccatttgagcctgggagatcgaggctgcagtgagccaagatcacggcactgcgctgcagcctgggcaacacagtgagaccctgtcaaa

SEQ ID NO: 213287 - DNA, 256 bp, Homo sapiens
cggctcctacggtttagtccgaattagcccatcattgccgatatgtgctacttatcagcaagatgatggattatcaatcactgtattttcaactagagcagcttgtcaaaaaaattaaccaggtacgtttgttggctggtggcatgtatgcagagtcacagaaggtgaggagagtggcacctgcacatttttgtaaatctcttaagtcttgctaactggaaaacagctgtattcacctatctgcttctacagtcaa

SEQ ID NO: 213288 - DNA, 809 bp, Homo sapiens
ttgttctgttgaggtatcatgatagccacaaaaaacatctaggcctacaactaattaccttgcaaatggtaaatcactgtgggtttgaaattgtatgtaatatgaccattcttattacatagttaatcactaggtgtaagggcttttctattcattaatgttggaaataacagactgtgctgcccataagagactgagttggattatagagagaagagagtaaaatgtgcacgtttcatttgatggtatttttaatacgataggtgctatagatatagtgattttgaaaatgatctttcccatatgactattagtaagatttctttgttaatagaaaatgtatatttagaattttgttaagagtataagagctggactctgatggcttgggtttatatcctggccatttccaaagtgtaatttggcgaatatatttaatccctctgtaactcaggttcctcatttcacaatgggcatactaatagtacctatattatacaatattttagatggttattgggaggattaactgagtttcatgtaaagcagttaaaacagcatgtagtgcttggtaaagttagctgctattagctaatactgtgacacgtaaaattcaaattattaatgattcgggtgcctaaatgaaacttttttttccttagctcctttttcttctccgagatgttaatttcctgaggtgctagctagattaccctagcttgggtacttactcttgaaggggccccaattttgttgtggacacctttcaatggcacaaccgtgccaaccatgtacaggggccacctttg

SEQ ID NO: 213289 - DNA, 357 bp, Homo sapiens
aaggaaggcagttttggagtgtctcagttcccaggcttaacttttcctttggcatagtgagtagaatgtctagaaggaagtgttatccaggtacagaacatcgctcccctgacatactgcagacgtctctagtggcccagaatattcgtgtttcttcttggacagtgtcgtataaataccgtttaattttcatcatccaatgcccttttaaaaatcaaatatgagaagtagtttactcatgccagctgtatcacacatcacacagccattgaaactagaaatttctactcattagtctttttttttttgagacagggtcttgttccaccacccaaactggagtgcagtggtgcaatc

SEQ ID NO: 213290 - DNA, 287 bp, Homo sapiens
  misc_feature (1)..(1): n is a, c, g, or t
  misc_feature (16)..(16): n is a, c, g, or t
nttttttgctgcctgnggtcactctagaggatccccgtcagcgccctgggagggggcccgttggtgtttgctgtgtgaaaagatgaattaatcctcccagggttcaaggaccagctaggagcaggattgccatggcttttttgtttttttttaacgtggagtctcactctgttgcccaggctggagtgctgtggcgcgatctctgctcaccgcaacctccacttcccaggttaaagtgattctcgagccttggtctcctgagtcgctgggatcgcagggcgctgact

SEQ ID NO: 213291 - DNA, 481 bp, Homo sapiens
tggttacagtacatggtacaataaaataatgtctgcatggttatcttctcactaaaaaaggactgaggttaataagctctttcctcccaacactcagattttctgaagtgctcaataatgatgctttgaaaaggactaaattcatttattactaactgtttgctatcatataaaatattgtttctaacatcagaatccttcaaggacaataaaaatgatttttttcttgaatgaatatattcaacctagacgtctcttattctgaatgagaactttgttgagcaggctacatcactattgtatttagtttgcaacctttaatgtcattcatatacaattacatgggttatgaaaattcagaaataataatttctaatgttgttaggtatgaatgtgaacatatcaagtttttctttaaatgcagattgttgtatacaagtcatttttgattaaaatacagataaaacatatttctcaagtc

SEQ ID NO: 213292 - DNA, 760 bp, Homo sapiens
gtgagctgcaaggccagagggatagagttaatcatgttacataattattgacaaggatatgtttttttcccccgagagggcatttatgtcttttatctgaagccaaaatatgtcaaaaccttttattaccattttacaaacttggctatttcccactgtctcctgcaaatacctttccagcctgggcaacagagaacttgtttccaaaaaaaaggcaaagtgtagctacgcgtaatgggaatacggtagttcccccttatccacagtttcactttctatggtcaactgtagtccaaaaataggtaagtgcagtacaataagattttgagagggagagagacaatgctcacataacttattacagtgtattataattattctatttttgtaaatttcttactgcgcctagtttatagattaagctttatcataggtatatgtgtatcaaacatatgccctgtggatgaaggggcgactaccataccagaaggagaagagagaatagaagagtgagagattaaagtcagagtatgggtaactagaaactttactctaaaggagatcagaaaaatgaggatgtacttagggggcaaatgaggacaccggttttaaactgttctgatgcaaggagtggtccgaaggcaatggggctagtgaaatcggagtgcccaaaacccacagagaaaacgccatctcaaacaccgaaacgaacatcacgaaacacacgagacccgctgcgcacacgccctccaccacgccc

SEQ ID NO: 213293 - DNA, 356 bp, Homo sapiens
aggggtgggatgattgctaatagggaagacggggtttcttttgggtaatgaaagtggtctaaattctgatcatggcaatggccatacaactttgtgaatatactaaaaaatcaataaattggacacacttcactatattattattattttttttgagatggagtcttactctgttgcccaggctggagtgcagaggcaagatcttggctcactgcaacctccgccttccaggttcaagcgattctcctgcttgagcctcccaagtagctgggattacaggtgtgcaccaccatacccgactaacttttgtatttttagtagagacagggttttgccatgttggccaggttggtctc

SEQ ID NO: 213294 - DNA, 645 bp, Homo sapiens
ctggtctcagactcctgacctcaagtgatgtgcctcagcctcccaaagtgctgggattactagtgtgagccactttatccagcccacttttctcccattttttgtctctgttataatttttctaataagatcttatatgtaccagctaatctctagcaaggctatgccattagaatgtttgtgttagagccaggaaatgtgggtgaaacttgctttgccaccttagtcaagctaatataattcagaacatctgaaatagttttgcatgaaatgatatatttaataaattctaaattcccatgttttattatttaattgaaataaggctaggcatggtgggcatggttgctgatatctgtaataccagcgctttgggaggctgaggcaggaggatcatttgagtgcaggagttcaagatcagcaagcgtgggcaacatagtgagaccccgtctctagaaaaaatgtaaaaattagcctggcgtggtggcatgtgcttgtcatcccatctactcgagaggctgaggtgggaggatcacttgaggtgaggaggtcaaggctgcagtaagccgtgattgcacttttgcactccagcctgggcaacagaatgagactctgtctcaaaaaaaaaaaaaaaagaaataaatc

SEQ ID NO: 213295 - DNA, 953 bp, Homo sapiens
  misc_feature (550)..(550): n is a, c, g, or t
  misc_feature (640)..(640): n is a, c, g, or t
  misc_feature (880)..(880): n is a, c, g, or t
  misc_feature (886)..(886): n is a, c, g, or t
  misc_feature (943)..(943): n is a, c, g, or t
cgcaccgccccgcgacgcagcccggcgcaactactttcttctctctcctttctttcttcctctcctttttcccctgctgggtagtggctgcggcggggtgggggagactttgaatgaccgagctcgcgtccacctttctcttcatgtcgacgtccctggaaacggccacacggatgccatggttacttttgccacgatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcgcggagagcccgccaagtcagcattccagccggtgattgcaatggacaccgaactgctgcgacaacagagacgctacaactcaccgcgggtcctgctgagcgacagcaccccnttggagcccccgcccttgtatctcatggaggattacgtgggcagccccgtggtggcgaacagaacatcacggcggaaacggtacgcgganataaagagtcaccgaggggagtactcggtatgtgacagtgagagtctgtgggtgaccgacaagtcatcggccatcgacattcggggacaccaggtcacggtgctgggggagatcaaacgggcaactctcccgtcaaacaatatttttatgaaacgcgatgtaaggaagcaggccggtcaaaaacggttgcaggggtattgatgataacactggaactctcagtgcaaaacatcccaaacntacgtncgagcactgacttcagagaacaataaactcgtgggctggcggtggatacggataganacgcctgtgt

SEQ ID NO: 213296 - DNA, 678 bp, Homo sapiens
ccatttccccttcgagattatgtccagaggcgcaggtcatctttccaggctccattccccttgttctgctttcatattctcctgagcttgacctggttcagtttctccctggagaggctcactattttttctggggttgagatcctcgtcattcttttgacaagagatacagaatcatcatttttaagaggaagtttatcagcaggctgtttttaaaagtgagttttgtgcttgatacaaatttttatgatgtttgctttctcttaagcactcgaggtctgtacggtcagccttctttgcctcatttgctccccttcctcccctgcctcccatcttatttgactgctaacctgggcgggcccaccattcattcttgtttgagacagatgaacacagtactttgtatgccttatgaccagataattcaagctgacagtaatcaagtttggggctaattatcattaaaaggtaatttcattgctgcccataattgatcttatcttaaaccaattgtagcatttcttttgtcacatgatttaaaaatttaaaaaaaaatgcttttggcaataaacttttgaaaacagattttctacactcagttctttttaaaaccaactttacaaactttaagtgtgctcttattaatgtgatttgtctgctttgtaatattgcatattc

SEQ ID NO: 213297 - DNA, 352 bp, Homo sapiens
agcctggacaaaagccagaccttgtctcaaaggaaaggataagaggaggtatttgtgaaagagttgtagttaacggcaagttgaaagccctttggttaggagtttgttttacattgagcaaagactagtgcatagtgaggcagagggtgagtggcatcagatgaaggtgagcaagtgggtaaaatgccagatcacaatttagtcgtaaatgatatgacactgagattttattggaagtgtaacaagccatttaatgagtttaagtgtggaagtgctctgtggcttctgtaaggagaatggactggcaggctgcagaatgtgtaaatagaaagactagttgggctattctagt

SEQ ID NO: 213298 - DNA, 838 bp, Homo sapiens
agacggagtctcactctgtcacctaggctggagtgtgcaatggcacgatctcggctcactgcaacctccgccacccaggttcgggcgattctcccgcctcagcctccggagtagctgggattacaggtgcatgccaccacgcccacctaatttttgtatttttagtagagacgaggtttcaccatgttggtcaggctggtctcaaactcctgacctcatgatctgcctgcctcggcctcccaaagtgctgggattacaagcgtgaaccactgcgcccggccagagtcctgtccctctaaggtgccaagtgcccctgcctctggacagaacagggcagggtgtgaagaagcaaagggaggaagacaaccctcaccaaccacccccaccctgggacacagcatcctgtgctgacccctccgggtccagggcttcgccgtagtccatggtcagcatcaaggtccaggcagggggctgagcttactgacactgagagtgatgatgggctggagacatcagcactcaatccaagctggaaccccatcacccctgtctggtcccatcagtttctgggtcagcaaggacattctaagatggttcaaggccccaccccacagcatagcaaatatattgaaacatacatcccacagaaatagatataatttttcacttgtaaaatttttgcaagaatttttacaattttgcttttgaaattatgtggctctgagaaaccatttagtttgcatttggctatgatttatcagtcatcatggtgtattcttgggaattctggcaaaataaaatggaactggaagtttttcaaatgtaattaaattcttat

SEQ ID NO: 213299 - DNA, 482 bp, Homo sapiens
agattaggaggaatgaaatataagctctgcaacttgccagagacatttgagtggacatttcaactctggggtgcctaggccctgccaacttagatggcctcttctgcctttgctaagggaaggatgccaggctgctcaaacagacctgcctgtgatcagcacctcttccccagtgtgggccttggtgacagggaaagtggtgagtgaggaggtgctcacctctgtacacacccaggaaaagaaaaggaacctgagcatagaaattttccttaagccagacccacttaattttccagccaagcactaacaataaaggagcttggaaacatatctcttccaagagaaaatctgtcctggcctccactgtgggtgtggtatggtggctgttaccagcactaatggaatatctagggaaacacatttctttgtttgtttttttaaaatattaaatatgttagacagaagcatcccatcctttctgt

SEQ ID NO: 213300 - DNA, 164 bp, Homo sapiens
tagggaaggaggaccccagggagggagatcccaggaagggaagatcacagggagtgagggaggacctcagggagggaggactccagggagggaatatcccagggagagaggactacagggagcaagggaggactccaggaagggaagatcctagggaaggagga

SEQ ID NO: 213301 - DNA, 475 bp, Homo sapiens
ttcataggcccagcatgctttgaacggcatgctttgaggtgatcctcctgcctcagcctcccaagtagctgggactacaggcatattccaccactttcctggctcaaggaatcctcctgcctcagcctcctgggtagctgggaggacaagtgtgtgtcaccacacctggacaactgggggtgtatttgtatcttatgggatggatatttggtgatttgttatgagcaaattgatacccttctgtttgtggagattctcttgaatccttttttccatacactccattttcttctgtttggaactcatgtttacttatggagtggtcctcaaatttttaaaagtttatattttgcatctttttctcttttccctctatttttgggagatttaaatttctttttttttctttttgaggagtctcactccagcctgagcaacagagcaagattctatcacccccaccccccaccccgca

SEQ ID NO: 213302 - DNA, 558 bp, Homo sapiens
tccactgctgaatatatacacaaaagaagtgatagcagtatcaaagagatatctgtacatctgtgtttatagcagcattattcacagtagttaaaatgtggaagcagaccaagtgactattggtggatgactgaataagcaaaatgtggtaaacacatacaatggcatattattcagccttaaataggaaggaaattttgatatatggtataacatggatgaatcttgaggacattatgttaagtgaaatgagacaataacaaaaaggcaaatactgtattattccacctatatgaggtacttagagtagtcaaatggtggttgcctggggctgagcagagggaagaatgggagttattgcttaatgaatacagttttgcaagatggaaagacttctggagatgggtagtggtgatggtagcacaacaatatgattgtacttaatgccactctactgtacacttaaaaatgattaagatagtaaattttatgttatgtatgttttaccacaattaaaaattgtggtaaataaataataaagtttttttaaatgttaaa

SEQ ID NO: 213303 - DNA, 1049 bp, Homo sapiens
gaaattaacaattttggctttattatatttgaaaatatcgtaaaaatttatacatgaaaacaaagccttctattgcttaatacttccacatgttactcctatatgaatggaacaaaaactgggacagtagaaattgtttatgaatgccaaagggcaagctaaccatgacaaattattcacccttggattcaaggtaaaattattttacaacttctatgatgtagtttatagagcatgggtttttgagtctggcagacctgcttttacatttcagctctttagctatgcatctttgagcttgtcactgaggtcttctcacctgttacgtagggttttccagagactaaatgagataatgtaggaataattcctggcacagagttaatactcagtaaatgtcctcccagctcccacatcccagctcaaagtggggagtaagattttctcagtgtaagaatgtcaggccattgcaaaggacaacaagctacttccttatcatccaaagcactttccagtgttttacgtgcaataaaccacagacctctggaaccctgccctgttgtctcctcccacacacttcatagatattttcctatgcatctcttgtatccttggggtttaggacaagtgagagaaatagttgtctcagggaatagaaaaacttacagtgaaggaaggagatggaaattaacaagtgtcatcatcatcatcatcagaaaaagattttataaaacataagttgtgaataacatgcttcctacatgaaatgtcaaaataatagaaaaatgctatcatgcagttttctaaggtaaaagaccaaaggaaaacctactgaggcagaacattcagcaggtatttcctttgtatcgattttgtgcgataattatcactatggaaggctttatagtgggtgccgctctggaacgaaccggttttgcacttactcactttttcctgttataccgggaatttcctaaaccttcccctataatacaccgagatccggacggggatcggcctaccgaggggaggcgcctccccgcctcttg

SEQ ID NO: 213304 - DNA, 164 bp, Homo sapiens
cagttgggaatttgagactaaagagaaggtgtgaaatgcagtttcaatgatagagtaacagttaaagccttgagataaaaaagttggcacgtgcatctacgtacacacacagatatacccctatgttcaaggcctggatagggactccttcctttcatcgatcg

SEQ ID NO: 213305 - DNA, 501 bp, Homo sapiens
gtttttctctttgggaagaagaggcaacaagcacttcctatgggcattctatatgtgagactggtgatgacacacttcaacatgatatcccggccagagagccccatgcaaccctgccagagaggtattattaatcctactattaataattaattaacaattaataattaatcctactattaatcctacttcatcctatagatgaagaaactagaggctcaggccgggcgtggtggctcacgactataatcccagcactttggggggccaaggcaggtggatcacctagatcaggaattcaagaccagcctcgccaatatggtgaaaccccatctctactaaaaatacaaaatttagctaggtgtggtggcaggcacctgtaatcccagctattcgggaggctgaggcaggagaatcacttgaacccaggaggcggagggtgcagtgagctgagatcatgcaattgcactccaggctgggtgacaaaagcaagactatctc

SEQ ID NO: 213306 - DNA, 469 bp, Homo sapiens
tacagcctagttttgtaaataacaatttattggaaaaagccacactcatttatttacatagtacctgtggctgcttttgtgttccaacagcagaactgagtcgttgccacagaacttgtataacctgcctaaaatattcactgtctaggcctttacaggaaagtttgcagacccctgagctagattatctgaatactttaaatccttatatatgccccaacaaatccctgaaagcctgcccccagaaattccatttcaccaaataccccggccttataagttgtcaacactgagaaacattgacaagaaacatgaagaacccccttctatggagatttgtaagaagagttctcagttgggcatggagaaggggtcatccagcagagaagcaggaagtggactttttcacctcctagccctctgtgtgagctgagaccggatgatggagggatgatgtggaaggttatga

SEQ ID NO: 213307 - DNA, 496 bp, Homo sapiens
tgatttgcaggcagccattttctccttgtatcttcaatggcagagaggaagggagggaaaaagaaagagaaggctcccctgtcccttcctataagaacattaatcccattcataaggttgtcacctccccaagacctaatcacctctctaacatcatcacattggggtttaggatttcaacatatgaacttagagggacacacgtattcagttcacagcgtacctagtccctgaagacaagaactacagagtgaagggactgaatgacatccttcttactggagaaacattgccctgtcctaccctaaaaccttctattcacagcctttgtgtgagcatgagaggattttcgttatcacacctttgtgttgtttttatgaactaagggtctcatcaaaatttttcccatataggctctgctgtccattacttaaggaatgtttaatgtttttcaaaattgtctaatttccttaataaaatatttgcatatacagta

SEQ ID NO: 213308 - DNA, 448 bp, Homo sapiens
gctggagtgctgtggcacgatcttggctcactatagcctctgcctcccgggttcaagtgattctcctgcctcagcctcccaagtagctgggattacaggcattaacccttgcacctggccggaagttttaaactgttatatgatctgtcaaaatgctttcctctacggtttataaaggttctccccactccaagattatgtaaatagccacccatattttctttgacacatttaatcattaatccatttggagtgtgtatgataaataatttttgcaaaaaagaataacagcccattgtttttgtttttctatgtcaacatgtcaggtttcataattatcctttacaatggctccataattaattgccgataccccatttttggtaactagatgaaatatttgagaaagccacgctacaagtggattaagtagaggactgctaaatac

SEQ ID NO: 213309 - DNA, 392 bp, Homo sapiens
aattcctttcttgtcattgtaattaccttacataggcatgaaactttccaaacctatctaacatcaactttacatattcataatattttttacgtacagccttaacatttggtctgagacaactttttagacaatttagacaatttttcaaactacttttttgaggaagcagagtattatatggcagctacagaatgataaaggatgactggagagttttctcttcagaaaaaagaacaaacttttcttcatgtgaaaggtaaacagagagagagaagttcagcagcataattaataagatggttctgcaatgtctaataacttctcctttttgtttgcctctgtacacaataaaagtgttaaagtataattttcaaaaaaatgtaacatca

SEQ ID NO: 213310 - DNA, 917 bp, Homo sapiens
aagggagattatccagacccccaggagcgaacagcaagcagcaaccgaaggcgcaagtgccaggattacagcctaggctgctccaactatgagcccttcctcggaccctgggactcggctacttggggtttgggggtcttccacaccacagaggcacaaagctgactttaatcactttttttcctttaaacttgattctgccgcagtggagccagcacagcggatgttttcacacccagcaagacaaaggccgtcgtctccgccatgacactgttccgttccaagcagaggccgggattctggactcctcgaaaaatcaaaaagaaacaaggaaaacaaacaacaaatacagcaacaaacagaaaaaactgaaaaccaccaaaatcgtttgcccgtttgcccgtgccaggggtgatctgggcatctgttgcagcagaaggcgcttgtgtggggctaatttttcttttggtgggggggacaagctgttggcttgtttgctatttcaacttcgtttataattaacttaaaaaaaaccccaccattcagcctagtcaacaacaaacaaagaaaaagcagacatcggaagagaaatgccataggaagcggcatgaatacatgccacagccggtgccacttgccactcggaaaacctcagggaaagatgccaattctacagctgcgaagaaggcagagaaaggaggataaaggtctacaactagaaatcataaggaaagaatactgcttgtataatcctggattgcaattgcacacagcctctgctgggagaagagagggaatatttaaatggagatatagatgggtataaattaaaagataggcacctatcgattgcgtataaacacatgtgtaaggttgtatgtgtatataaatatgcatattttcagacaaacgtttag

SEQ ID NO: 213311 - DNA, 283 bp, Homo sapiens
gatgaaacccagagagaccgtggtgtgtagactgcaggaaacctcccatctgaagagttaattttctttcagaatctgtgttagaggctgctgagattaaaacacgacactttaagattggtacaggaacacttataactgttgacgataaaaagaaaacccaggaggtcagactcagccttgggagttactttggtttgagcctcataagacctttattttgaattttcctcttctttgattatgcatgctttctgctttaataaaaagaattcattaaatt

SEQ ID NO: 213312 - DNA, 510 bp, Homo sapiens
ctaggggagaactggaaccagttcttcctcacatccctcagaatgaaacaagtcttctgacaccttgatctcggacttcttgcctccagaactatgggacaatatactgtttaaaccattctgttggtggtaccttgttaaagcagtgctagcaaaggtcaatgttgctggtagaagtggcaagtggacaataccaagataaataagtaatcctagaggcccaatgtcctgaggcaggatccattctcctcagacttacaggagggaaaccaggagctgaacttttgcctctcctggtagagatgatatggtgaagccattcatatttactagatgcagtagaatgaatggagcatattaaaaatatctaaatagatatagtaaatatctcaaaggagtagtcaagggaatttgtaataaaggccagaacaagcacttgcaaagaataaccaacttgaaaattaggatgtgagaagtctataatggaaacagtggactcttatcaaacca

SEQ ID NO: 213313 - DNA, 402 bp, Homo sapiens
acattaaaataatttttgtatctgttcttaacatagagatggaggaagtgcaatgacaattttattcacatttattcaggagatgtagaaaccttgattagttctataagtaaattatggttgtgccataattcttatggttattaaatggcagtaatttaaagggggcctttgttctttaatccagagaaatatcctggcttttgactcataactttgaggtaatatgattgcttgtagtcaccacattgtaagttccctaaaggatataagctctgtgtcttgaaggttttaggtactagtgcctagcacagaatgtggcaccttttatatttgttgagtgaatggctgttatcttacataaatgttatttccaggcttttaataaagtggttaaaagca

SEQ ID NO: 213314 - DNA, 956 bp, Homo sapiens
attgctttgaatctgtagataaacttgaaaataattgacatcttaatattgggtcttgtgatccatgaacatggcataagttcttatgccatgtttgtgtagctttttaaataacgttttgtagtgttcaatgtgtaggtcttacgtatcttttgtcagatgtatccctaagtatttcaattttttttttttttttttgaggcagagtttcactcttgttgcccaggctggagtgcaatggcacgatctctgctcatggcaaactccgcctcctgggttcaagtgattctcctgcctcagcctcccgagtagctgggattacaggcatgtgccaccacacccggctaatttttgtatttttagtagagacagagtttctccatgttggtcaggctagtttcgaactcccaaccttaggtgatccactctgcctcggcctcccaaagtgctgggattacaggcatgagccaccgtgtccggctgtatttcattttttattgctattacaaatggcactatatgtaatttctgtttctgattgtttagtgctgtatagaaatacaattgaattttgtgtattgatcttatatgctcttgtaaactcccatctagtaggttttttaagatatcagattttctacatatgtgatcatataatgctaactattacagacaattttactttatcccttccaatttgaatttttttttgttgtttctttcttattttgctgggtggaacttttagtatagtgttgaacagaaagaagtgttaagagagagtggatatccttacctcatttctcttcattgaagggaacagaagggcaagcatacaaacttttgactgttcccttctattcctatttattgaggtttttgttttgtttctgtttttcaaatcaggaatgggttgatttttgtcagatagtttttctgcatccacatcatgcact

SEQ ID NO: 213315 - DNA, 516 bp, Homo sapiens
cttcaagtcaagaagctgtctcactttgggttatgtagagtccacaaaaaagtcaaactaaatatagtgagtctaaaggcagtattagcatctttgtcaaatagagaagaagcaaatgaacatttctaagttggtcaatagtccttacagaggctaagaaagttaaatgtatttaatccagaaatatctataatttttataaaatacttaaaaaattcttgatatatttaacaacatgtctattacacattttaaaatttgctatcatccttgcacctcccctaaacctgcttctccccagtgtaccatctcagtccttggcacagccatccatctctagtggttcggaccaactgaatcatctgggaaccatcctggattgcttcttcccttattgtcctcatccttggttctcttttgcattaagccacctctcaggacctccaaagctagcatagaacaaagtactactactagtcttcctgctttcattcttgccactctatattctcatct

SEQ ID NO: 213316 - DNA, 199 bp, Homo sapiens
agtggggcaaaatgtaaacaataattaagacaaattataattcgctctctgatcttggtagtggggaaaaaacgagtattctctaaatgttttataatatgaaataatcaagtattttatatacataaataacatacaaattcactctgattaaaaaccattaattcattcaacaaatatttactgaacattgatgata

SEQ ID NO: 213317 - DNA, 1454 bp, Homo sapiens
acatgattaaatccgtaaattcatccatggttgtgtatgattgtaaatggttcgttctcattgctatgtagactttcatcatgtgaatattccacaatttctttctttcttccactcttcctggacatttgggtactttccagtttggggcagttatgaatagtgctgctgtgaacattcctgtacatgaattttggtgtacatatgtgtgcacttacattggtgtgtatacctagaagggaggcagttttgaataattcagtttagcatgttggacacaatgatttaaatgatgtctccaagcacgtatcagtccctgaaggggtaataatctctgaggctgatggcagaggcagtcaggggatctctctgtgttactgagcttgtggtggtgtgtttttgtatcttcggggctgaaggagtgattctggcagggtgagtgtgggttccccaaagctatcaccacattcttgccccagctggatcgttgccatctactgaggcctggctggccctccattacctcgctgtggctctctctgtggttttgcattgagtctgtggtttgcacacatcttgatgaccccatggtttttacctgccgggccatcataggacagtgctctctgatgaaatgctggccatttgtggcacagagaagtaggtgtcaacaagaacacctagcagtgagacaagtcttcaccaagactccaaaatgaaaggttcagccttgtgggcagtttgtgaggagaggaaagagagcaagtcaagaaatgaggctcttaccccagtccctttacagggcgaatgtggagcccggcagctgtggaccagtttgtctccatcatttgcaggtcagaggttaccctcagctcctcagctgcaaatggaagccctctatcaaacggcctttgccagaatacttaggctgtgaccttccccctatgcagctcatttgcctgggtaaatgagtagagtgctttctgcgtggcagatttaaatttcaccactaattgatgctagcgtcttcaggggaaaatgcttgccattagatcacaggcctttgggagacagcctcataacaaatacatccaggacagggggcggggatggggaaagtacagaatgcagctgtaccgaaaggaactgtgggacgtgcccagagaaaccaactgagtacttttgaggcatgcccttggggactgcgcatgtgcatggttgtgccatgtgtgttttgatggcctttttttttcttgctagtgtatagtatgtacaggacaaacttggagccaaactgtctggaatcaaatcccagctctgctgcttacaagcaaatatttaacttctccattgttagtttccttgaccataaaatggggataatgatggtactttgagtcatgagatgattcagtatgttagagacctcataacagtacctggcaggttgtaag

SEQ ID NO: 213318 - DNA, 340 bp, Homo sapiens
aaccacactgagttttcctccactgccagcattggtgcttcagtactgtgaattttcttttaccattagcaaagctgtttcagctttttggcttgaaattttaagatcaaagtttaactttgaaggtgttaatgtatccctatcagaagcaaagatatttttttataatgtcctaatgcaaaaagattgttcgaatattgtctggcacactgcttactccaagtagctctcagtaaagaaagccaactttgttacatttgaaataaatgggttagtaaaaagtgtaaacattaccaaaaaatgaaaataacatatgaacaaataatctgttctccttttc

SEQ ID NO: 213319 - DNA, 193 bp, Homo sapiens
aggaagccccctgtttctatgggcttgtgttattgagtcaggctcctgcagataacctgcctacctgaaggtcatgtagtagtacaacatgatcatggtgtgataacctcatcagagccacaggttccaaggagtagggtgtaggaccttgaggggaggaggttcttctgtgggtagacttcccctggcatag

SEQ ID NO: 213320 - DNA, 217 bp, Homo sapiens
gtcaggtgatcttgagtatccctgtaatctccgagtgctcaatgaggcttgtgttattgagtcaggctcctgcagataacctgcctacctgaaggtcatgtagtagtacaacatgatcatggtgtgataacctcatcagagccacaggttccaaggagtagggtgtaggaccttgaggggaggaggttcttctgtgggtagacttcccctggcatag

SEQ ID NO: 213321 - DNA, 214 bp, Homo sapiens
tagaggaacgactgcagaggggcattctgggtcagtctggatatagtcctgtcatttctgtttacttgccattggttaaagcaatccgatggctacatctggttgcaaggaagaataagaaacatagtccagctgtgtgcccaggaggagaagagtgagttttaatgggtagctccagtctctgccacaattgtcgaaaggaagcagttgatgg

SEQ ID NO: 213322 - DNA, 247 bp, Homo sapiens
cgttttgatgtgagagaagtttgttttccttctcccaaatccttttatatttttttcatgacacgatgtggactttgaggtgccctctcaggcccgcaaggatatcctgtgaaccaaagtaacactctccgtttaaggagacccccgctgctttttcatgttatctttgaggcattctccatggagtctgaccatcattcttgttcagagacagctctgaggaatcctcggtctctcacacacactg

SEQ ID NO: 213323 - DNA, 497 bp, Homo sapiens
acagggaaaatctgcatccagctgctactgtttggcgctatctcaacacctgtgtaggatggttccacgagtggtgaggctgcaaattgagcttttctcttcaacccttcaactccttcctccactgaaaatgccatggcctccaatgtcacatgatggacttcttgtttttcactcctttttcagttgaatctcatgaattggcggtctgtctcaggcgttttcctgagggttagataatgagcagcggcgtgcattctgataacttagaatacaacattttgcctctgtgcctagtgtgggcatgtgatgagcccctgtgagactcagtgaaagaacatatagtaccttgcgtttcctcatgagccaagtgtggggccttattattcattaggaatttgagaaatctctttttatctgcttcaacaagcagaaatattttaaatcttctgtgtaagtgcaaggtattataagcttcatggtaggatatataggaa

SEQ ID NO: 213324 - DNA, 881 bp, Homo sapiens
gagcacatggcccaggggtggagccgacctccagacaccagaagaacaacctaagttcctcccacacagtcagacttgaaactagaggacagacagagaaccaggaatgtctactttgcccccatgaggaatagaaacaacttcctgactatcccttggtgggacaggaggactttcaagaggatgaaactctgaaaaagagtttaccctgtgattaattaaatgaaatcctcaatggccagagtaattatacaaagattaagtgtcaaatgggagagagtttacctggaagcagtaagattcgttgcttttattggttcatttgttttgttttctgctttcggtagaaatggatcttcacgagtcagttgaatttgattaaacagaatttagcatttcagccatttgggtgacagtgggtgcattctaaagtcagcacaccacccaaagtgatatatgaggtggaatgggaggggtggcaggtattcagcttaaaggaccgggatatcatgatcagtggctactgttttacttttaaaaaccttccttttctgggtctagaatatataaagaatgtctacaaatcaacaacaaaaaacatgaacagcctaattttttaaacaggcaaatgaattcagtaggtatctcacaggacaaatgaatgatcagtaagcactgaaaaggtgttcaatgtccccagtcatcaggacaacacaaattaaaattgcaataagataacatttcacgtccactaaaattgctaaggtgaaatacgatgaacattgacaagtgtgtggagacactggaactctttatcattgtggatgaagatgtgtctagcagtttcttatggcagtaaataaacatgcttctaccccatg

SEQ ID NO: 213325 - DNA, 153 bp, Homo sapiens
gctgtaagtttattcaatgcaaaagaatcctctccagttttactgaggtggctgaccacgtccacgaccaaatccgcctctaaactagaattcggttgctgacccagccccagcctcggctttcttgtcggcaccaggtagcacagcactcct

SEQ ID NO: 213326 - DNA, 394 bp, Homo sapiens
ccgcatactgacgacctggtttcactaaatcaacctgtgatctgctttgagaaagagtcattagaaagacactttatttcaacttctctaataatcatagatattagtcctctagtggctgagaggcagcgactagtttccactaaatacagttcaaaactctaagatctatatggtgggagaattgcagatggcatttcctgtattcatcacacatttctgtatttttaaaatgtttttattctagtatttacataaaatatatgacaggcaggaaagttaaaatcatttatagatagcagaaacattctgtaaacgttttaacatgtattatatatacatatataatatgtgtatatatacattataaatacatatatattaatcctctagc

SEQ ID NO: 213327 - DNA, 479 bp, Homo sapiens
ttatatttacaaacaatttacagtgttccctttcaagatggtgtttgtgtgtggtgcgaggtgagggtagaggttcaccctctcgcagtgtgatcccgaggtgttcagggctgtctgtcgaaggactgtcctttcctccctggattgccttggcacctttctgaaaagaatgggccctctatgcccgagtctgcttctggtctctgctctgtttcgttggtctctatgacttgccacggtgtccgaggacagcaccttgatgactgtaactctgtgctgagtcttggcactggtatgtgtgaatcctccagtgttctttttcaaaatggttttagttgttttaagccttttacatttccgttttcagaatcatctcgtgaacttctatcagaaaagctagcctggctgctgattgggactgttgtgataactgatgtggcgagaattgcgatcttaacattgagtgtttctgtgagctt

SEQ ID NO: 213328 - DNA, 394 bp, Homo sapiens
attacaggcgtgagccaccgcacccggccaatacatacaagttaacagcaaagcagcaaaaagctaaagatcaaaacaaacaacaaaagaacccacaaaaaacagtcagaacaaaatgaattgatagactgataggtgacttttcaatagcaataatgaaagccaaaagacagaggaataagagcttcagcatgttaaaagaaaacaattgccaacttttgtattcagcaaaaacatcattcaagaatggctgcaaaataaagacattttcaggtgaacaaaaactgagtgttcatcatcaatagatcttcaataaaagccattccaaaaactgtactttttaaaggagacagggtcttgctctgtcacccaggaaggtgtgcagtggcatgat

SEQ ID NO: 213329 - DNA, 145 bp, Homo sapiens
tttttttttttgtagagaggtttcgccatgttgcccagtctggcctccagctcctgggctcaagtgatccacccaccttggctcaaaccaccacacccaaccctgagggagattctaatcttccccacccttctgtcgtcttctc

SEQ ID NO: 213330 - DNA, 271 bp, Homo sapiens
ttgaacccgagaggtggaggtttcagtgagccgagattgtgctattgtactccagcctgggtgacagagggagactctgtctccaaaaaaaaaaaaaaaaaaaaaggtagagctgagtggctgagtgggtattatgctcaggttgtcctgatctcaaaaaaagaaaagtttttttttttgtttgtttgtttttttttgagacaggcttgctctgtcacccaggctggagagcagtggtgccatcatagctcactgcagcctcaacctccca

SEQ ID NO: 213331 - DNA, 510 bp, Homo sapiens
tttgacagctgtgtgtggccagtggatactgtacaggacagggcctatggaggacatttccatcattccagaaagttctatgggacaatactgatctagaaaaataatctacaaagtctctcccagtctgcatcagtggctgccatgacaactagttttcttacaaaaggcaagccctatcagtttcaagtaggcaggttccatagactgatgtaaatttggggctgaaaggagctggtcatcttttctaggattatcaaccacgcggggctcccaccaaaacatatttcaccttaagtccatggcagacattgctaatcaactgcagcactccctcctagggaaccttcagagtctttcttgacacaatgctgcaggtagccgaaactaatccagattagcacttgatattgaatctgtaatctgacctattgcaatcacaaagagtgggaaactgaggcccagtgaaataaagtaaattgcctgaagtcagatgatgagtcaaggcca

SEQ ID NO: 213332 - DNA, 821 bp, Homo sapiens
aaaatagcactggcttgaatgtttggagtgtggattctgctgaacgaggatgggcaggtcaggcagaggctgttgccatggttattatgagatggcaccttggggtagtcagaaaagggagcaaagtaaaagatctgaaatatgtcggaggcacttgctgatggataccatataaggcgggatgaagaaaaagagaatcaaggataatttctagatccaaatttgaacaaatgatgagtggtggtagtgttaagtaaaatggggagaatgagagagcaagtaggtttagtttgtggtttagaaattggtagttcttttgggggcatattttaggtttgtgatatcaggtgtttgagtagatatattaaaaagataattataacagtctggcctttaggagaggggcagaggctagagataaacgtctgatggccattggtgcacagttcctatttaaataaggcacagggcagggtaagattacctaggaagaatgtatagataaagatccaggattgagctatgtgaggttctctaatatttaccagtcaatcagagtaagggtgacagaaatgaaatgaggagtagcactcctgaggtagaggaaagccaaaacgataaaatgtctcaaaagcaaagctctttccacgtagttaccaaggaatggaaacagagggataagaggccctgtacaagcaaacccaggagttgatattcacagccacatatagctaggagtttcaccaacttctggccaatcaaaggtggccaactgttcaaaccgtgttcaagtaagcaaacatcaagctgtaaccggtgca

SEQ ID NO: 213333 - DNA, 467 bp, Homo sapiens
tcatgcctcttcccaaaggagttgggttgcacaggatgttcagactttacaaacccaaagcactgaatccctgggggaggaatttcagaccagtggggaggtattttgaggtaagggacaggcgcatatcataaagtgggagtaggtggggtttccacagaatcaatggccctcttggcattgaccattaggattcaggtgcagccagtttggcctcaggactttgtgactcctgtgacggttgcaggtcagatcataggtcctggggatgctttgattcagatctgcctactggaagcaaatctcctcagatctttgggaaacaaaactgatcaggcttggcctgggcgccgtggctcacctgtaataccagcactttgagaggccgaagcaggcagatcacctgaggtcaggagttcgagaccagcctggccaacgtggcgaaaccccgtctctactaaaaatac

SEQ ID NO: 213334 - DNA, 111 bp, Homo sapiens
tggttcttcaaaaagataaagaaaattaataaactgctagactaaccaagaagacagaacacccaaataagtaaaatcagaaatgaaaaggagacactgcaactgatacta

SEQ ID NO: 213335 - DNA, 433 bp, Homo sapiens
tatggacatcccctcaaaattcacatgttcaacctaactcccaatgcaatcgtattaagaggtggggccttgaggaggttgtcatgagggtcctgttctatgagtaggattagcatcctaataaaagaggtcgagctggccatggtggctggcgcctataatcccagctagtcaggaggctgaggtgggaagatgttgagcccaggagtcggaggaaaaaaaaaaaaaaaaaaaaaaaatttgggtttgggggtcttgggggttttatttatataagggttttatttttgggcccggaagttttttaaaggggttttggctttaaaattggacaaagtgtgggggggggaaaccattttttccttggaaggggggggtaagcaattttgtgctagggggtatggaattgggaactttttctctcttaaattgg

SEQ ID NO: 213336 - DNA, 159 bp, Homo sapiens
tactttgcatggtcatactgaacttctcaaaaaaataaaaataaactagctgcaagaacaaaactaacaaagaaatattcagaaattccattttttgaaagatattttagtagcaataaagttcatatatttcagtgtgtaagtaatatctagcttgtg

SEQ ID NO: 213337 - DNA, 493 bp, Homo sapiens
ttcctggttccatggactgcatcctgcacttaccactcccccatattccctaccatgccttcttcatctaatttaatattactaacaagatctattgttcaagccaaaacccaagtgtcactccttcaatttctctttaccttatcctccaaatttaatccattagcaagtcctctcttcaaacccatcccaaaccaaccttgtttttaaccatctccacaccaccaattaccacaaggataaaatctgaattccttaccaccaaatactatgtgatctggccctcatctatgaccttctcccattccttgagtaatctctgcctccacacataatttgcaaattactccagctacactggcctattattattattattattatttttgagacggagtcttgctctttcgcccagcctggagtgcagtggcgcaatctcagctcactgcaatctccgcctcctgggttcaagcgattctcctgccccagcctc

SEQ ID NO: 213338 - DNA, 405 bp, Homo sapiens
cagggaagaaggggagaggaggtcattagtgtgaccttgggtgtgttcagtctgagatgcctttgggacatccaaggggaaagtcactaagagggtgtggcagccagagtgtgggtgtcgtctgtgataagcaactgtgagcgtcttttcctgagcaagccacagggtccaggcagacatttacgtgtctgcatttcctacctgaggtgaacttcttagggtatgttcactttcccgtgaatctccaggcattagaacacagaaagtatgtaatgatattgtagtaaagtgcgcccaaactcatcaagggagccaattaagttatccccaagatcactgtttcccaacaccggcttgggaaccagtcaggcaaactacaggattctgtctatcttctccttcccc

SEQ ID NO: 213339 - DNA, 259 bp, Homo sapiens
ccagtccaattttctcatgatattatgtgagtaccactttcttcgtgtgtgtatttaaggttctgtgctgaaaagttgataacatagaacatacattgaaatgtaaattttctgaaggaggagaatggaaagttaatttaaggaaaaacctattgaagtgaaaaaactgaactttaataaaggacagagttttgctaagaattagaaagaaatgcattcattgcaaaatacgaattaaattctctaacctttgtagtag

SEQ ID NO: 213340 - DNA, 714 bp, Homo sapiens
taattttttgtattttttttagtagagacggggtttcaccgtgttagccaggatggtctcgatctcctgacctcgtgatccgcccgcctcggcctcccaaagtgctaggattataggcgtgagccaacacgcctggcggacttttcttaaaactgatgcaaaaataattcttatgtgtaagagattagatcattactggccttaatttctgaactcttggaaaaattaaacacctcacaataaatgaagcatcaaaacagtatttccctgtgttaccattgaacagtagcaagagcttactgctgcagttagaaaaaggattcatagaaacagtgaaaggtatagattgaccagctatctaaagtaattctatagcaaggattacagtgaagaaacatggagcaattagatgttttttctgttatatttactccagttgattgtttaagtctcataatcttatgtgccagatggaggagtattggctgaatagaccatcagtgggtacattttagttgattaaatagccaaaccatattggaggatggttctcttaggtctccagtgttttgtagagactaatttttaatcactgagtgatgaagccttgaagagatgcttacgaactttacagttagcataaagccaggggggtgtttcaaccattatggatgttaaactaaggattattaaagatcagaccaggcacagtgg

SEQ ID NO: 213341 - DNA, 406 bp, Homo sapiens
ttgatgtgttcactaaccccacccagaagctctttgaaacccccttccagtcattgacaggtgttttggagacctcattagacaggtatgattgatgacatcatcagccattgaggattaagtcgatctccagcccctctcccctccctggaggttggggttggggagcagggggactgaagttctaaccctcctctggcaaccagcccccatcctccaagagtcacctcattagcgtaaactcagatgtagttactaataatggtttggatatttgtcccctccaaatctcatattgaactttgaccccagtgttgggactggagcctggttggggggtgtttgggtcatgggggtggatgcctcatgaatgtcttggtgccgtccatgcagtaatgagtgagtt

SEQ ID NO: 213342 - DNA, 454 bp, Homo sapiens
attcatgtaatagcctagaaatcaaattatctgactataagaatgcttagatggagaaaacatttttcagcaaaaccattgtaatagtatattatgtttattgtaaggaaatagataattataagataattataataatagtattttaaatgccagttaaggtttttgaaataaaattttgttaggagattataaatgaatgtaaattttcaagtaatataaataatttctgattattaagtaaaataaatccaacaggctaactgagcataatgctttatgagtatattttaattaaaatctggagaaattgatgaatggattgagagccactaggtcattgtcttgaaagaaagttgaatctgttcctcatactttacaccagaaattttctagatggatcagttgttgaaatgttaaaaacaaaactaagaaaaaaacaatggaagatttg

SEQ ID NO: 213343 - DNA, 363 bp, Homo sapiens
agcacttagcaacagtaagtacacaagtgttcgttccttgcctccttccacatgacaaccattggtattatcagtgtttgtcctttctttccatcccgagtgaattccattacctggacctggatcccatattctacaccacccaggtcccttcctaggaatgcccctccatttatcaggatccctctaaaaacacactgcttagaactgaacacagtatctcagatgctgtttaggcagtgcagaataattacctcctttgatctatatgatttctctatgaatgcaatttttatcagtcacttcacactgttagctacagttggtggtaaataaaaccctgtggggtaattttcatgtaaa

SEQ ID NO: 213344 - DNA, 447 bp, Homo sapiens
ggttcaagcaattctgcctcagcctcctgaatagctgggattacaggcgcacggcaccacgcttgactaattttttgtatttttcgtagaaacggggttagccaggctggtctcgaactcctgacctcaggtgatccacccgcctcagcctcccaaagtgctgggattacaggtgtgagccacggcgcctggccaagatgtgttttattatttgcacttgtgtaatggcaaagaaaataggttactaagcttgctcttgttagaatatcctttgtagtcactcatttgatgatgttgagtaagaatctttcctctgttaatacgtctttgtttaaaagaaaataagttacctttgtagtctttgtacatttttctttgcagaaagtttcccctctgctggataataattaattttataaaagtgtttaatccagtactgattatatt

SEQ ID NO: 213345 - DNA, 581 bp, Homo sapiens
tacgtcgccagaagtctttctggagtgcctcttgccacatcaatgcagactcatgatcatcatgaagccagttccttattactcaccacattaaatcttttctgggtagagatagggtctcactatgttgctcaggctggtctcaaactcctggactcaagctatccttctgccttggcctcccaaaatgctggaattacaggtgtgggacactgtgcccagccaccacatcaagtcataagctaaatcctgcatttctttcgtcatgatgtatgcatagcagttatataattaatcttaaaattaatctacataataacaacaatattaaggacaatattttccttgtaacttgatttactggaacacatatctttatccattagcctgaaaaatatccatttctgtatactacctaggttactcacttaaatccaagatttgagccaaaatatacgtctaattaatcacattgtgttatagctggttataggaaactggttcccagacaaattcccatacatgatctgcttaagtgaggataacagattgactcaggaatcaaaagcaatccatttttt

SEQ ID NO: 213346 - DNA, 347 bp, Homo sapiens
gggattaggacatcagcatagtttggggaaggacaaaattcactctgtaacacctccatatacagtcatgtaccacataatgttctggtccacagtgggccacgtatataacagcggtcccataagactataattccatatttttactgtaccttttgtacgtttagatacgttgagatacatacatacttactattatattgcagttgcctacatacagtattcagtacagtaacgtgctgtacaggtttgtagcctgagagcatatagcatagccttggtgtgtgataggctagaccctccaggtttgtgcaagtacatgctatgatgctcgcacaacaacgaaa

SEQ ID NO: 213347 - DNA, 430 bp, Homo sapiens
tatctcattttgtcatcatttaaaaaaagtgttcctggatgtccttttgcatagacttttgaatgtatttctgactattttcttaacctgtcctgtacttctgcaagtagaactgcttgagcagagattaggagcaattttaaggtttttcaaaaatcttgacaaactattctgcaggaaaaatgtatcttgttaccatcagcatttttaagtaactagtgactaattgtaaaaataattgtgtttccttgtatttaagccttgcgctatagattttaaaaatttgtccttttttttttttcatttgtaaaaaaaagccatctaaaagaccttagaacctggtatcagctgaagcttactaaaccatatcaagaagatcatgtcattctcaagaaaagcatgtttcaaataaaaaggaaatgtcagccct

SEQ ID NO: 213348 - DNA, 500 bp, Homo sapiens
ccttattttgaatgaaatcaacaccatggatattgggcgggggcaagttacctcttatttcagaaaaggatttctggggagaacccaccattatttctcttctcatcttcccactcttatctcctcttttcacatcaaagatccatcaaatctctgtggcaagcctggtaataagttttctatggtggttttaaattaatgggcattagtcaggcccagtgtctcagacctgtaatcccaccattttgggaaactaaggtgggagaatcacttgagggcaggactttgagaccagcctgggccacatagcaaaatcccatttctacaaaaaaatttaaagtttgactacaggtatgtgcagtgtcacgtgcctgtagtcacagctacttgggaggacgaggtagaaggatcacatgagcccaggaggtggaggttgcagtgagctgtgatcgtgccattgcactacagcttggatgaaacagagtgagaccctgtttcaa

SEQ ID NO: 213349 - DNA, 466 bp, Homo sapiens
cacagggctcaacttcagaaaggctggtaaattttaaagtagagcatcagtggtgcacaccacacaatggttagaaaagtggagtcagtgaagacgttgtgttaaaggagctgggtgccagccatacacagagtaggggggcatttatttccgtgtgtgtttatagatgtaaatgtatttttaaaatatctgcaagaaaacagcacactgacctcttgttaccgcatgaagttttcattaccttctttaagaaaaggacaattaaatatgaatacagagtcttggagcagcttgcataaatgagctactgaccctgaagcttcagcttctattagcttctttctgcctctgtgtgaccttggacaatttacttaacccatttgctttggctttgtcatctgtaaaatggggctaattatagtaatctacctcacagagtgattatgagacacagccgtcttggaac

SEQ ID NO: 213350 - DNA, 386 bp, Homo sapiens
gggcgtgggaagcagagaatattctgagcagaggcaacagcatgggtgaggaaggcccagtgacctgtgatctggcatgttcacgttggcacagcctacttggcggcagactggaggctgcaacagaggtgaaggtaccagggtgggaggcccctgggaggctggtgcaagagttcaggctggacactgtggagtcctaccctgggggctggaatgggaggggctgaacgtaactgagacgaataagaataatacctcttggccgggtggtgtggtagctcacgcctgtaatcccagcactttgggaggccgaggtgggcggatcatgaagtcaggagattgagaccatcctggtcaatatggtgaaaccccatctctactaaaaa

SEQ ID NO: 213351 - DNA, 636 bp, Homo sapiens
gggccagatggaatgaatgttatctggagtcagactcaaaagttctgcaaccctgggcagatttctcctttatacacctctgtatcaccacctgtaaaatcatacctgccttgtacggttgttatgagaattaaatgagttgatgtgcaaaatgctcagaaccatgcttggtctgtagtgagcacttagtacatttttaatactgcgtgctcagtttagcactgactcctaccttctttgcagttcctagtactcgcttagagtttaagtaccttggacaaggtacttggccacatcattcccaaagctggaattcagactcaaatctatttgattctgaagccagggcttttaattatgcagcactgtcttccaaataaccattaacttactgacacggctgtgatcctcaaacagctcatgacctggtaaggtaagagacgactccacacggccatctcattatgcatggtacatgaagggcagtgttcttgggctggcaagaaagaggaagctggttctgttcataaaatatttcttagagaaataggaaaatgagtctctttagctggatatatgaacatttttatgtgttttaagacaaacggcaaagcttggggcttatgaggcagaaag

SEQ ID NO: 213352 - DNA, 140 bp, Homo sapiens
gcgcccggcccggcgtgttttaatatgcaatcttcatagaattatttgcattttgaaatacgaatatctggagagagcattgttacttcaaaggtgttaataccttgaattttcaggattatgacacgtgagtaggatgg

SEQ ID NO: 213353 - DNA, 502 bp, Homo sapiens
ggacacactgggacctgcagtgaaacaaaggacatctgtagcaaagcctttcaactctagattgtcctctccatcctagaaatggaggaggaagtgatagctgaagttggttaattaaatgctctgatcttctgtaaaatacctagccagtgttcttcaagactctcaaggtcatggaaaccttggaaaaactgagaaacttccatctcagaccagaggacactaaggagaaataatgagtaaatgcaatttgatatcctggattggatcctggaacagaagaaagacattggaaaagcaggtgaaatccaaataaagtgtggactttagttaatagcgatgtaccaatattagtcctttggttttgactaatgtactatggttctgtaagatgttaacattaaggaaaatgggtgaaggacattcagaaactccgtaaactatatttgtaacttttttgtaaatctaaaattattccagaataaaacttattaaaaaaaaa

SEQ ID NO: 213354 - DNA, 515 bp, Homo sapiens
gatgtactcttaattaaaaaaaattgaagtcccatatactcctccaaatctagtcaacaagtaaatattttcaagctacttttaatttttgttttaaaagtaggagactagtgggtataaaatagtaaaagagcattagatatgaaacctatgagttcacaaatatatacttcactttccaaatgaatgagaattacgataaactgttaattcatccacacagagtggcactaccttatcatcagaacttcccgtatctggatatttggtcttgactgtttcactgcgatattcagctattgcaagaatattttcttcacctcttccactggttcaaaggggttcttactttggaggtcttctagaacaccatgcctcagtgctctctactgtatgtttttaataccctcatttttcaggacaaaggtatttggaaagcatttgtcgactgtttttccaataaacactcacataataattcactgggaaatattatatttatatgtttaatgctt

SEQ ID NO: 213355 - DNA, 550 bp, Homo sapiens
gctgggcatggtggcacacacttgtagtcctatttgggaggctgagacgagtggatcacttgaacccttgagtttgtggctgtggtgagttatgattacaccactgcactccagccagggtgaaagggtgaaacccccacctcttaaaaaaaaaatttgctctcatacctatatccatcatagcatctaagtacctctagtttcacatgattaactcagtataaatatttgatggggttctcatgaaatcaaaatactttctctaggattatcaagataggagaaagaaccattagaagaaagagaaaatgtcacaaatattaatatctgaaagaattgaaactcatcagtgatatccacaatatagaaattctaggaattgctagacatagtggtgtgtgcctgtattcccaccttgttgggagactgaggcaggaggattgcttgagtctgggagttaaggctgtgatgcactatgatcatgcttctgaatagccagtgcactccagcctgtgcaacatagcaagactctgtctctaaagggggaaaa

SEQ ID NO: 213356 - DNA, 431 bp, Homo sapiens
ccccacaacagtccccagagtgtgatattccccttcctgtgtccatgtgatctcattgttcaattcccacctatgagtgagaatatgcggtgtttcctcattttttatcatcagattcaacaaacacaaaattgcatttttataaatgcaatcagaaaataacaggaaaagagagaagagtctcaaaaaactgtacatgttgctcattgaaggtatgcgtggaggtgattaaaatttctgtgcttacctcattgcagaccaataaaaaatgggacatggatcacacttttagagacttttgctttaggaattagtttacatactactaatgatattaactttgtctccaaacttgttaagggtaagaaagcaagaaaattagtatcaacaactgggatttggatactatgtagaaagatgtgaaactaagg

SEQ ID NO: 213357 - DNA, 389 bp, Homo sapiens
acatcctatgtgggcaggaagctgtgtatgttaccgcccccatcccctgccatgtgttcccaggatctgtgcctggagaaatgacacatctgtaggttatgagtatacagaaccttatctagccttctcagtaccttttagagaagggaagtgttgtactcagtgttacccagctagaaagtggaaggtctagaatgaaacccacttgctatctgactccaaaggccgcactctttccatcccagcacgcagtagaggaatctagaaaggtattagtggcagcggagtgggaagccatcaggtggagtgagggagaaaggaggtaccaagttgtttcacacttgtgataatccactccctcggttatctgttgctttataacaaaaaaa

SEQ ID NO: 213358 - DNA, 1532 bp, Homo sapiens
cgctcagtccggcagcgcagcaggagggaggcgcgaggcaggagccggcggctgggctccgcagcgcagccagcgcagcgcggcgccccgggcccggccccatgcccgcagccccgccggaccgtccttgagcgcgggcgcctagcccgcgccccctgcccgccggcaccattgccccgacggcgcggccgggcggcccggcgctccccaggctccgcgcgggccgaaagacgctgctagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccggcacctactttttcacctaccatgtcctcatgcgcggcggcgacggcaccagtatgtgggcagacctctgcaagaatggccaggtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatctactccgactgagctccccacgtctccctccacccacgtccctcacccgccggggtcccctccgggcggggcagacgatgactcgcccctcgcccacccgctcgctgcccggccctccccggctatgacgcccccggcccgtgctcaacaccgcctgggccacagctaggccctcccaccggctcgctgcagagccgggcccagcgcgccctgtccccgtgccagggaaccggggttgaccgcccccgcccagcccgcgctatatatttgtacaataggactgtttactgcccacctccgcctgccagcccaccccagcctggggagaggtcgcggcggcgggtttgcttcctgcgctctgagatgagctgccctcggctccctccggggtggcgcgcccgggggaggggggagttgggggctggatagcttcccagcaccctcagagcccccgcccggctgtgccccgtctgaccaaagttataataaaaacattttcaccccgca

SEQ ID NO: 213359 - DNA, 1062 bp, Homo sapiens
cgctcagtccggcagcgcagcaggagggaggcgcgaggcaggagccggcggctgggctccgcagcgcagccagcgcagcgcggcgccccgggcccggccccatgcccgcagccccgccggaccgtccttgagcgcgggcgcctagcccgcgccccctgcccgccggcaccattgccccgacggcgcggccgggcggcccggcgctccccaggctccgcgcgggccgaaagacgctgctagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccgtgccagggaaccggggttgaccgcccccgcccagcccgcgctatatatttgtacaataggactgtttactgcccacctccgcctgccagcccaccccagcctggggagaggtcgcggcggcgggtttgcttcctgcgctctgagatgagctgccctcggctccctccggggtggcgcgcccgggggaggggggagttgggggctggatagcttcccagcaccctcagagcccccgcccggctgtgccccgtctgaccaaagttataataaaaacattttcaccccgca

SEQ ID NO: 213360 - DNA, 1637 bp, Homo sapiens
cgctcagtccggcagcgcagcaggagggaggcgcgaggcaggagccggcggctgggctccgcagcgcagccagcgcagcgcggcgccccgggcccggccccatgcccgcagccccgccggaccgtccttgagcgcgggcgcctagcccgcgccccctgcccgccggcaccattgccccgacggcgcggccgggcggcccggcgctccccaggctccgcgcgggccgaaagacgctgctagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccggcacctactttttcacctaccatgtcctcatgcgcggcggcgacggcaccagtatgtgggcagacctctgcaagaatggccaggtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatctactccgactgagctccccacgtctccctccacccacgtccctcacccgccggggtcccctccgggcggggcagacgatgactcgcccctcgcccacccgctcgctgcccggccctccccggctatgacgcccccggcccgtgctcaacaccgcctgggccacagctaggccctcccaccggctcgctgcagagccgggcccagcgcgccctgtccccgtgccagggaaccggggttgaccgcccccgcccagcccgcgctatatatttgtacaataggactgtttactgcccacctccgcctgccagcccaccccagcctggggagaggtcgcggcggcgggtttgcttcctgcgctctgagatgagctgccctcggctccctccggggtggcgcgcccgggggaggggggagttgggggctggatagcttcccagcaccctcagagcccccgcccggctgtgccccgtctgaccaaagttataataaaaacattttcaccccgcaaaaaaaaaacccaaggcaaaattaggtggaaacagcgagaaggccagggcaaacgtccggccagtccgccacagtgaatcgggcccaaagacgcaatgaacggac

SEQ ID NO: 213361 - DNA, 1239 bp, Homo sapiens
cgctcagtccggcagcgcagcaggagggaggcgcgaggcaggagccggcggctgggctccgcagcgcagccagcgcagcgcggcgccccgggcccggccccatgcccgcagccccgccggaccgtccttgagcgcgggcgcctagcccgcgccccctgcccgccggcaccattgccccgacggcgcggccgggcggcccggcgctccccaggctccgcgcgggccgaaagacgctgctagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccggcacctactttttcacctaccatgtcctcatgcgcggcggcgacggcaccagtatgtgggcagacctctgcaagaatggccaggtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatctactccgcctgccagcccaccccagcctggggagaggtcgcggcggcgggtttgcttcctgcgctctgagatgagctgccctcggctccctccggggtggcgcgcccgggggaggggggagttgggggctggatagcttcccagcaccctcagagcccccgcccggctgtgccccgtctgaccaaagttataataaaaacattttcaccccgca

SEQ ID NO: 213362 - DNA, 975 bp, Homo sapiens
acactcttcaccccgcccctcccttgcttagtcgctcggctggcccggctcaccttcggggtgaaggctaccagcgagcgttatagcagacgactttaataaatgcaggcggcagcaggaactctgggaacttgggtgcccttgcctggcagtaagggttgaattatccggatctgaaatactttacagagccgaggggtgataggctctgcaaaagcactttttgcccctctcctttatgccaatactcgctgactgtgcacacaagtcatattcagtattaaatacaaaccggtctgtaattcaatggctctagcaagacgcctctgagagggccaggtggcgggtgcaagttgctcattaaccctttagagtcgcagtttgcagatctgagttagatccccggctttgaggtccttcagttgccctcctcccccacctccccccgccactgcgagaaaaatgtgcaaagagaaggaaatttgcacatcaaacgaggggcaatcgcggcggtagatgaacttgattaggcagacgcgtgagatcaaagtggccgggaccaaagcggacagggtccaacgtgccagcactgccaagagaaggccttttgtactcaggttaaataagaacatcctgcaaggagtctgttcttttatgcagcctaaagatcaagtaataatcattgacactgatactgagcatgtcgattttgaagagactagcatttcctggtaatgaagtggagtatatatccatatatttctgttttctggatgagaagactaacctaactaagtaggaaccttgaagaatcatgttcttcctaggaattacaaatcccccgattccatgtctaacataatttctactggcctctttgcttctcatgctttagtaccagtgcttctgaatttgaaagtcttcatgcaaattgcccagctgacagggcagccactgttgaggaaatgctgatca

SEQ ID NO: 213363 - DNA, 710 bp, Homo sapiens
aaagtgttgggttggtgtagctcaggtgggataaaaggagaggctgaatgaccatgttttggagtgtctggaataatggggtatgttttgttaagctaggtctttaggtgcatgtgacataccaagagaaggtatatattttttaagattaaacactgaggctgtgtgatttttatagtttactgtctttctactatattactccatgagggctggttccaggtctgtgtttctctccactgtgtcctcagtgcctagggcacagaaagcactcattaaatatttgttgaataaatgagtggagaaagtagaggccaggaatcaaacaagaattggacagactcaagagaccttagctctagctggacttggttttgctatttaatggctctgtgccctcggaaagggcgcttcatttttcggtttagtttcctcatctgtaaattggggataataccacttagctcataggattattatgatgtttaggggacaggatatacaaaagtaacttgaaaaatataaagtactatgcaaatgcaagcaaactgttatttagattgaggatgatttttgttggtttaaattagccaagtggaaagaaaataagcaggaaagagaaaggttttcaaaaggcacgtgcctctgggcattacatgcacctatttctgattaatgggtcaagctgttatagatcttcagcccacaca

SEQ ID NO: 213364 - DNA, 485 bp, Homo sapiens
tggggttgccccaatgtttcagagtattcaatgggcctgaacgggaccactgacctctccgggttttcatctctttgtttcacaatgtagaacatttgggaaggatggaatctggacgcgtgggtttccctgcctctaggcttctgaattctgtcttgagctcacacgaaaggtggctttgcctctagattgcttctagagttgtggcaactttatgcaagtcagatcaaagtgctccttctacaagacacaccatttccacccagcagaaaatcatgcaaagatgcggaggtgcagtgcctgtgctgagaacagtgctcctaaggtgccgcactctcctgcaaggcaaaatgcataccgatgtgggggcgcggcttccactgaaatccaggcaaactctgaacttggaggttttatatttaggttgtattagtaattttcaattcataattcataataaatacttgtattattaattattataa

SEQ ID NO: 213365 - DNA, 413 bp, Homo sapiens
ccgtcatttccttctgctaagccagcatacatctatccaaatgagcaattttcatttttttgtgtgtcactagtttgtattaaatggttagtattgatcagactgaacgtttttacctttttcttttaaaccatcccacttcacatactgagaaagtaaaaagacaaactctctgggatgaagtgttttcgggaaggatgcaggttgacaagtgcattcagagtgtgctgaagcttggccattcctgcagttttgcctatcagaaatttgaccttggccgggcgcggtggctcacgcctgtaatcccagcactttgggaggccgaggcaggcagatcacgaggtcaggagatcaagaccatcctggctaacacggagaaaccccatctctactaaaaatacaaaaaaaaaaaa

SEQ ID NO: 213366 - DNA, 617 bp, Homo sapiens
ttcagtggggaatgctgaggctggattttacaggggtcagaaaaggaagggaggatatggcttatactagttctgccaaatctaccatgtaacctccttacagccattcattcattcattcactcactcattcatccattcaaacaggggatgaggagggtgtgccaagcaccagaaaggaagggcacaggtctgctttctagagctgcagtctccatgaaagagtttttgaaggatggaatgaccaggcctgggcaaactgacttctggacaattctggagtgtgggtacagatgatcagtgcttggctggtcagaaaagggaaagccaggaatgtgggggaggtgaaaacaaaatgtttctattctctaaattcacaaaagggcagggaagggagcggccaggctcagtggctcaagtctgtagtcccagccttttgggaggtggccaaggttggaggattgcttgaggacaggagttcaagaccagcctgggcaacatagcaagaccctgtctctaccaaaaatacataaattagcagggtgtggtggcacatgcctgcagtcccagctactatactcaggaggccgagttgggaggactgcttgagcccagga

SEQ ID NO: 213367 - DNA, 143 bp, Homo sapiens
tgtattatagtcaaacaatggcatgctgcacagcaatgagaacaaactatgactacacattacaacatggacacatctcacaatgttgggcaaaagaagttagaacaggccccgtgcagtggctcacacctgtaatcccagca

SEQ ID NO: 213368 - DNA, 376 bp, Homo sapiens
gctcgataccccgtgaaagcacacccctccttgccctttggtaatactaatgactacagtcacttaaactccataattaaaagtacctagtcagtatattaatcaacctttcaatgtccattcagagctaaaacttttcccttccctagctaagattatctatagatggaagacagtgtgattagcttctctttttgttgcttatctcctcacccactggcaagttgctatatctgaccccatcaggatctaaaccaggggaaggaagagagaaagcaaggcaaacagtttttgttgttgtttttcccacactcctgttgtgaaattgctttactgtttttgaacttgatatgtgtttaaggctggccctttttct

SEQ ID NO: 213369 - DNA, 359 bp, Homo sapiens
aaagaagccagaggagtaactgaggcagtgagggctttgcagccactgtaggacttgggctttctctctgtatgtgatgggaaccagcacagatgttttttgtttgttttatagatccacaagtataaacttcaatatactttggtcagaaatggataaatcaagtcaacacaaaatatgtaaatccagagggaatttgataaaattaacataacaaccagctctaaaagtagacaatgtggctgggtggctcatgcctataattccagaactctgggaggccaaggtgaaaagatcacttgaggccaggagtttgagaccagcctagacaacatagtgagacctcctgtttctataaa

SEQ ID NO: 213370 - DNA, 1575 bp, Homo sapiens
gctttcataagaaatcccatggcaaagggtaataaaaaggacctaatcttaaaaatacaatttctaagcacttgtaagaacccagtgggttggagcctcccactttgtccctcctttgaagtggatgggaactcaaggtgcaaagaacctgttttggaagaaagcttggggccatttcagccccctgtattctcatgattttctctcaggaagcacacactgtgaatggcagacttttcatttagccccaggtgacttactaaaaatagttgaaaattattcacctaagaatagaatctcagcattgtgttaaataaaaatgaaagctttagaaggcatgagatgttcctatcttaaataaagcatgtttcttttctatagagaaatgtatagtttgactctccagaatgtactatccatcttgatgagaaaactcttaaatagtaccaaacattttgaactttaaattatgtatttaaagtgagtgtttaagaaactgtagctgcttcttttacaagtggtgcctattaaagtcagtaatggccattattgttccattgtggaaattaaattatgtaagcttcctaatatcataaacatattaaaattcttctaaaatattgcttttcttttaagtgacaatttgactattcttatgataagcacatgagagtgtcttacattttccaaaagcaggctttaattgcatagttgagtctaggaaaaaataatgttaaaagtgaatatgccaccataattacttaattatgttagtatagaaactacagaatatttaccctggaaagaaaatattggaatgttattataaactcttagatatttatataattcaaaagaatgcatgtttcacattgtgacagataaagatgtatgatttctaaggctttaaaaattattcataaaacagtgggcaatagataaaggaaattctggagaaaatgaaggtatttaaagggtagtttcaaagctatatatattttgaaggatatattctttatgaacaaatatattgtaaaaatttatactaaggtcatctggtaactgtgggattaatatggtcgaaaacaaatgttatggagaagctgtcccaagcaaactaaattacctgtacttttttcccatttcaagggaagaggcaaccacatgaagcaatacttcttacacatgcctaagaacgttcattgaaaaaataaatttttaaaaggcatgtgtttcctatgccaccaatacttttgaaaaattgtgaaccttacccaaaaccatttatcatgtccattaagtatatttgggtatataattaggaagatatttacatgttccatctccacagtggaaaaacttattgaggctaccaaagtgtgccaagaaatgtaagtccttagagtaattagaaatgctgttttcctcaaaagcatgagaaactagcattttcatttcttatttactccctttctatatcaatgcaattcacaacccaattttaatacatccctatatctcaagcatttctatcttgtactttttcagaaaataaaccaaaaataatcctttggt

SEQ ID NO: 213371 - DNA, 436 bp, Homo sapiens
ttttcagcgcaggtgttggactgagctgtctgctgtgtaacatgcaattctctccctctccacttttcctcactgagcctgtgaagctcagttcaaacccaattctgtagttcagcttcactcttgtccttcctctgaaattatatggctctcttcatttgacatttcacttgcatacaataaatatcctgttgctatatttgcagaatgtattataacaaatttttagtatcctttatctcttctaacacaggatgagtgcatcgatacattcaaatatctgattgatcaaacaatctttacatctcctcagcagttctagttgggttttaatgacatcatgaccctgcgtggacctacacacattgctgaagttgcacaccagaatgtaattatgatatatgcattcaggcatgcaatgtggacagcaaaaaaa

SEQ ID NO: 213372 - DNA, 444 bp, Homo sapiens
cacttttcttctctcaggaagctgttaaatactgtgagaagaggtcaaggtggctgtgggtagtagaagcccctagctagtgaagctaagctcctggagaattaaaacctaagtgggtctgggccgtttcccattgggacatgtcttccactgggctttgataggagctcagttacctggaatagcagaggcatctgggccaacctgaatgtttttgagttgtatctgcatcattggcaagccagttctatatccaatacccatctttctgtctttgttctctaagtgaagcattttaccactaaatcaaattacttaactagataacagatatcatggtcattttatcagatatcagtatagtttgcactgaagttcattgttgcaatagacattccaatttctattttaccgctattattagagagacatattgacaaatag

SEQ ID NO: 213373 - DNA, 360 bp, Homo sapiens
aagcattatagtactgcaaatcctttttccaccatcttttcaaacttttgccgtgacagaattgtttttgatacccacatagaaaagattaaatgagtagaaaagaagatcaatatgaaaaatttaaaggaactgtcatttttcagcctaggaagagagagaatgccgaaagacttctaatgtatggagtttaaacatcagatggtgattgattgctattaatttatgtcagcaaaggaggagaagaaatacgtaaaactgcctctgaagaatttacattaaacaccaaaagaatctgactctgaaaatgaagaaacaaggaatattgtttgttttgggaatcaaaaaaaaaaaaaactt

SEQ ID NO: 213374 - DNA, 528 bp, Homo sapiens
acaaaaaagacgtcacttcaaagatgatccttggttcttggggcatgacagaagagaaaaggtaaatatgtctggatacctctcttctcccatctcttcctagggtaaggactgtcatttactgctcacttctctagtcctagtaccaaaaccatgcccagatgcagctggggtgcacttgtggttctttcggtggtgccaaaacctatctgtttgactggttaagtgtgtagaaagtaggagccctctttgccagtaaaaaggggtgcagttgatcagagaggaaagtaaatgtacccatgtgtgacacagccatcactatgtattcaagacagatgctgtacctgaggcaaagtaccccaattctagagctaattatctgctttatttgaaacttgtctatcattttaccatgccgattcttcaaaataagactataaaacataaaacagaaaggactattgataggattttgcttgttcatggttctttgtaaaacagcaataaaccaccctggctgaggaagca

SEQ ID NO: 213375 - DNA, 284 bp, Homo sapiens
agcatgacggcttgaatgtttgctgcctctgggagaagtagagtaggagagggtataagaaggacgctgacaccaggctttcctgtagtacttattcacagagccaggtgcttgagtactggtggtggtgtggggggattgtccattgatcctccttgacttttgccataagagaggccttatttatgggctactggctttctctcatttgttatgtgtttttttttcttttcatgcagtgatcagaatataatgtccaaacattcaagccgtaagggatccgc

SEQ ID NO: 213376 - DNA, 127 bp, Homo sapiens
attttaaatggcatactctaaaaatatttgtttagaacacatatttctaaaaatatataaaatatatagctgttgtctctgtgttgtcacctgatttacctaatctgtctagttctcaccattctgc

SEQ ID NO: 213377 - DNA, 453 bp, Homo sapiens
acctatgttatttagtttaattttcacagccaccgcatgaggtatgtattaaccaaaaaaccaggagtagattttcattttccaagaatcagaacataataaatctacactaaaaactgagcaacatatcttacatttggcagcatctgcttatttcacttcaaaagaattaaggggaccgggccatatcttacatttggcagcatctgcttatttcacttcaaaagaattaaggggaccgggcacagtggctcatgcctgtaatcccagcactttgggaggccgaggcgggcagatcacgaggtcaagagatcgagaccatcctggccaacatggtgaaaccccgactctactaaaaatacaaaaattagctgcgcgtggtggcatgcgccggtagtcccagctactcggaaggccgaggcaggggaatcgcttgaacatgggaggtggagg

SEQ ID NO: 213378 - DNA, 745 bp, Homo sapiens
agatattcaccactaataatgcttcttaccatgatctacttatattttggacatttcatttttatacaattaaagttttcagaactatgaaaattaagaaaacaggtttctaagtacactctttgttaaacaaaataatttcagaaatctaactttaggcttttgggatacccacatatttctttcaggggagaaaaattaataagagcccggtcacaaatcaaaagaaaaacatgtggcctaacattatggtagaaaccatggctacattaaagccacagctgtgcataaatcacaatcaccatcaatagtatcaaggaacacaaaagttagccacaggcacactgaataaaaagggtaacctgtaacctctgtccaggcttacattgctactgaaatgccactgaacttaaaaaggaaaataatttatgtaatttttacacaattatcaagaactctggtttataaaactcacataaaacaagtggcatttataccaacagtaaaagcatagatggcttaacacatgttccattcacagggccagagaaatttttaaataggtaagaacatatcattcgcccagtaatttttactatttttgtgtgaatttgcaaaattttgaaaaatcaaatactttcagcaacagtttgattttaacttcaattttagctaaatgaaaacacatcaattatgctccactacctgataaaagtctgaatggtcaaaaaccaaaaaaaattca

SEQ ID NO: 213379 - DNA, 460 bp, Homo sapiens
tacaaaaaaagggaattacaatgagagatgaatactttggtaaattatggaacatctgctgaactgtaagagtatatatcaatttaaaagaatatgctacaattgttttataaaaaagaaaactttgtcagaggacaaaaaaatgatctgcaggatagtatatattttatggtcttgttattggaagaaatcataaacatcttttggaaaattgtgattggttaaacaagacatttagtttgaattaatattgtttgtgttcataggtagagaatgccatgtttttacttgaaaaatattcccaatttatacttaattttactatctttgtaccataatcatgaatatattataaaacatgttgatcttagaaaataggtatgatgatgtataagttcatggcatgataaatgcaaaataggctgttttctttcagaaaataaatatgctcatgcatttg

SEQ ID NO: 213380 - DNA, 457 bp, Homo sapiens
tgcaaacagtttaaaaattagccaggtgtggtggtgcatgcctgtagtcccaggtccttgggaggctgaggcaggaggattgcttgaacccaggaggaggaggttgtggtgagaaagattgtgccactttactgcagcctgggcaacagaaggagacgctgtctcaaaaacaaagaaaacacaacataacacaacgcgtaggatacagtaaaagcagtactaagaggaaagtttatatagctataaatgcctgcatccagaaagaaaacttcaaataaatgcactaacaatgcattttgcaagagcaaaccaaacccgaaattagtagaagaaaagaaataataataaagataagagcagaagtaaatgaaatagaaatgaagacagtataaaagatcaaagaaacaaaaagttgttttttgaaatcgtaaacaaaattgacaaacctttagccaga

SEQ ID NO: 213381 - DNA, 361 bp, Homo sapiens
agggcagtagaggttgccttcacaggcctctccgcagcagccatcttagacttgagggctctgtcctgatgccttacaaacgcagggtccaagaaataggattccaaaaaaaacagtggtctccagcctgggactatgaagatacgaaacaacttactttaagggacagggtctcgctgtgttgcatgcgctggaatgtagtggttattctcacagatgtggtcacagcatgctacagccttggactcctgggctcaagccatcctcctgcctcagcctccccatgtggtggcctacaggcactacctcatgcctggctatgaagtaaatcttaaaagtgcctatgagacttttaggcaag

SEQ ID NO: 213382 - DNA, 539 bp, Homo sapiens
caccaccatgccctgctattttttctttattgtatttttagtagatactgggtttcaccatgtcggccaggctggttatgaactcctgacctcaagtgatccacccacctcggcctcccaaagtgctaggattacaggcatgagccaccgcacccggcctagatgttggtttttaaggctactgtgaaactggggaggggggtgggaatagggcaatttaaaatgccacagagcttactggttttactgagattcagccattttattaaataaatgctacctgaattgctgtaagctattggttaatttccagagttctaaagttgattccgatgacttttgtcagtgttcttgttgcttttatagaggagagcatttttagaagttcttactctgccatttttactacatcccctcctagtatggcttcttgcatgggaaaatgattcagtaaaaactaagcttgacatcaaacagtgtactagattaggcaagaaattggcatagttaatatacaaatctatatgaaaggtatgaaa

SEQ ID NO: 213383 - DNA, 449 bp, Homo sapiens
ctacatggtgcctagcagccttgggttggggagtcatggagagagaagtccattagtctttctagctgctcatactttttcacttccttatagccccatggatagtcacagtctcaatgttcagttctggaatattgcttctagtaatcttgtctctacacagctgtttttacttttctttgaggtaaagtcagatcacttctgctataccatgttggtgatatcactctccctttgcctattttttaaaaattgggttatttgtctgtttattgttgagttttaagagttatttgtttttattggatattagaagtttttagataattgatttggaaatatttcctcccattctgtaagttggcttttcaagttctgaattgtgtactttgatgcaaaaagtttttaatttcagggaagtccaatttattttttcttttgtcattgct

SEQ ID NO: 213384 - DNA, 772 bp, Homo sapiens
tttgggaaaattgtcttggtagatgtataatatattaagaaattaaaccagaattgtaagttacataaatttttgagtgactaggcagtaatatttcaaaaggtatttcagattttaagacatttttatttttcacagttctttttgtgatgaaatatatcatttttattttaatattgaagatattgggggccaaagcatggaaaacattttgaaataaagggcttttaaaattctttttgcatagtaaagaaaattatctcatttccagtaataaaccacttagtttaatttttaaaaaggaaaataaaatagtacttatagaaactatgagactagcagctcttgaagagaaaatgccagtaacaactagcagtgccaatatgattacaaatttacttaacagtataaattagagctttcacaactctgaagttcttttcctactaaacaaaccttggaacatatggaaaaattctctggctggcttaatcacttaacttgacctcttttcattatttgcttggtctgtcctcaaaattaaaaggaaactattatatttcatgatgtaacatgcagttcaattatcagtaaataatttaacaagatctgaaagagattaaaaatgatttgcttaacagctttggttaactagcatcaattgtattttagtgaagatatatttagaaaaagctaaatatatagagagaagtacttgctgaatcagccaattagaggcagtatgcagagaaccagtgagctgaaaccaagg

SEQ ID NO: 213385 - DNA, 199 bp, Homo sapiens
cctcactagtcgtagaaaagagtacttctccatcataatgaaacaacataaccaaaaaggttagaacataatagggaaggagtaagagggtgtaagaaagagaaaaactaacttcagaacagaaagactataaaactctccatttattctccatctttctagagataatacttttccgaaagtcagtgatcaacaaatc

SEQ ID NO: 213386 - DNA, 569 bp, Homo sapiens
taaccttctctatttagaagaagactatgttcacaaatatttgtagatattgagaatcaaagaagtaaatgtgtctataggcaataagaattacacttttctaattttttattgaacctgaagtttccattgactacattatgttctttacatttgtctccccagtggactctactttacctttagatcttaggggaaatatatagatagatataggtatatagatgtagatatacacacacacatacacataccccactgcctattatcatatctttaatatactatttatttgttttcaagtaatagtgcactagcatttgttttgtatgtcatagtttattattattttagagtatgttctttctacacagttaactgaaagacagcctcaagcaagtccttcaggaggtattccagaagaagacattgttgtacaagttagcttctagtatgttattgttcctgaccatcttctagtgggacaagatatagaggtagaagacagtcatattgatgatctgactctgtataggcctaggctaatgtgtgtgtgtgtcttcattttt

SEQ ID NO: 213387 - DNA, 898 bp, Homo sapiens
ctctgaggccagggcaggacacgaacgcgcggaggccggcggcgactgagagccggggccgcggcggcgctccctaggaagggccgtacgaggcggcggcccggcgggctcccggaggaggcggctgcgccatggacgagccacccttcagcgaggcggctttggagcaggcgctgggcgagccgtgcgatctggacgcggcgctgctgaccgacatcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaa

SEQ ID NO: 213388 - DNA, 464 bp, Homo sapiens
catttccttggcctgttaatttctctgttctatgttgcttgtatggaaaagtatctcaaaacctataatgtaaacctctcaatttgctttacttttcctgctcttgagattttcatgtggccctgattaaaattttaatttgtcagtagagtcaaatcttattagtgccattccagcaattgggcactgggatcatttgcaaggtcttcagggaagtttgcctttgcacagtttaggaaagattctgttaattaggtgaatggtataattgatacgacaagaggattgtttaacttaagggaagcaatttattatgcatgcatgagaagcttctaggtatttactgaccaattgcatgcccattacatatcctttttgtattttagagataataatcatcttatattgtttacctcctagcccagtttttggcacacttgaaagtactacaaattgtctttatg

SEQ ID NO: 213389 - DNA, 460 bp, Homo sapiens
tcctttgattcctccagcctatctgctatacccatatagctatgtgccttgaaggtgaagggtatgatgaaatcattcagagctgctcctagacaatgacaacaaggtctaaaaagtgcattccccacattgcccaggaatggctggaatttctgcttcatgtgatttatctctaatattatggcttatttaaaaaaaaatccctgtctcatagccaggatgcaaaagggagtcttccctctgcctccatcctcaacccttctttcctctgcaagttttccagtgaggaattaaaataaaaaatcctttagtgtcttaaagcatgtaaatgtaatgctaacattaaaatgatgccatagaatcataaacatatgaaaagatgcttaacctgacttggaatcagggaaatacataaattaaaatcacaaggagactctgttttatactcatcagattggca

SEQ ID NO: 213390 - DNA, 242 bp, Homo sapiens
tcaccgtgcgaatatctgatcaaattcctcctccccacccttgatatctgactacctttgatatctagtcaaattctttaatccctgccttccgtgttttaccaccttggcctgccttcagcaataatcctatcaagttggtttagccagaacactgttacccttgatgtttcttcttagtaattttccatacggtgagccacatccatatccttggctataaatctctacttctccttgac

SEQ ID NO: 213391 - DNA, 467 bp, Homo sapiens
aatacattttaaaataagattggcttggtttgagaagatgacttgctatttacaattactatttaatatttgcctccctgatgtgtctgaggaatagatgtcggaagtgcaaactcttaaaaaattggccttctaaaaaacatatatcagattccaaatcaaggttaaacatatgatagaacattcatggtgaaattcctatggtaaatatttttttctcaaatgaaataagtaatgtatacaaaagtgcctaagacagtacctggcttcagagtcactaagaaattgctaaaagctctgcttcgcatggtaaaaaacttaagtcctggtttgcgtagcttgatagagtgattatacaacttccattctctcactttttttttctgtatcccaccccttttctactgaatttgtggggatcctataataaaagtgaatgactaaaaattttaaaagcattccttctc

SEQ ID NO: 213392 - DNA, 272 bp, Homo sapiens
gtaaaaatggctgggtacagtggctcacgtctgtaaccctagcactttgggaggccgaagcaggtagatttcctgagcccaggagtttgagtccagtctaggcaacatggcaaaaccctgtctctacaaaaaatacaaaattagctggatgtggtgatgcatgcttatagtcccagctacttgggaggctcagcccgggaggttgaggctcagtgagacgtgatcatgccgctgcactccagctgcggtgacagagtgaaacccatctcaaa

SEQ ID NO: 213393 - DNA, 462 bp, Homo sapiens
ttacttgctgtgttacctaaggggcaagtcttgggagttccaggtgctccagcttcctcatcggtagactgggaataacgcctagattgtaaaggtcaaactatcagaaaatacttttgaacattcatgcagttacacaatttaataaatatggccaggtgtgttaaaaatctttaacggaatagattcagaatggattcttgttatcgaaattgttataaaatgaatataaaggaatccgaagtccgcccctcccccattcacctgtacttagaaggttccccaggagctcttgagaaatacataggctggtttagatttggccttagattgtattttttaaaatttgtagatcgacttttaaaatcttcatctccggtgtctattacttgttgctctccgttggttgctccgaagaccacctccgcaccgagtaggtcggcgctttccccagggtacaga

SEQ ID NO: 213394 - DNA, 436 bp, Homo sapiens
gcctcattgtctaccatgaaggcacaatcagagtgctccagggtggtgtgggtggtgaggatggagttgtagggctcaactacagctgtggaaacctggggcgccgctttagccagggtggacatagcttaaattataaaaactaaagatgaaagtacaaggaagtataagttatacttatgtaagtataaattcatgctgcctacttctaagagaaatttcattcttcataaccacataacattataatgccactgattcatacgggatttacattaattctatgggggaggacactagaattattagtgttcattttcatctaagatctttattctctaacgttcttgatcctattgaaacattgcagtatgcaaaactactgcaatgttaaacccaagagaaaagccattatcatgtgtatgctggctcgtgc

SEQ ID NO: 213395 - DNA, 553 bp, Homo sapiens
ataaatataaggtaggttcttattatcagtaggattcatcattaaaacatagctggcttgatagaataagttattctagaaaatgggggtatcattgacataagactcttcctctaaacttttatacctaatacattaactgcaatcatgtttccagccaaattaatcaaacagatatataaactatttaagacgtttgagtaggaaagccagagccactctttgtaggctcagtctgccaaaaaccattggaggcgtctctatttctaatattagatactacaattggacctccgcctcctgcctccagataactactcagtagggccgactttcagcttatgtgaagatagaggagaacaggatttgtgacattctgggattttgccagaatttagtaggtggtagaactaaggctgaaggccaagtgacaaatccactagatagctgcacaaaacataccctcatgcttttgttgattaaagtgttatattatttttctgagcatgggggtagggaggaaatagtctacttttttgaaagtgtctctcca

SEQ ID NO: 213396 - DNA, 164 bp, Homo sapiens
ctgccattgttagcaaaaccttctcttgagtggagctcaaagatttgtaatctcccacttcccagaaagataacttcagactcaacctagaagtaaagatcctccagatatggcctcaattaccctccaacccatgtccccagtacatccctttgatgtcccct

SEQ ID NO: 213397 - DNA, 620 bp, Homo sapiens
  misc_feature (568)..(568): n is a, c, g, or t
  misc_feature (572)..(572): n is a, c, g, or t
cgtgtctctagtatgaagagtgatgataaatgaggctgggaatgttatgtaagatgcagaccctgtaggtttgttggccaaattaagagcatttgtttctttttctcttgagaacaatggaaatcattggatgattttaaccaaaacaatcgtaagaaatttgatgatatatactaaagagaacacaagcctattcaggcatactgatcgcagtccagaagtagggatgatatctttgggtagtggaatgacagtgaataggaagaaagacaaaagagacttaagaaataaaatcaacaggactcattaatgaattagatgtgtaatatatggaaaacagaagtgacaaggatgactcctaggcttttggcttcagcaagtgctgaaacatactactgttactgagtttcagaatatgaagaccagatgtgaagagaagataagtttggtcttagctgttatgagtttgagacacctgtgtgatcgttggtgctgctgaacaaataggtggatatgcagaggacagatgcggatgaaaatttgagactggttaccccataaaggaatnggtnaacctttggccgcctttgggaattgccttggtccacttggattgcccc

SEQ ID NO: 213398 - DNA, 480 bp, Homo sapiens
agtcccagttctgaaatttgtcagaattgtgtttatagacagttttattacacatcttcttcctatctattaatattccaagattttatgtcatttcacgtataaggaaagcattaacatttactggtcacgtatcatgttccctcataagaatcttctatcaggcggggtaggtatcattattcaaactttacagacgatgaaacaggctcacagttgacaggtaatttttgcagaaatcacaaagtcaaattggcttctggagtctgctgctctatcatgatgcctccatgtcaccactattaactttgcctgaaggaaccatgacttgcagtttctaccccacgtggtcagtgaccatgaatacaaatgacccttactccaggtgattctgaagtttcagggagatgacagattccccctaaattttgaacagtaatattaattacaggtaataaaatataccaaaacatcactaca

SEQ ID NO: 213399 - DNA, 472 bp, Homo sapiens
tatgcatagcacatccccaaatgcttgaacagcaataagtacccaaaaaagtactgtttaggtagccaactcccactgtctaatttaatcccactgaaactggatgtgtctttttctccttttgttctaaagaaacttgttctactactatttgctggcaggaataattttctgccacctgtagtactctctgcttctgtgaaggctgaacttcaagttgctgtgaaagaatttgcattatccctctatagtcatacctaaaattaacccactgtcttaagttaaataagatatagaatgctcacaactgttatggttatcggagaactagagagtgaggctttctggcactacgagaggatgtagaagatgacacatgtggtttggcctttatttggaagcagcaaaaatcacagaggtggtggttacaagacaaaaaaggccaggggagtgaacacaaagttttggctga

SEQ ID NO: 213400 - DNA, 243 bp, Homo sapiens
ggagttcgagaccagcccgggcaacatggcaaaaccatgtctcaaaaaaaaaattaagtagttaaatatatataaaatatttatataatacattttaaacttaatcaccaacatcaatgctgaaataaatccggggaaggaggaagagaggagaagacaataggaagttagacaggaggggagaagagtgaggaggaggaaaggaagaaatgtatgtatgtatgagtaaaatacgtatacgtt

SEQ ID NO: 213401 - DNA, 909 bp, Homo sapiens
gtgatccaagctgatgtcttgttatcactgcagaaatatcgatgtgatagtctaccactgttcgctcagaaccttctagggttgcctttctaaaatctgaattattcagaattccgaaacacatcaggcccaagaggtttaggaagggatcatgccaccgtatatatgaagaaagcacttagcctagtacctggcacatagtaaatgctgtgtcaatgttaaccatttactgttgctactattactagttaaagtgcttacctcaccatccgtaatcatcatcatggaaaagcgagtgataatcacagtgagataccgtgacacacctgcttcagtggctacgataaaaagagggcacggaggagctgaggtcagagagttccacaggaggtctgctagggactggggccttttccttacatggatagggggagggttctgagcagaggaaggacatgatctgacccatagattaatagagtccctctggctgtgtgtggcagcaggagccagagccaggaaattggggcagaagctcctgctgtggtccatggtcctgcctgtgggggtgtgaaggaggggtgagcccatttatatcttgaaggtggagctgacagtgagtactgatggcctggatgtaggggtgagagaaagagagggggctaggatgaccctgaggtttgggcctggacaccagctgaggggtgaagatactgcattgagggaccccagggtcggggtttgcagggagtggcagaaggccttgtgaagaatcagagacgtggctgagtctgttcggtgctgggtgcccgtcagacagctgcgtgagatggcaaggagacagttggatacgcatacctgaagttgagagaggtccaggggggagaaggaaaagtaggggtccccagc

SEQ ID NO: 213402 - DNA, 462 bp, Homo sapiens
tgtgcttgatgaatggatgtaagggacgaagaaaaccaatgaatcacagataactcctagtttttcagcttgatcaacttggtagtactatttagtgatgtggggaagacttagatgaattagatgagctatacagtgaatgatgggaaatcagatagaagctatttttttaagttttgttttcataaaaagtaatatcacatctcagacattggaaaggtagagactagatgaaattacttatgatcctgacttcctgacacaataattttaagtgttttggtgtgtatctttatagtcttgcataggggttggcaactttctgtaaaggcagcttcttaactctgttgtagcatgaaagcagccataaacaatatgtaaacaaatgagcctgcttgtgttccagtgaagctttatttatggacactgaaatttgaacttaaggtaactttcacatattgc

SEQ ID NO: 213403 - DNA, 439 bp, Homo sapiens
gacctagtgcattgcctggtatggaggaagtaaccggtaagtatatattggttgaatgaatgatttgatttcctagtttttggaattggcccatgattctaagtgaatgagctcacctcagatgccttaatagtaaatgaaattttgcagcagaaatattttctaaaatacattgatttttatggaactagtgtcttgttttcaaaacagccctctgttttgctacaacaaaacatttcaagagtttcaaatttaaattggctactcaaagccaatttcttcatttttttcctatctcagtggtctagaggggcatcttggtgttttaagtggaacacaggcttagaagtcagacttgggtttttttgttttgttttgttttgatggggtcttgctgtgttgcccaggatggagtgcagcggcaccatctccgctcact

SEQ ID NO: 213404 - DNA, 448 bp, Homo sapiens
agccattggtttgcaaaagaagaaaagctttgctgctgccgcctgcacgcacccgcacgctcactccccttgatgctggagtgatgctggagagctcaccgctgctgcttgcttttctagttctcttccttcattttccctttgcagatttcactgattttgaatctctcacaatggagcccttggtttccagagatctgagaaacagaaagtgatcacattttcctagaggggagctcaacattctgctggggaagtaggagatgtcgagtctgaggtcattttcagacaccaacttgttttgttctatgaatttaaggagattttagaattggggaacaaataaaatcattctgtcagagcaaaggagaaacatctttgtatattgccttaagctttccatgcaccgttaagtgattaaaatgcaactgaaaactctgatagcaaa

SEQ ID NO: 213405 - DNA, 999 bp, Homo sapiens
tcctgggcctgtggctgtggccaggcagaccatgttggccccctctccctccctcagtttcaggcctccgggtggctcatctactttgcgcatcgtgcagacctctaatagcaccatcgtgcagagtgtccctttgttccctgcccactctgcacactaacctctgtcacccatattgctgccagccttcttttcttccacctggtctttccccctatccccaaactctagccccatttctgctccactcctccctgcccatcccagtcagagcccttactttgtgttgtcatgagcctccaagtcctcctcccaggatcctgacagtagtccatctgcttccaattcccctcttgcctccgctttgtatgttctgtcaaaaatacacatgcatggagttcctcaatgcttattcaaataaaccagcagctctctgagtccttttaatgtgcttatattaaaagccaattaaagatacttgggatgaaaaacaaggttgttggaatccaaagttaatgttgatggtttgaatcacagaatagataggactgaggaataaaaactagatatttgggcaagagagagatggacagtgtgacagagcagtcatccatggagctctcatgggatccattgtcctgaggatccacagatgatctaacgtggagctccccagggatccatcatcctggggatcagatgtcatgtaacatggaattctcccaggatccattgtcctgaggatccacaggtcatgtaatgtggagttcttctgggatccattgtcctgaggatccacaggccatgtaatgtggctctcttacaggatccattgtcctaaggatccacaggtcatctaacatggagctctcccaggatccatcatcctgaggattctcaggccatctaacatagagctctcccaggatccatcatcctgaggatccacaggtcatcagaaatggagctctcctgcaatccatcatcctgaagatccgc

SEQ ID NO: 213406 - DNA, 235 bp, Homo sapiens
atggctacttgacacttccactcttcctcctctgaattaggtggccctcctgtgtgctccatagcaatctgtcttgacactttgcataactatctgtaactgtcaatctttctgatctgtatcctccaatagatcctaagctctgccagggctaattccgtttctgctacatccctagcatccagaacaactgacacactacatattcagtgcaatctagcatggaaaatttcta

SEQ ID NO: 213407 - DNA, 326 bp, Homo sapiens
tgaatatgtttcatgctaatgtctcgcagaccgaggctgcgtccgtaaccacataatcatcacagtggaaattctgactcagctgtgacgtttggtaggcgggacctttgaatggtgctttagacaattccgtgcaaaggctgtagtcagtggcccagctttgcaagtctttccaaaagtcctaaagcgcactagcatgtcctcacttggccctgtcacctctgcttaaattttttcatggagaatactcactcccaatcatggtacattaaggtgaatttgatcttgggcagcctccctcagtggagtgaatcagaatcatggga

SEQ ID NO: 213408 - DNA, 1021 bp, Homo sapiens
aattggagaatgtcgaaaataagaacaaactttatagctcattgaggccagaatggcattccctgcctgtagacgacaaggcagttgatttctgccatcttttgaggagcctaggcaaggcctcagaatgttccttagctattgatccacacagcagctaacccagaggagttggtctgtgaggcgcagctgtgaccaggtgccagctaggcaaactgccttacatgtgaggaaacccagctgcagaagtgaagcctcccgctgggtcgctcagcccgtcctgtgacagctgataaaagagactgcatgttctgatccccaacacaattctgtttccactgccccagattccccagttcactggtgatcagaaagggccacaaagctgcaaaggcaccccagctggccagcggcagaagtgcatctagtccagcccctaccctgataccacctgtggagctctgtccacctgcagagctgtatccctcctcaaggctctgtggattgttcttcttctgttgtttctcttgtcttttctctctggtaagaatgttagtattggttttgactcagttagcagttgatcaaagattactccagccactagtattagaagcacctgggctgcttgtttggctactttctagtcctacccaagacccactgaatcagaatggctgggcctggggtcccagatgatcccgaaaccccactgctacactgcccaccccctcctcaccctttctcataatgttctcgacactagaaatttcccatgtgccgtgcttgctgttggcatttggtgtgaatgaaggggttgtgaacccactggttatgaagaactggctcttacagagagtgaggctagtgtccagcagggccatttatgaccgaatataatgaaaatttctatggccatttttctttcaggctcctttagagagcaaactgctacttttgtagaattcagggcatttatttttcgtttgaaccactgtgcagaaagaagaggatgatgttg

SEQ ID NO: 213409 - DNA, 435 bp, Homo sapiens
agaattaaaagtaatgaggggtagtggagtattactttcaaaggagcaattatgagattgccagaaacagatggtttcattttccacagaaactaaaaaggtagaagacaaaggaaaaatagctctgatgtgctagaaaaaaataaactgtcaaactaaaaatatcatccacaaactctgaaaaggatacacttcacaatttgttacgtaaggctagcatgtaatcttgatactacaacatgacaaggttgtggaaagaacaaaaaataacagccaaatcgctcatgaatatagaggaaacatcctaaataacatattatcaaattatatctataacacaaagggagaattaatatattttgacctaattagtatttttccaggaatataagattggtttaacagtgaaaaatcaatcagtgtaattcactatat

SEQ ID NO: 213410 - DNA, 272 bp, Homo sapiens
ttgcataaccagggtaaattctgacttctaaggtttcttccttaagtagtgtatagcttgctcaactcaacatttaaaactgaattttagtagagccagtaactgttttcatacaagggggtccatcatttccaactccctgtgtcttcctcagcggatgttttcaagttctaaggaacaaagctaataagtaatgtggatgaggctttttcttgacggttttgttttgctgtaactccctcttcttctatactcccttctgtcgtcttctc

SEQ ID NO: 213411 - DNA, 645 bp, Homo sapiens
cactgcactccagcctgagcaacagagcgagactttgtctcagaaaaaaaaaatcagcttataataagtgccataaagaaaataaaactgggagacatgaaagagactgactagggtggtagtctaacagatggggcagtcaggaagtcttccctgaggaggtgacatctgagctgagatctgaatgaaggataggatccagccacagattgatctgggggagaggcattctaggcagaagacgtggctagtgcaaaggtcctgaggtaggaatgcacttggcatgttcaaagaacacagagtcggtgtggctggagcagagcaagtgaggaagaggactgggagatgaatcaggaaggtgccggggcttgtaggctcagatgaggaatttgaggactcttggtgctgagggaagaacgtgaaggagatgattgatcagggctgacttctccggagaaccactgggctggtatggaggcagcatgagattctgagtggtcaactcagaggcgagaatcagcaaccccagcatcaacttcagttcgttgagagaagaaaaaaaaagaatttagggttaaagtctgtattcattccctgtggctgctgtaacaaatcaacacaaactggtcgggcgcggtggctcaa

SEQ ID NO: 213412 - DNA, 473 bp, Homo sapiens
gaggatccccggtgtttatcgatgccactcccacagattgatctgggggagaggcattctaggcagaagacgtggctagtgcaaaggtcctgaggtaggaatgcacttggcatgttcaaagaacacagagtcggtgtggctggagcagagcaagtgaggaagaggactgggagatgaatcaggaaggtgccggggcttgtaggctcagatgaggaatttgaggactcttggtgctgagggaagaacgtgaaggagatgattgatcagggctgacttctccggagaaccactgggctggtatggaggcagcatgagattctgagtggtcaactcagaggcgagaatcagcaaccccagcatcaacttcagttcgttgagagaagaaaaaaaaagaatttagggttaaagtctgtattcattccctgtggctgctgtaacaaatcaacacaaactggtcgggcgcggtggctcaa

SEQ ID NO: 213413 - DNA, 319 bp, Homo sapiens
aagtggtagcacctgtattcaagtcaagtccatttatctctaaaacaagagctcttaccactattgctgaagctacacatttcctaaggctcaggccatgatttcttctctgctttatgtcacttctcattctgccctaacatctggagggctgggtgttcaggtagaagcctggatacgctgccactgtgaattagtaccaagtgcaggcagcacagagcaatgggtaaggcacatgactcgctgtgggtctcgggctttgtttatctgtctttctcagagacttgctgcatagaccaatgcattgcatgtgtgcagt

SEQ ID NO: 213414 - DNA, 320 bp, Homo sapiens
tgatgtccataaagtgtacaacccaaaagagagaattacaaatctaaggcaagaaaaatgttctgaaataatcgaactgaattggcagaccaaagtccctactagactcttccacctgatatgacaacaaaatctatataagatatatgaataatccagtatgataccctttagcaaagtgaatgacaatggtatgccacatacaaaatcagttggggaattttgcaacttaactgcattccttgagaaggctggagcacttgggctgggtgtggtggctcaagcttgtaatcccagcactttgggaggtcaaggcggat

SEQ ID NO: 213415 - DNA, 443 bp, Homo sapiens
gtaattccagctacttgggaggctgaggcaggagaactgcttgaacccgggaggcagaggctgcagtgagtcgagatcgcaccactgcactccagcctgggtgacagagtgagaccctgtctcaaaaaacaaacaaacaaacaaaaataataaaaacctgtaccccgaccaccttgggtgcatgtcctcaggaccgcctgaggctgtatgttaacgctgtatccttaactttggcaaaataaactttctaagttgattgagctctgtcttagatacttttgggttcacataggaaagaaccttgcaggggagaggctgccttcatccttcatgggcccggcaaggcctgcatgagcaggcagtgctcatcacaccatggggaacagctgaggttgttcccgtgacgcagaaacaagcaagcaggctcacaaccaagggagggg

SEQ ID NO: 213416 - DNA, 681 bp, Homo sapiens
  misc_feature (654)..(655): n is a, c, g, or t
ggcatagtcaaggtcacccacaaggcctagtcactcacgtgcccaagcctgacatcaaaggtgcagaaattgtagactctcccataggaggtactccaagagaaggagaatagggtctggaggcagggaacctaaggctgatttaccctgacttcctagaactaaatcaaaaggaaaagcctgactttccacacccaagtaacaaaaggatgagaggctactgcctttgcaacccccttccccgcttttccacatggtagatgaaaaattgaaagtacctctgattggtcccccctcacaaccaatcagactgatcttgggccaagtcttcgtttgcataggagtataactctataacttcatttcagcctctgattggtcactttccacaaccaatcagacgtttgcataggttgcaactttgtaacttaacttcagcctctgattgattgttttccttaaccaattgggctgatcgtgggccactacttcatttacacaggatgtacaccaaataaccaatgaaaaacctctagagggtatttaaatcccagaaaattctgtaaccagagctcttgagctgcttgctcgagcctgctcccactctgtggagtgtactttcatttcaataaatctgtgcccctaaaccttagnnatgggtaccagctcgatcggtatcat

SEQ ID NO: 213417 - DNA, 450 bp, Homo sapiens
ccaagaattcgacatcatcctgggaaacatggggaaactccatccttattattaaaaaaataaaattttaaaaataacatgaaagaataagcttccttacacattaactctggctgggcatggtggcttactgctataatcctagcactctgggaagccgaggtgggaggattgcttgaggacaggagttcaagaccagcctggccaacaattgcgagatctcatctcttaaaaaaaaaaaaaaaataggtcaacaaattacttaaattgcttctaacatctgatatagcaaagtagcaagtaactatgatgtcatctctacagatgccaaataggactaaaagttttcatttacaagacagtgaatatctgctataatagcaggtgggaatgaaaaaatactggaggtagtgaggtggttttctttactgctttaggaaccttaattaa

SEQ ID NO: 213418 - DNA, 1231 bp, Homo sapiens
gataagttggggctaattattcacttacttttgtaaaacatttctaaggagttctgaggaccaagttttctttctatattttaagtgagatttgacttatgcccaattcttctggaacgcatcccctgaaatggatatttttattcattttaatagtactttatttatcttattttgttgacattgagtactatttgccaagcactatggtaagcgcttcatttctgggtctcatttatcctcctgcagccctataaggtagatgctattatgggtatcttcaagttgccaacgaggacgctgaagcttaggtaggttaaataatttacaaaaactataatggcagcactaagagtccaatatagatctgccaatcccaagaacttgaacagctcctgagaatgaagaatgaacagcccttgatcttgaagatctgttttccaggctccaaaatctaaactgggctctatctacatctgccttcctgggccaaacatttataagcatcagtgagagaagattgcctggatttgtttactttgtggtcctgaattttcagacaagcgcaaattcccatgaaagaagaacagacaatagctgtatcccagtagatcatttccctgttaccacctgtgctgaatttgcatttcattcattcattcatttattcagtcagtcattcaacagatcctgttgaataccatgttcagagaaatgtgtggactaaaaggatgatgcagacccaagagttgtccttaaggagcttacagcagagtgggaattttaggtgcccagatggaaatttgtccatttgggagtagtgtggggtgggaaggaaagaattagttaagactaaaaaaaaaagttcttaaaacttcatcaccctttagccattgccctattgctcttctctcagccaacctttgtaaaagctttctgcattcactatttctcattctcacctccggtttactcgccatttcactgcttctgccccctccactactccagtagaattgctcttgccaaagttactagggacttgccagttgctaaattcatggaatacactctggtctaatcttatttggcctttctgctgcatttggcagtgctgattttgtactcttgtaaagttcttcctcccttggccttgcttactctcctgattctactcacactttttggaagttccttcatgggctgcacattgactatcccctaggtttct

SEQ ID NO: 213419 - DNA, 290 bp, Homo sapiens
aaattccagataagaattttgtaaataaaagaaagtgacaagcataaaagattgataaaatttaatgtgaaaattaaaaatggttcatcaaaaaacagcctaaaaacagtgaaaaaaatcataaaatagaaaaaatatttgtacactaatacacgatagtggattagtatcaaaaatgcattaagaactcttataaatcaataaggaaaagaaaaacaactcaattaaaacaacccagtagaaaaccagatcaggaccgggtgcagtggctcatgcctgtaattccagca

SEQ ID NO: 213420 - DNA, 450 bp, Homo sapiens
acaaggagacccttaaggtctttttacttctcccatagggcaccagagcacgagggaggggaacatgcagagagaggggcattgccagagatgactgtgcagcaggacaccaaaggtgcatgagcagaaagatttggtgccaaacctccgcaggcatgaagataatgtcatctcactcagtgaagctgtaaagagaataatttatcaagcagagaatggtttcgatacttttaaatctgacgtacacaggagcacataccagtgagactattctagtctgtaaaacagtgaaatgatttcatcctggttagtaaatagccctagcaacaagaagcttggaaattccaccctggctgcccacccctgtcccagatcacaaggtcccctacaggccaacatcaggaggttgaagacctagcccagccagagtctatcaggagcctgcccaac

SEQ ID NO: 213421 - DNA, 402 bp, Homo sapiens
agaggacaaggcaaaacctctctggagaaaaatgagataatccagagattctaaaacttttaatatataaagataaggattcattttaaaactaccagacttaacaaacaagaccaattgaaaaaaaaagaatcgaaacaaactcacaaatggtttggttattggtattatcaggtacagatgctaaaataattatggttaatatgtcaagaagacaagacagaaagttgtaacaaagaacagaatctatttttttaaaaatcaaaatggaagttctagaatttaaaaacatttaacaagtgaaattaagaactcaataacagcaatctagacacaacagaagataaatctggtgtaactcatgacagaatcagtagaaaataccttgcctgggctgggtgc

SEQ ID NO: 213422 - DNA, 391 bp, Homo sapiens
taaagttgttttagaaattcagatgtgaaaatacaaacattctctgcttttttctcccttgtagctttgattcctcaatattcaatttgtcagccaatcacattaactctatgtccaattgatttcccatatgcctgctttattttctgtggttaccacttcgggacatccttctcacttcaatccccattcttctgtggtaggcaaaaatttgtaaatcccccaaccaagggtgtcctgtcctgatccccaaaacctgtatttatgacaagatatcactcccatgatcatgttatagtatatggcacaactgactttcagattatccaaatcagccgaatgtaatcacatcactctataaaagcaaagaacgtttttttcccactggtgg

SEQ ID NO: 213423 - DNA, 667 bp, Homo sapiens
gagtaaacctgtaaggtcaggttgggctttactctgatgggtgggattctcactttcctagcctcatgtttccttgcagagagatctcagctactgtgattctcttgcctctcctgccatcccttatccccctttgctcggggaaggagtgacttgcttgactggtggattttggggaaggcagtaagcaggtggggctcaggccctgtagattccctccaggttctctctttgggagccgccctccccacaggggacatgccttcctcctgccagagttgtagggccacctcccctgcgtttgtcccactatggcagtggtcaggagcctacttggctacaaacccaaaaccagactctttagtcagaaggccagtattttcatctccatccacctgactcctgttttgatttccaaatggattctagactgggagcagaggaagaaatattgagactcgtatgagcatgaacacagcacccaaggcaaaaagaagattctagggtgtgtagtgcatttcctgaccccagccccagtcccttaaggtagtattgaggcaagaaagagccattgcaaccctaaacattctgacaccttcccatctagaaagaaacagacccagagtcgggaatagaagccggggaaaagttcggggagaacactcaa

SEQ ID NO: 213424 - DNA, 816 bp, Homo sapiens
  misc_feature (32)..(32): n is a, c, g, or t
  misc_feature (34)..(34): n is a, c, g, or t
ctcgggtgttgtctgcgtcatctcgccctggnanatctctcgcccgcgtcagaactcgtgccggcctcggcgtcaccggggtgcttgcgcggcttcctttaccggtgggtcaccagttttgggccctggccctttctatggggttcagggttttgtgacccgtgccttggtccccggccccgtcacctgtgtcctagaaggtggcccattcccggcatctgtttacttgttactatgcttccttcttgggaggcattccaattacaatgactcagttacctcctccacctagggggactgtgaaaaacaaacttttaagctgaaatattcaaactatttgacatcagtctgaaaagatgcattgttcatccattcaatagacattgattgcctaccctgcaaggtgctgccatgggttgcaggacccatgatgctgaccggcagataggattcctactagcgaagcttgcagtgtaataagggccagagttgtggggcacagtgcaggatacagggcagatgatagagcgaggctgtctgaagcaagaatggaaccttgggcattttagagcagtgaatcagtccttcaggaccatgtgctcagtttttgcttgaaatgtaaccacaaaacacacttcccaaaacagggagttttgtttcctagtatattcagttctgcagtagggcagataatttggcagggattccaatccactacattcgatactgctttgacccagactagttaactctagaggttggggctccatatgtgaagcaaagttgctgagctattaaaaaataagacatatgagg

SEQ ID NO: 213425 - DNA, 210 bp, Homo sapiens
ccttcacatctttagaaattatgaaaacgtatgtgattggagggtttggaaaaccagttatcttatttaacattttaaaaattacctaacagttatttacaaacaggtctgtgcatcccaggtctgtcttcttttcaaggtctgggccttgtgctcgggttatgtttgtgggaaatgcttaataaatactgataatatgggaagagatga

SEQ ID NO: 213426 - DNA, 422 bp, Homo sapiens
tggccccacacaagcttgtggcaggggaagctggaattctctagagatactttctccagcccttcaaagggctttcttgagtcattttctatttagtttgttctaaagacactgcccaggcctcttcattttcagtgagaccaaaagaggcagtatcagttcccctgcttctcctgcgcaggcccagggaagacccccttcctgcctgagcgtggaggagggagcgttgaccacggggccagcctcctgccagttaggcctggactggagctgctggggcccaggggctgcttcactccctgccttcccgctcctggcctggcttccatctgtccatttgtgtttcacatcattttgccaaatgtaaatctgtctgtctggtttgtttattttctaaactcatgtatgttctctagacttgg

SEQ ID NO: 213427 - DNA, 153 bp, Homo sapiens
caataaggagcaatacattttttaagataatgtgtttctaataatttttgtttgaaagcatgaatttatcattttcaatatgtgctatcagagctttccttgaagtaacaggctttggtcttgagaaaatgtctgccaaatacccaagtccag

SEQ ID NO: 213428 - DNA, 463 bp, Homo sapiens
attctgcatgctcctaaatatcgcttaaaaataataacatgctttattaaaaacaaccagttgaaataaacccgtttctatgtctttcccaaggatagtgtgtacttaacgttggttttaaaaatgaacttactattgtaatattacacttacagataaacgtattatttaacaccttattaaagtgtacacaccaatgtaactattacctctaaatcgaaaaatagaattcttactaacaaatcagaacccctttcatcctcccccatcattattttttcttctctctccaaagacacccattatcttgacttctacatcttttcttttgaattgaattgaatataacatttagaaaatgtttgccggccgggcgcggtggcttatgcctgtaatcccaccactttgggaagccgaggcaggtggatcacgaggtcaggagatcgagaccatcctgtctaac

SEQ ID NO: 213429 - DNA, 130 bp, Homo sapiens
gtgagtgcccaaacccaggagaatccaagctgtcctcgctgcctcttgctgcgccgtcccctccagggctggccagagggtgacaaccctgccaggccgggagcctgaggccctcaagccactcagcatt

SEQ ID NO: 213430 - DNA, 119 bp, Homo sapiens
ttaacaggagcagcatgtggggtgagggcttggcactcacaccctctggcctgatgcttcatgcaaaccacctgccaatgaggggacagggcgttaccccataccaggagctgccgcct

SEQ ID NO: 213431 - DNA, 424 bp, Homo sapiens
atgattacatgtgaaatgataatagcttatataatattaggttaaagaaagcattagaattaatttcatctgtctcttttcacctcttaatgtggttactaaaaaattttaaattacatatgtgagtgttgtataaagaagagaaggttagcattccccttgacaaggatggaagaggcctgtacaacactcatataacttcggcattgccaccttctttgtagcatctaaccatggttttgaggatggaaaatgattgtgtaattggtacgaggtttcctttgtgatgattaaaatgttctggaactagatagtggtgtcagttacacaatattgtgaatgcactacatgccactaatagtaaatgttatgtatcttttactgcaataaaaaattatgtgtgtctcacattatatttctattg

SEQ ID NO: 213432 - DNA, 497 bp, Homo sapiens
catttatagtgtgtcgataacacatccgtgtccctcctcaaagttcttcaaaggcttcctgtcacacgtagactaaaattcaaactccatatcgtgagctgcaggctctagaggatccaagttctgtctgcttttatttacctcattggtgttgtctttatcacctctcttttggctctctgtgctccagccatgctgtttgccttgctcaacaagctaagtatattcccgcctattttcgattccttctgcctggaaagctttaatccagatctcctgtcagcttggctctgttcttcaccctgttcaggtctctactactgttaaaagaggtgttattgactgtcaactgtacaaggacaacttcactctctgtcctcttactgtgttttttttctttataacacttgtcacagtgacatttcttatgcacatatatatgcatacacacacttttttttggctttttaattctcttcttacctctggaatgtgaa

SEQ ID NO: 213433 - DNA, 386 bp, Homo sapiens
ctctctcaccccaggttggagtacagtggcgtgatcatggctcactgcagccttggcctcctgggctcaagcaatcctcccacctcagcctcttgagttgctgggactacaagcatgtgccactacacttgggtaatttttttatttattgtagagatgcggtctcactgttttctatgtcacgcaggctggtctcgaactcttgggctaaagcaatcctctcgcctcggcctcccaaagtgctggtattacaggtgcgagctacggcacacagcttcctcaggaaccatctgaaactattgctcaaaaaaagtaatatctgaatttcattgccaccagctacacggctatgtagaaatgcacaataagctgctgttttaactcta

SEQ ID NO: 213434 - DNA, 269 bp, Homo sapiens
cccaagactgaaccaggaagaaatacaaattctatacagatcaataatgagtagtgagattgaattagtaataaaaaaatcttccaacaaaaaagaagcccagaaccagatagattcacaaccaaattctattaagcaaataaagaagaaatggtaccaatcctgctgaaattttccccaaaaattacataagaagggaattttccctaactcattctttttttttttttttttttttttttttactaataacaggatggtttattata

SEQ ID NO: 213435 - DNA, 550 bp, Homo sapiens
gccagatgccacagtaaaaagtattttaggcatagagaagggctaacataaagacagattcatttatcctattaagttttggttcctatcttttctctgtcttcttttgaccccaaagtaagcttgcatgcaaaaatgtcaatgaataaaatggatgcctacactaaaaatgctatctagtttgtttccttggcattatttggaaaaattgcagtccttagtttttctttgacattatcttagattttctgtgaaaagggggagagcctgattctgattcctccacgcaccacccagaagcactcagtaattttgtagaaatgtaattgatttatttttgtttacttgataaactcaacactttagctgggaggatgtcagacttaaatgcaattttacagtctcttcgaaggatgcagttggtcaaacatcatgtagctaaagtatccgtctggctcctgaatgtcttcagaacatggaagtgtgtgccctggttacatgtttctccaaatgagcattaggaatgtttccttttctctacatccttttt

SEQ ID NO: 213436 - DNA, 347 bp, Homo sapiens
atatctcttattacaagtgacctgagcatctccctggattaagagccagttgtgtctgggtgcagtggctcacgactataatcccagcactttgggaggccgaggcagatggatcacctgaggtcaggagttcaagaccagcctggccaacatatagtaaaaccctgtctctactaaaaatacaaaaattagctgggcatgatggtgcatgcctgtagtcccagctacttgagaagctgaggcaggagaatcacttgaacccgggaggtggaggttgcagtgagccgagatcatgccactgcactccagcctgggtgacagagcaagactgtctctccaaaaaaaaa

SEQ ID NO: 213437 - DNA, 512 bp, Homo sapiens
cagggcatgcagtagctgaaccatactcattaaacacaagaggtgagcccaaacatgcaagcccatttaaagcctttgctggcattacatctgctcacactccatgggccaaaacctgtcacagatataatttgtatttacagtatgtgtggatatttcaagtggcgtgaactcacagaagaatattgtatcttggacaatgttaccataaccttttcaaacgtatttgcaaacttgacaaacttggtgtaagctttttcacttttgaaaacgttttgaacttgtggaagaatttctatggggaaagagagaaatatactttggaattcaactattgctatcacagtgttgggaaattcactgacaccagtttgtaacttgaatctacaggaagaaatgaagagagccaaaaatgacaacaaatggattaacccaacgaactccataaatatttattttttcccctttcttttctcagcttctttaaaagatgtaagatgatataaagtaat

SEQ ID NO: 213438 - DNA, 310 bp, Homo sapiens
ggaggcgcggcatgcccctggcaggggagagcgggctgggctccgcggggccatggggacccgcgcgctgacaatgcctgggtgaccggagccgcgccagccaccctgtcacctccaccatcgccccctgcacccagcctcgccgccggccaccagcaccagcctcctccgtctctctctctctctctctctccattattgtttcccactctacagaggatggggtcggctgatgattaggaagcaagtcagaccttccttcaaagcctggtaatatttatgtaggcaaaagagacagagagagataaaa

SEQ ID NO: 213439 - DNA, 357 bp, Homo sapiens
tccgcccgcctcggcctcccaaagtgccgggattacaggcgtgagccaccgcgcccggccaatttttaaggtcttttatttagttcattgaaaccattatgagacaagatatagcttgaagggggactgcatttctcaccagatgaaggaatttgtggcctgtgtagtgactacgggagacaaaaggttattttgaggagatttgatttattatataagattaatgggctgggctaggtggctcatgcctgtattcccagcactttgggaggctgaggctggtggatcacttgagctcaggagttcaagaccagtctgggcaacatggtgaaactccccccctctaccaaaaataca

SEQ ID NO: 213440 - DNA, 430 bp, Homo sapiens
gaggcagaggcagaattgcttgagaccacgtgtttgataacagcttagacgacatattgagacctcatctctacaaaacaaatgaacaacagaaacataatggtatagtggcaagttgatacatgtgaactttgttgtaaactgcattgtattttagaagagtaaaataatgcttactgattactttggaataatatagtaaaaatactctgccaatgctgactggatagatatttgatgatatgaaataacttttttttaaatctggtaatgtacttactgggttttaagaaaaggagtcctgtggctgggcatggtggctcgacgcctgtaatcccagcaccttggggtgccgaagtgggcagattgcttgagctcaggagtttgagaccagcctaggcaacatggtaaaactccatctctacaaaaa

SEQ ID NO: 213441 - DNA, 448 bp, Homo sapiens
ggatttgacggggccagctttatcggaggtgtcgtgctggtgttgagcctacaggcggtggctttctttgtgctgcacttcctcaaggccaaggacagcacctaccagacgctaatctgacccctttgggcctggactccatcctgaggggaaaggaggatgcagagggtggcctctgggcacccttgtgggtaagcggggggcgggggcgggaaaaactctggccgccagtttttggctcctgcgggcaccaagcaggctcagtgtctgatgcctgacatctcctcctgtcctgggcctggaacctgcagctgagaaaatccctcaaccacctcgtctcctccatcgcccctgctgggccccccagcctgacagtgggttgtatgcctgcctctttccaccaactggcctgggcactgcccccaaataaaggaactctgcactgcac

SEQ ID NO: 213442 - DNA, 989 bp, Homo sapiens
ggatttgacggggccagctttatcggaggtgtcgtgctggtgttgagcctacaggcggtggctttctttgtgctgcacttcctcaaggccaaggacagcacctaccagacgctgtgagtacctggccagcagcaagtacctgagtcccagctcacctcctggttcctgccccaccgttccccttcagtacccagggtgctgtcttctccatgggcaagccctcaggacggtgacagcgtgctccatgtgagccacaccccttttgtctcctccagttggggtgtttcctttgtcagatgttggctgggaccaggactcagcctgggccagtctaggagcccagctgagccctcctgtgtcttttcccttcatgctgccagcagggaagagaaccagtaggtgccagcccaggcaagcctgtggcccgcgtttctgtggctgtgggcaggagctgggccttgtgtctagttgggttttgctctgagaaggggagctgtgcctgaggccctctgtgtgccgtgtgtgctgtggggcgggtcgccacagcctgtgttaaagtgtttgctcttcctctgctgcctcctctcgaggcagggggtccttggctggctgaggcagtgtcaccttcctgagtgtcctctttggcctctgcagaatctgacccctttgggcctggactccatcctgaggggaaaggaggatgcagagggtggcctctgggcacccttgtgggtaagcggggggcgggggcgggaaaaactctggccgccagtttttggctcctgcgggcaccaagcaggctcagtgtctgatgcctgacatctcctcctgtcctgggcctggaacctgcagctgagaaaatccctcaaccacctcgtctcctccatcgcccctgctgggccccccagcctgacagtgggttgtatgcctgcctctttccaccaactggcctgggcactgcccccaaataaaggaactctgcactgcac

SEQ ID NO: 213443 - DNA, 907 bp, Homo sapiens
ccccggccacccccaccccgcgagcccatggaggctccgggaccccgcgccttgcggactgcgctctgtggcggctgttgctgcctcctcctatgtgcccagctggctgtggctggtaaaggagctcgaggctttgggaggggagccctgatccgcctgaatatctggccggcggtccaaggggcctgcaaacagctggaggtctgtgagcactgcgtggagggagacggagcgcgcaatctctccagctgcgtgtgggagcagtgccggccagaggagccaggacactgtgtggcccaatctgaggtggtcaaggaaggttgctccatctacaaccgctcagaggcatgtccaggtaagggggttcttgcacctaagccaagttgcatgggtctccccagccatagcctgccccccaggaggaaacagcctctctcaggcggtggattttgctcacccatacctgggcccggtatcagttctgcctttagctcactgagaagtcccctcctctctctgcctatttcctcatctgaaaattagtacaggtgtgtggaggggatgggagtgttagctcttcttctagtttaaggcatagcaaggactttggaagttcagagggaatgagagggagtgcttcctggaggaggtggcatcagtaatgagcctggaaggtagagatggagagagagcacatctggtggagggaactgtgtggggcttgcaagtatgttggatgtctagagtagggacagggctgcatctgaatcggaagtttagcggtgagtgggggctggggtcttgatgggagtcagggggtgggaaggctgctttgctatggatcacctgtctcctcagctgctcaccaccaccccacctatgaaccgaagacagtcacaacaggtga

SEQ ID NO: 213444 - DNA, 288 bp, Homo sapiens
atatacagagctagtttttcagcatccttgacagcacttggtgctgccactattatattgctttaataggtgtatagttgcagaattagtttgcttttctctaacggataataatgacaagtatattctcaggtactcatctactattcatatagcctctttggtaaaacgtttctcatgtcttttgcccattttctaatcgaatattttttgctgttgaggtttgagacatactccagatatgagtccttcgtcagatatgtagcttgtaaatattttctccatgtg

SEQ ID NO: 213445 - DNA, 448 bp, Homo sapiens
agtcttgaatattggcgagaaaagatgaagaagagaggatccattgtgtcgatcttcaagccctgttcttctaaaatgattgaagctgagatctccacctagtggatatataggattttgcagatctttatgggaacagccaactatccctggaaatccttaatttttttctcttagagaaataacaagttttaaagacttctacttaaatctaggatgattgtcaacaggacaattgcaaatgtatgaaacataccaatatgcatatcagttacactacagttaacaaagctgaatttttattttcatactataattaggaaaacagatcaaacacaaatatgaatatataattatccatgtagaaagcaatattgtaataccactaattgagatatgtataataatttacatgaaataaacatcaaatgtaaatctgctcaaatac

SEQ ID NO: 213446 - DNA, 196 bp, Homo sapiens
gagacagggtcttgctttgtcacccaggctggagtgcagtgggtggtgccatcatagctcactgcagcctcagcctcctggactcaagcaatcctcacacctgggcctcctgagtagctgaactatataggcgttagccactgctcccagcccagtctctcctttctttgctctaacaagtttaattgaatgtttt

SEQ ID NO: 213447 - DNA, 549 bp, Homo sapiens
attagacactgtagaagaggtgagtgtgaacctgaagccataccaacagaaactatccaaagtgaaacacagagataaaaaaagacaaaaaatgaacagagctatcaattcagaagatgttctacaatttctacaaatgttcttaaagttgttctacagctcagcgatggctctgttcattctttttgaagtagaacaacttcaagcagctgattatatatgcaatcagggcatctagaggaggctgggctggagacagaaaaaaaagttaagatataatagccacggtggctcacgcctgtaatcccagcactttgggaggccaaggcgggcagatcacgaggtcaggagatcaagaccatccccgtctctactaaaaatacaaaaaattcgccgggcgaggtggcgggcgcctgtagtaccagctacgcgggaggctgaggcaggagaatggcgtgaaccccagggggcggtgcctgcagtgagccgagatcgcgccactgcactccagcctgggcgacagtgagactccgtttcaaaaaaaaaaaa

SEQ ID NO: 213448 - DNA, 412 bp, Homo sapiens
atatattatatatatcatattatatatggtatatatatactatatatattttatgatatatgtaatatatatatagtgtatatatatatatatatatggcatcccccttctaagatattaactcctcaatgacaggggctctccaccatgatttccagctttatattttctcacaggaagtaataaattccatccaagcttggctacttcctggtccccatatgatgcttgtcctttcccactgatcgcagtgcttagcttgctatacaaacatttatttacttatcatttgttaatggtcatcaaagcccaaatgagtgactacagtacttatttgcccttctcacatttcatatggcatttatccagtctggagataagaatggtttttacatttttaaatgattctatt

SEQ ID NO: 213449 - DNA, 1965 bp, Homo sapiens
agacatcaggtttcatcatgttgaccagtctggtctggaacccctgggctcaagcaatcctccctccttgtcctcttaaagtgttgaaattatgggtgcgagtcactgcgcttggccctaaatattttcttcttctacctccacttccctgctacttctcaagcccctcaacaatatcatcattcactgatcttgtctaacatcttcccattttcattctcctctcaaaatccttgctcctcacagctgccagaataaacttttgttagtttatatcggatcatatcattcccttaatagttttccaaatttcttcacctggcccagaagctcctatgtcatccagtcccacctaagacatgaacatcctctcccctgagaggtttcttttgctttctgtcttctcgtcctgcttgctttcttccagacctctgaaaaagctgggcgggccctggaacattgctgtttcctcattttcaagtgcctttccttcttctctgcggtgccaactctctctcatgtctctatttgacatcgctgctagaacatcacttcctgcggtatctgcagtcaggcatcccttccataagaattaacaccacgttcttgaccttagcagtaattgaaattagacagtcactggttaaatcagtcacttcacatgaggtcagggaccaattcctcctttctaccatatcaccaggaaaaatcataaggcatcacagagaatagaaaaggtatatttgctaaataaatttaaacgttactaagaacccacccattaatatggaagcgattcctctgttaattcatggaatgtcacaaatgagctgaattcattcaccctcacggtgcctctaagttataaaccactaagtcatccatatactcccaaactttaccaagattcagtgtcttagggtacaacttaaaaataataacaaatgagaaatttgaaattttatgcctcaccagttttcaatttatcgtccctcatatcctaatacagctttatgatactgaatcaggatcctgtaagcattcctcctttgccagctagttgaaagttaagcttcatcaatagaggacactcgagtgatggtgaggtgcttgatgcaggaaggtgcatcccttccaagactcacactttagttattcagtaatgtttatcattaatattggagtttaagaatatgaatgttaaagaatatatttaagaatactaaagaatatactttgagaaggcaagaggaaaacttctaatagcacatttgttttaccttttattaaatattgcattctgcatagaaattaattcagaaaactcctacataaaccatttatatgagtcttttgtaatcactgaaagaaatagactgttgacagtcaccttttaaaagggtgtataccattcaactcttaggtataccatttattattttgtttcctgcaaactcaaagcatctaggagtgagattacaaaaataacaacaacaacaaaaaagcagtgttggctaatttgtcagcatatggaagttaaatttcttacagacacacaacttctgtgtaaatgtaaatcacttggccattctagctctattatcaaatttatagtttcccagagacaaacattgctttggcttttgtctggttttggatagttggttgtcttttctcttcatgcttccttatctcctttatttcatttatttttaattaaaaaacaaagagacaggaattacctatatttcattgttgaaggttaaattttgtttgtatttgtaccttagttccacacttttttctttctggaaacgtatatgataaacatatgcttgaaaacaaaggattacatggatattctgaactcccaaaaagagaatctcatgactaagccaatttcacatttctaattagcatacttgctttcattgagtgttttgaaatttaactaaacataaaatt

SEQ ID NO: 213450 - DNA, 451 bp, Homo sapiens
ctttaaagaaaaaaaaattgcgtttttgaagtaccttgcatttgtttcagctgtcacttggatgatcacattcatgagatctctaggaactccatcctgtatgtgtgtgacacatatagttgaggtatgctgccaggatttagtgaaggcctaactaaatgtggtttcctcaaattgacaggaagatttattgaaggattatgtttactggctactgtaaaaatcacttgtagtctctaaagtgattaaggagacataatgaagatccagatcccaggtttgtttttgttagtaaaaactttagagtatctgctgggcatggtagctcaaacttgtagtcccaacactttgggaggccaagacaagaggattgctttagcccaggagtttgaggtcagcctgggtaacatagggagactccatctctaccaaaaaaaaaaaaaaaaacata

SEQ ID NO: 213451 - DNA, 392 bp, Homo sapiens
tagggtcctccctgtactgggtatcagcctggtctcagcattcagggactcagagagaataatcagaggtgcatttctatcactgtgaggaccttaggctcaggccaataatgcaaagaagcaccctacctgggagaaacttactgtctagttgtaaagaaagcaccagggggccatgatgcccatcccacccatgttcccacccaaactctcctaaacccacagctcccaaacaagtcctggattgtacagatcaggctccagccaaggtgagctcactgaggtcagagcttacagaatctgggagctcaaccaacatgatggcttcagagatgaaatacccagcacatccagctgcagttgccccataaggagcagaaagtttgctatca

SEQ ID NO: 213452 - DNA, 426 bp, Homo sapiens
ggcacaaaggaacagccttctgggggtgctttcaagctcactcatgtgattattaacaggtctcaggttctttctggctgttggccagaggccaattccttgacccttccatagggcagctaacaacatgggcagctggttgttagttcagagcaagggagagagggcatccaagatggaaaccaagctctttctgtaacttattcttagagtgggagcccatcacacttgctgcatccttttaaaaaaattattgtgctaaagtgtgcataatgtaaacttaacattttaactattttaagtgtacaattcagtggcattacatacattcacattgttgtgcaattatcactatcatgcatctccagaactttctcatctttacaaaatgaaactctatacccattaaataactccccatcgtct

SEQ ID NO: 213453 - DNA, 554 bp, Homo sapiens
tattactttttaaaaatatcctttaatagatatcctagatatctgttcccaaattctaggcaaaaccagtctaccagtttcatttttccttgcaataactttcctggagcaattcagtcttttgctatagtcctgcctagttgctttctagtctggctgcacaaatgttgactagcatttgtccttccccatggtctttgcctctcccatgttagactacctgtctcctgggttcccatgtcttttccttttgtgattcatttccttattttggtggaggatattcttctgtagctttccaataaagtgtgtatgacagataagagactttgcatttctgaaaatatgtatttgcccttgtctttgagtgatagtttgagtatctatggtgttctaaagcagacattttttcaaaacttgaatatgttattccattgtcttcttacagtggtgctatttagaaatcaggtaccattctgattttttccatcctttacatgtgaaatgttgattctctgagattgttctcattatcagcattgcactgaacttaa

SEQ ID NO: 213454 - DNA, 271 bp, Homo sapiens
ttcgttctaggagatagccttgattctgttatagtttccactttaatatttacaccagcttgggtttttctgttaaatgcacatacaaaaaattttgacctgatcgaccaccattccatctttcttttaatttagcattactgctttctagccattttcataggaagaaagtataaagcaaacagaaatgaatataaaaatttgttgctgaattacaagtagtgtcacgaagtctaatccacaataaacaggcttttcaaaatcattcaga

SEQ ID NO: 213455 - DNA, 375 bp, Homo sapiens
gactgcccccatttgccagatgagaagctgaggctcggagatattgaggaatctgtcgagcgtgagatgcggttttactatttcaccaggctggtctcgaactcctgggctcaggcgatcttcccgtgtgggcttcccaaagtgatgggattacaggggtcctttctgagctcacctagggaacccaagaaaggaggatggctggctcttcattcttctgatcttcattcttccttgtgtgttaggtcccctgtcttagacactggagataggacagtgagccaatcagatgcgggtcctgccctcatggaatttatggtctaagggagatagagattaactgatcataagaataaatgtaaaattatatggcca

SEQ ID NO: 213456 - DNA, 496 bp, Homo sapiens
atacacatatcattctgaagataaaccttaggtgtaagaaaattatgaagtgtttttgtgtaagtatgagtttctgcttattttcagaagaaaagaacaattattggaacaatattttaattaggtgactaataaaaatctaaacacctcgggaatgctgaaagcaaatctatactttctgctttgtcttgaatttattaacttaaaattttgttgcttatggtttagattctcccaggaatctccctattaaagcacaggcaactttgtctccagaaataacactctggagtacaacaataaaagccttctcaaaacagaaaacaaataaatatttttaacacttattttaatgaaaattcaaccaaaattgaataattggatatatttttaatgttctttgtgtgtgtgaatgtataaaatgatgcataaaggataaataaaagaaaaatgatgttaatatttgtaatgaataaaactggacatttgttaatta

SEQ ID NO: 213457 - DNA, 1195 bp, Homo sapiens
  misc_feature (2)..(2): n is a, c, g, or t
  misc_feature (4)..(6): n is a, c, g, or t
angnnngcgatggcggagtcgctgcccctggagatgctcacatatattctgagcttcctgcctctgtcagatcagaaagaggcctccctcgtgagttgggcttggtaccgtgctgcccagaatgcccttcgggagaggctgtggctaccctgtgcttccagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtccagtcccgcttcgtgggaggggctgacctgaccctaacactctgaggccagaccctctaggactgggggtggggccaatccagggcagcccagagggaacatcctgccacaccgcctggcagtagcctctttccagctacacgtcgctgccacaggcccctggaaatgctacctacgtgttgccgccacaggctcctgctctctggccaagccctgggtgggaggccaggcccccagcgggcagggtctggtgctgggaggagcagagcctctgcctcttgcctgccctcctctcagacctaaggccgggctccacctactcctgtgggactctcccagcaccctgtgtgcactgagcttcagcagctgagcctaggtctgtgctgtaaatcctaagattaaacattccagatagta

SEQ ID NO: 213458 - DNA, 521 bp, Homo sapiens
  misc_feature (2)..(2): n is a, c, g, or t
  misc_feature (4)..(6): n is a, c, g, or t
angnnngcgatggcggagtcgctgcccctggagatgctcacatatattctgagcttcctgcctctgtcagatcagaaagaggcctccctcgtgagttgggcttggtaccgtgctgcccagaatgcccttcgggaggtaaggcacccaccctcccccgtcccatcctcaggtgtttcttacttcagcttactcgtggccctgctcatgtatctccatccatctatccatccatccatccatccattcatatgctcatacatacacatatatacatacattcatacatacttggctctgggtacagtgctggggctatacagataaataagacatagttccctaaggagctcacattccagtgaaggagaaagacgagtaatatgaatgatcatgctatcgtgtgctcagcgctgtgacactgggaagaaagagttcgacggggacagccgggcgcagtggctcacgcctgtaatcccagcactttgggaggccaaggcgggtagatcacctgaggtcaggag

SEQ ID NO: 213459 - DNA, 1407 bp, Homo sapiens
  misc_feature (2)..(2): n is a, c, g, or t
  misc_feature (4)..(6): n is a, c, g, or t
angnnngcgatggcggagtcgctgcccctggagatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtccagtcccgcttcgtgggaggggctgacctgaccctaacactctgaggccaggtcagtaaccagccctgcagcacagcctccttgactcccccagtctccaaccctggccttgacccgggttgctttttgcctccctctactgcagaccctctaggactgggggtggggccaatccagggcagcccagagggaacatcctgccacaccgcctggcagtagcctctttccagctacacgtcgctgccacaggcccctggaaatgctacctacgtgttgccgccacaggctcctgctctctggccaagccctgggtgggaggccaggcccccagcgggcagggtctggtgctgggaggagcagagcctctgcctcttgcctgccctcctctcagacctaaggccgggctccacctactcctgtgggactctcccagcaccctgtgtgcactgagcttcagcagctgagcctaggtctgtgctgtaaatcctaagattaaacattccagatagta

SEQ ID NO: 213460 - DNA, 1501 bp, Homo sapiens
ccgatcccgggaccttctagctctgggtaacggttcctcctttgggccactctgtccctttagcttgggggaccgtcctccccttccctatcggccccagaagatagctgccctgtcatctccgcgagaacaggccctctgcccatccccttcccttgaagtggctgtctcctccccgctcagttctggaagatgtccgctccatctcatcgtcccgaaggatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtccagtcccgcttcgtgggaggggctgacctgaccctaacactctgaggccagaccctctaggactgggggtggggccaatccagggcagcccagagggaacatcctgccacaccgcctggcagtagcctctttccagctacacgtcgctgccacaggcccctggaaatgctacctacgtgttgccgccacaggctcctgctctctggccaagccctgggtgggaggccaggcccccagcgggcagggtctggtgctgggaggagcagagcctctgcctcttgcctgccctcctctcagacctaaggccgggctccacctactcctgtgggactctcccagcaccctgtgtgcactgagcttcagcagctgagcctaggtctgtgctgtaaatcctaagattaaacattccagatagta

SEQ ID NO: 213461 - DNA, 791 bp, Homo sapiens
cctgtagtcccagctactcaggaagctgaggcaggaaaattgcttgaacccaggaggcagaggttgcagtgagccaagatcacaccactgcactccagcctgggcgacagagcaacactctgtctcagagaaaaaaaaagaaagaaaaagctttcttacatggtcacagagccctcaggtagactgcactttaaatctgtaaaggatttaaggagacaggatatgtacacttaaaatttccaaataagccaagttgctagctcctggctgatagacaaaaaaagtgaaagaattcttagcaaagctgtcatgcagtattttgctcttcctcattcgttggtgctgtggctatactgctggctcctctcatagtcagctctaaagaattgaaagttggccgggcacagtggcacacacctgtaatcccagcactttgggaggccaaggaggtggatcacctgaggtcaggagttcgagaccagcctggctaacatggtgaaatcccatttctactaaaaatacaaaaaattagccaggcgtggtggttgtgcacctataatcccaactactcgggaggctgaagcaggacaattgcttgaacccaggaggtggaggctgcagtgggctgagatcgcaccattgcactccaccttgggcaacaagagggaaactccgtctcaaaaaaacaaaacaaaacaaaacaaaaacaaaagtcaagtgcttacattttgccagaagccacaaatgaagactgtgccttataggccagcagagcggctaagagcacggga

SEQ ID NO: 213462 - DNA, 316 bp, Homo sapiens
aaacactagtgaattcctcacatttcagcaggccaaggcctctagggattggtagctcaagagtatagactcaaaaaactataaactcagtttgacaggtgagatggagaggtgactgtgctaataatcgtttagctcacaaatgattcagcaaactctttagacttgtgaaaaaacacatccaaaaggagactgcagcctggtgccggtggctaacgcccgaaatcccagcacttttgggtggccatggtgcaaggatggcttgaggccatgggtttcaagaccagcctggtcaacatagaccctgcgtctatta

SEQ ID NO: 213463 - DNA, 467 bp, Homo sapiens
cagatttctttttttggggaccttggggaaagggaggccagaaacctccgtgtccaaggtggggtggaaggagagggagaaatcttagcaaaaatgtcaaccagcaagggaagatgtgctagcgcaagtaggcaactcaacacaagactcagttggagagggaagaaaaatttagtactaaattattgtagtttcttcttattgtaggcgactgggagtcataattaccaaactatttaaaatgaccaaaatgttgctcttacctgagtatgttggcatacaactggaatgtatctgatggaagaaaaagcttctcccactgaataaattttatgaggatgatgagagacaaaaaaatgtttgatcagatatcatgtatgtgcatgcttgtctaattcactgattatgcatacattcacctcaaaatgctactaaaacaacaataaaataatgaaaaagtgaaaaaa

SEQ ID NO: 213464 - DNA, 916 bp, Homo sapiens
gtggaattttctcaagggatgtcttacctgaactagggaggagggggtgtggcgcaggaacagttctcgctcgggggagtctgatgctactggtctgggaaccattttttgggaactcctgacgtaggtgatgtacctggaagttccccaaggacaaagtagtggcaatccattggttccctcttatctgagagatagttaaaagaatcatagccactgacgcattagcctgtatcagtagcattcttcaggaactagagcgagtacctcctgtcaacattttactacagtgggcagagcactggatggaaacttttctggatttctgcttccttgccagagtaatgggaagattggactcatgctgtctgccttctttaaaattctgtgacctttctttgaaaagaatatttatttcagcctaatgaggtgttttgtgtttattttttatctttttaagctaaatctccactgagagtatagatattgatgctagtggctgctggttttagttccacttcaccttataatggctttgtttctccctattgcttgtgttcgatttagggctatatggacagtgttctttagtgtagttttcttattctcatcaagttgttttatttataccacctcaaggacttgagttggtccttgtaaaaaaaaacaaaaaaaaaagtacactggatagagaggaaagcaggcagggcactagggttagaagacatgattcaagcaaagacaaagataggaatgagccaggtatgcactgagagactcacatgcttagagaggaaagtagaggttagggagaagtgataaattgcattgactgtgtacagagggtactcgaaaaccatgtagctgagtttggatttgccaaatgggaattagatctttgagccaaggtaggggg

SEQ ID NO: 213465 - DNA, 805 bp, Homo sapiens
gtggaattttctcaagggatgtcttacctgaactagggaggagggggtgtggcgcaggaacagttctcgctcgggggagtctgatgctactggtctgggaaccattttttgggaactcctgacgtaggtgatgtacctggaagttccccaaggacaaagtagtggcaatccattggttccctcttatctgagagatagttaaaagaatcatagccactgacgcattagcctgtatcagtagcattcttcaggaactagagcgagtacctcctgtcaacattttactacagtgggcagagcactggatggaaacttttctggatttctgcttccttgccagagtaatgggaagattggactcatgctgtctgccttctttaaaattctgtgacctttctttgaaaagaatatttatttcagcctaatgaggtgttttgtgtttattttttatctttttaagctaaatctccactgagagtatagatattgatgctagtggctgctggttttagttccacttcaccttataatggctttgtttctccctattgcttgtgttcgatttagggctatatggacagtgttctttagtgtagttttcttattctcatcaagttgttttatttataccacctcaaggacttgagttggtccttgtaaaaaaaaacaaaaaaaaaagtacactggatagagaggaaagcaggcaggagaatcacttgaactcaggaggtggaggttgtggtgagccgagattgtgccattgccctccatcctgggcaacaagaacgaaactctgtctcaaaaa

SEQ ID NO: 213466 - DNA, 427 bp, Homo sapiens
gaatagttcttatggagtggacacacgaaatagagtcatgtgagtgaaagaaagttgtgattcttttttttcccccttaactttacatgatataaatatagtgaaagcgaaattgttttcagtgttttgatgtgtcacatgtaaagtcataccttggccaaccgtggtagctcacacctgtaatctcaacactttgagaggcggaggcaggaggattgcttgagctcaggagtttgagaccagagcaagacctcgactctactaaaaaaatttaaaaattgaccaggcatggtggcatgtgcctattgtcccagttactcgggaggctgaggcagaaggattgcttgagtgtaggagttgaaggctgcagtgagctgtgattgcaccattgcattccagcctgggcaacagagtgagaccctttctc

SEQ ID NO: 213467 - DNA, 509 bp, Homo sapiens
caaaaataagaaattaggagaagacaatgggcgctcaaagaatttcagctcttggatcagcttcctttcttagatttcagagaacttaatattttagttggccatatgaatgttaagtgattttgtactttgattttgacctatcaaaatacacttttgcttttactaataatccttctggtgttttcctgagtacacgatcagcaataagttttaaagcaatggttgggtgcgggggctcacgcctctaatcccaacactttgggaggctaggcaggtgcatcacttgagcccaggagctcaagagcagcctggacaacatggcaaaaccccatgtctacaaaaaatacaaaaaattagctgggtgtggtggcatgtgcctatagtaccagctactcaggaggctgctgtgggaggatcacctgagtctggggaggttgaggctgcagtgagccatgattgcgccactgcaatccagcatggataatggagtgagaccctgcctcaga

SEQ ID NO: 213468 - DNA, 462 bp, Homo sapiens
aagggcagcatcgagaccacagagaggggagggcacccggggtgagcagctgctggggatgaaactgctggaggtgctggccagggctggctccccacccgctttctccctaggaaactcccacacccactaaggagcttttgcaattgggaagctaggtgctcagccccacttgtctccagtccagtgaagccctttgtgggtcaagggatttgctgggcctccctcggttcgtcactcccacccttcccaaatgttgcaaggggtggtgtttcaggctggagctatgcgctagggagccagaaagaggcctgatacaatgcttgtcctcaagaagctcacagtttgaggccgggtagcaggaggaggccgttgggacagtggaaggcaagaggacctgcctgtccccgcagcctccgatgggggccggcaggaaaggctttccaagggtcagaggaaatg

SEQ ID NO: 213469 - DNA, 150 bp, Homo sapiens
ttataaataattctgtgagcctagttatcacaatgaattgtaattttgttttgtacatcatcttcctcatggactatgaactgctggagagcaggaagttttaatttgtctttgtgttttctgcacttaacactacatttgggacacagt

SEQ ID NO: 213470 - DNA, 354 bp, Homo sapiens
gaaacaaaactatcatcattctcagatgatatgtctacatttaaaacttacttctgcaggaaaaaaaatatcagaaatgatagcagagtttagcaaggtaatttccagttattaaaaactcagatctcagaggcaaggggacaaagccataggggtattactcgcacagaggcacagggtgctgtcagcaagagcagagcccatcctggggccacttgtccccaggatgatttctacccaaggccagcattggatggtgagcggggacaagggtgagcctggacatcagtctgtagttccaccttgttggaggagaggcatggcagcctgctactcagaggctgaagtgggaga

SEQ ID NO: 213471 - DNA, 110 bp, Homo sapiens
ggtgagaatggcttctccctcccctgccctcctccctgtgctttggtttggctttgatctctctgtaaactcatcacaagaaagagcccttctaactccccatgaagctt

SEQ ID NO: 213472 - DNA, 234 bp, Homo sapiens
tcgtgccaggccttgttacatgttttctaccacaaaatttaaattgaataaaattcatttaaataaacatttattttttcagtttcatcagtcacatttcaagtgttcagtagccacatgtggctaatagctaccattttagagagagtaaatatggaacatttataattatcccagaaagttctatttgcattggttgtgtagcacttaagaagacagttttcagctgggtgg

SEQ ID NO: 213473 - DNA, 279 bp, Homo sapiens
aagtgctgggattacaggcttgagccaccacgcccggccaacatggagattttgatgaacgatgttaggatccccaggtcagaaaagcaaacttggacccatacttgacaccatacaacaaaatcaatccaagtgggtcaaaagtttaaatggaaataaaatattaggaaaaaaatgggtgaattcctgtataacctcagaataggaagaccttttcaactacgactcaaaatccagaagcccccaaatactgagattcaactacatattttaagtggc

SEQ ID NO: 213474 - DNA, 182 bp, Homo sapiens
tccttggcagagctccccttgagagagctcccctcagagctcgtaatatatagcttttatcattgcattctctgctcagaaaccttcagtggacttcctcttgctaccatataaagctcaaataggttaccatagcatccacagcctggctccctctcaaccttcccagtcctatcttcccc

SEQ ID NO: 213475 - DNA, 126 bp, Homo sapiens
aaacactaggcccagaccctttcctttgttaagaaaggaaaaagtgttttgctaggacgttagagttactatttaagaaacccagaacaatcatgtctctcagagtccttagtattacctggtagc

SEQ ID NO: 213476 - DNA, 579 bp, Homo sapiens
ctgaaagggacaggggcgcccagccgtggagggagggtcctcactgactgacacaggagagaaaacccaggtccttaacttcggtcaaagaaaacagcgttctggccacaggctgctggatgtcatgggaaccgcaggcgtgggacctccagcccggctgcctggcccaggcaggccctccctgaccaggccccgtggcagcaccctctgcccgctcctggggagcgccaggaccccggtgcttgtggactcttctttgtcttttctagaggagatcatttcctgtgatccccttggctgggttcatagcaggggctggacagttgggggaacatccccctccccgctcagcccaaacagagggctccttgttccgctcacacaaagagagcccgccatcaaaggaatccctcaggtccggctggcgggggtggggaagcccggcccccagagaccccagcagggtgggcgccgggagcacggagcccagtgacccaggcccggccctgctaaggattcacctgcatcttacctgtgtcttgcggcaggcttgccaggtaaaacacatgcttgcatgaa

SEQ ID NO: 213477 - DNA, 493 bp, Homo sapiens
ctttcatgtcctctaagattcatttcaccgtgacaatatcactgaaaaacagcaaacaggaattacagctctcactatgttgccaaggctggtctcaaactcgtgggctcaagcaattctcccaccttaacctcccaaagtgttgagattacaggtgtgagccactacacccagctttattaaatctttaactttcactttagtgttaaaaacagtaaatactaaggctaaaagtgacaggaatcttaaaggtagatcagtcaggcatattagttaacatgtgatctggttttattctgattatctgtctctaaatcaccaggtcaaattaaaatacaaaaaaattagccaggcatagtggcacgtgcctgtaatcccagctacttgagaggctgaggcaggagaatcacttgaacctgggtggcagaggttgcagtgagctgagatggcaccactgcactccagcctgggcgacagagctggactctgtctc

SEQ ID NO: 213478 - DNA, 451 bp, Homo sapiens
actgcctcagcctcctgagtagctgggattacaggcacctgccaccacacccaactaatttttatattttagtagagacggggtttcaccacgttggctaggctagtcttgaactcctgacctcaagtgatccgcctgcctcggcctcccaaagtgctgggattacaggtgtgagccatcgtgcttggctttctaagtcttttttttttggcggggggatgctattgtaagtggaatttttaaaaacttttcatgttcagattgcttattgcttgtgtatagaaatacgattactacttgtatattgagcttgtatcctgtaactgtgttggatgtgtttattggctctaatagtttatttgtgggattttcttaggattttctatatacaagattatatcatctgcaaataaaggtagttttccttcttttttttaagcctgagtgattt

SEQ ID NO: 213479 - DNA, 908 bp, Homo sapiens
gtagtcccagctactccggaggctgaagtgggaggatcacttgagcccaggatttgagcttgcagtgaggtatgatcatgccactgcactccagcctgggtgacagagcaagaccctgtctccaaaaaaaaaagtgtttattttgtaatatgtgtgtgacacatatttgtttacagtgtcccttatctgtactaaagaaagaatataatgaagtaattgaagatggctgggtgtgatggctcacacctgttattccaacactttgggaggccaaggtgggtggatcaccttaggacaggagttcaagaccagcctggccaacatggagaaaccctgtctctaccaaaaatacaaaaattagccagctgtagtggtgcacgactgtaatcctagctactcgggaggctgagacacgagaatcacttgaaaccaggaagcagaggttgcagtgagctgagattgtagcactacacaccatcctgggtgacagtgtgagactgtctcggaaaaaaaaaaaattgaagatatcatttgccatttaatttttttttttttttttggtttcttttttggtatagctgtcaattttaaggccaaatcttttattttgaaagattttacccatgttaatttctataattctgaagtcattactcacagctagaaataaatttagaaataatcaatgcacatccaaactggcctctcgttttttcttttttcttttttctttttttttggtatctgtttaattctcacttccaattttgctacattgcatatgggaaagtaatttttattaaaattctaattttgtttgagcctgatattttaatgaactaaattacttagaaatagctgccaaaaagtctctcttttttgcatgatgagcaaatcccaaactatag

SEQ ID NO: 213480 - DNA, 554 bp, Homo sapiens
aggactccctgcctgtcctggggagtgtgtttttgacacgctcatgacaaggtcccccagcgtgaggcaggaacaggacccaggcagggcagtagtggtagcacctgtccagtgtgtctaaggagtggactgttgatctcgttcacacctcatagtgacagtatggttattttcacttaacataggagaaaacaaggctcagagagacagagcaggctgcctgaggccacacagcttggcctggtggagctgggtttggatctgtattattagccacgggctcacctgtgatcggagctctggggagggaccttgctatgaacgccgaagggggatgcacacccgttgagcttccaagaggcaggacccagtctcagcctcagccttgcctgggcagcctgggcttggctcctggctcctgctcttaccgtgtgactcgggtaaactgctggccccctgcgattccgacccctcgtgtgtccaaggtgttagggttgaatgagacagcccagataaggcacccgtgggtccatggcaccaggaaggccccacag

SEQ ID NO: 213481 - DNA, 639 bp, Homo sapiens
tggtcctcagtgggacttccattagaacatcttcaaaagcaggaggaaagcaggtcttgttctacacatgccagagtatattcccactgtggccctactaccactgtttttcatctgttggtcttataaaactctgacagcagagtaagaaagggtttgagaagcaggtcttatgaggacatacattaccaagaatgtacctccatattcactctgtatattagccccacaaatcttcaataaagcaacaacatgcttgatatgcttgaatttttttgtggaagctggtgaagaggctaaattttgtgggaccttaaaaaagggtcagaccacatgtgcccaagatatagttccaggcttccctgataccagctaatgtacactgagcatgtcaggcaaaaggcaaagttatttcaacctgttagctctcctaatctttataacaaccctgtgaattaacttgaattgctacaaataacatgcctgaggctcagagaatggaggtaactcattcagctccaaaaaacctaataatggggccaggactctgaccaaggtttgtctgattactgaattggaacctgaatttcaattttagagctccccaaccagttaccatgcattgactatccatgtact

SEQ ID NO: 213482 - DNA, 500 bp, Homo sapiens
cacacacacacaaatacagtgcgctatacggagtgataattagaatacaacatgttaggaatctctgtgttcatgcctttaaccatttcatattatttcataataatcaagaacttattaatcaaattagcatttaattatcttcagatgaaatgagaaagagggtgggcaaaatgtagactgaaggctgagaattataggaattatggtcacaatcagccagtgttttaactctactgcaattgtaacaaagtcattggatcttggttcaaccaatgggaatagatcctttcaaaatgccaataaataaaatgctaaataaacattttggcaattttctcttgataaatctcttatagcaatgtgcataatgcttccattttcatccaatgaagtactagtgaaaatagtctagatagtgttaatattgatagaaattataactaaggaataagttagatggtgattaaagagttgaataagcactcaaagaaagttgt

SEQ ID NO: 213483 - DNA, 342 bp, Homo sapiens
gacactccgtctcaaaaaaaatatatatatatgtgtgtgtgtgtgtgtgtgtgtgtgtgtgtgtgtgtgtagcatcatttcttttatgtttactttctcagtgggatataccattggcctttgcctaatattaaaatgagcatacatatccattgccagaacagattccagctaacagcaaagagagctacccacacagcatgctacattatataaaatttggagaaggttatctagttcagggcattgatctgcttagatcttttcatcttaaagagagaaaatacaaattatttttagacctgaaatcaagtgctcaactccaaacaacatttctgagaa

SEQ ID NO: 213484 - DNA, 407 bp, Homo sapiens
ggaatgctacagtgaccataatcccccaaagtctacaacccccaagtcatttcaaaatgtctggggaaggctttatgattttctggcagcaagtttattttcctgatcatgttttgctccagctcgtgcagaatgacgctgcgttccctgagcacatatgcaccgacagatggtgtaagaggactagaatcacactaactccttcagaggagccagtttggaatgcaaatttaattttcagagaagttaaacaaggcaaatcgagaactgactctgaaatctgaaagccatacaaagaatgaaatgtattcctaggaagccaaactatgtcccctacgtgcgtattacacacatagcagtataccaaacactacaattgtttcgtcgcccacctttcaactacaggg

SEQ ID NO: 213485 - DNA, 337 bp, Homo sapiens
ctggactattatgtatagagtaaactgatactacctctaaaagctgagattacaggtggtattggcttcttcacacttttctactttttcacaataatttcttgtagtaattagaggtacttaaaactgaaggctaatgatttacagagaatggtagtttaaaatgattggatcacatgaaaacataatataacattcagttcttctaacatctttttagttaggaaacttcattagtgaaaatatttgattatcatggcttaacaagagtagtggcacattcatttattaattttgcataaataaagggaaaagaatctaggatatatcactttat

SEQ ID NO: 213486 - DNA, 776 bp, Homo sapiens
atgttgaataaatctgatgaaaatgggcgtcctgatcttgttccagatcttagcagaaaggctttcaatttttccgcctttggtatgatgttagccatgggtttgtcaaatatggtctttattgttttgaggtataccccttttatactcaattttttagtgttttgataataaagacatgttgaattttaccaaatgctttttctgcatctattgaaataataacatggtttttgttcctggtttatttatgtaatgtatcatgtttattgatttccatatgttaagccatcctttcatttctgggaggttaaataatatgtccagatggtaagtaagaaagccaggattttaactcaagtctaacttccaagcctatgtacgttttaccatttgagaaacttctgtattttaattctacattcataaacctatagacatatagagatccacatccatatgtataaactgtttataatatatgtagtataatttctacattaaagttttcattaagtctggtttctatccctatgtatatgttatgtttcatgggattcgacttcatctaaatctataaactagtgatatattatatatttttagtactatctatatatctcttttaaaattgttctgcacattgatctccaagatgtgaaccacctgaggtgccagaaaccagcctttcatatgatatactttatcagtcattagatttttcgaatatggcttcgataatttaccggtgtttcccaatgccttggggtccttcc

SEQ ID NO: 213487 - DNA, 482 bp, Homo sapiens
tgcatgtgcagtgcacttactgaagttgtacacatgttcatttgaggcatttttcccttaccagtcaattgttcctagaggaaggtcatataccagttaaactctgccattttgcctcttagtgcacatgcttgagcccactcttccaaatcccaagatcttattaggaagctgctgatcactagcttcaggtattttctatctgttggagactgccttcccctggcaccgctgtgatcaattattattgtagaaagacagtttaacaaccacctggccatcatctgatggtcgcctgacgttccttttggggggctctcctgccctgctcatgtctgcctagctacctaccctaacatatgcacatatacttttttctcttgttttttaattttctaaaataggatcagactatacataatattctataattttctttttttacctaataaaatttcaaagatttctcttcaagtaatgta

SEQ ID NO: 213488 - DNA, 492 bp, Homo sapiens
ctatcgagagtcctgaggacttcagcagacctccagggaggcctgtccaggatgttctcctacgtctgtaaaggagtgagcactttgtgctagtttagggaaagacagcttttctgttgggattttagacttaccctgcttgaaattggtggaaaaatacctgtctgggatggggctcaataatctgcagctgtattaggaaatgcaagtagttttgatgtgggtggtttcaagacatatttggaaaatgtgagggaaatgtgtatgtgcatttgctgagcgggggactggtgaaggatcaccgatccatttattcctaatgctcatctcagctttttattgtgccgagtaccttgataaggcttgggttattttatgagcgtttatatataaattgatagtgtccatcagatcatgtatatttagaggcatgctcctactttgagtaaatggaaagctttagagatatacactaaataaacatcagttact

SEQ ID NO: 213489 - DNA, 281 bp, Homo sapiens
aggctgggcatggtgactcacgcctgtaatcccaacactttgggaggccaaggttagtggactgcttgagcccaggagtttgagacttgcctaggcaacacagtgagacccccatctctataaaactaaaaacatcagccagcatggtggtgcatgctgtgttcctagctactgaggaggctgagatgggaggtttgcttgaacccaggaggttgagactataggtagccatgatcacaccactgcactctagcttgggcagcagaatgagatcttgccta

SEQ ID NO: 213490 - DNA, 316 bp, Homo sapiens
tactctttcccccaaccccagtccccaaattccattgtatcattcttgcacctttatgtactcaaataacttctaggcttaattgtttgttaaacaatccaatagtaaagatatccatcttaccggaaatgtctcagaagaataattttgttactatctttaaaagtgtgaaagcaaccagaggaggaaaaaatacagtaaactttagctcaattaagtttgaggttgcagtcaagaaatgtgaaattattaatatactgggtttttctactgacttctacatccataattgcagaataaaaattaagattcaaaa

SEQ ID NO: 213491 - DNA, 246 bp, Homo sapiens
tggaaaaaagtgttactgatgaaatttgaatatcgtctctagattgagcaactaagcaataatattgtattaaattgctagattgggcaatagtattgtactaaagttaatttcctgacacagttaaataattgtactgtgtatataagatgtcaaaattgagaagttgcaaggctaaatggaatttctcagttttttaaactcttactttgtacatctgaaattattttaaaataaaaactaaaa

SEQ ID NO: 213492 - DNA, 108 bp, Homo sapiens
ctcctcatttacagagtgttgagcagatctccctattccccaccaggaatccagggctcacagcctagagaaggaaaacgccaactccatgccaggtactgggctcag

SEQ ID NO: 213493 - DNA, 784 bp, Homo sapiens
ctgtatagagcaaaagcagggactgagtcatacgaggctgagtctctcttggtgcctgaggctttgcaaggtcaggagctgactaccttttcccccatgtctgacaagtggattctgtcctctgcatgttgttgtttattttatgaatcagccccagccattgtccagctcacgggcacctccagcagagagtggaggcctgcagggactcacaggtgacccacgcctgcagcagagtggagaagggcctccctcctggtcggcggaaggacatcgacattgaagccagatgctggggtccccaggaccaggtgtccacacccccactgcacggatgagacaatcagcacagggaggtgggctggctcgctgacacaggctcaggcagttggtgggatgcttggaatgaaatccctatccctatgtttaaattctagctccaaaatctgggctcctgaccacaatgttagaggtgccttccaagggcttttcactaattgaggatttcaaacaagcctgagatgagagatcccacattcagccttgagcaactgagggttgacggttgtgtgtgctgacatctgtctgtctacctgttgattatgtaaagtagtcgtccacagtttcctaaatcgttaaatatccacaaatctgtttacacacattaacggtagttactgctttagcaatcaacttcaaatttgaataccattaaaacacagaaaataaactaaaaaccacattgggaagatgcatatttctgtttttttgtgaaactggtgct

SEQ ID NO: 213494 - DNA, 420 bp, Homo sapiens
ttatatttacgactacagttaaacatataacattgattgaaaaattgaaatgctttaataagggaatgatggaagcccttcctgggaactgaggggccaagtcctcagaaacctgccttactgttctctgaaagtgggtttcagggagttcaggtctctgagatgcaacatagagtgttggttttgatcagagctgctttggaagatgcaggcagctggcacatcacaacacagcacatgtttaaaaccctgaaggctgagggcggtggcttgagcttataatgccagcactttgggaggccaaggtgggaagatcccttgagtccaggagttcgagaccaggcaacatggtgagacctcatctctacgaaaaaatattttttttttcttttcaaaccctgcatgtggcatgtgatgcaa

SEQ ID NO: 213495 - DNA, 461 bp, Homo sapiens
gccttcagaatcacagcagattcagagagactacagtgatgcctagtggtcagaacaaatttatagacaaaaaagggaagtgacatacagaaatcggaagtaaggcataaaaacagctgggttggttacagctgggcgtttgccttttttgaacacagtttgaacactcagctgtatatgagtggttgaagtatgactgctgggattggccaagactcagctattgttacaggtgcatactcctaaattaggtttttaatcttgtccacctatcaagttaggttgcagttcatccacaaggactcaaatattgaagtacagactccttctcaggccatgtttagttcactttaatacatcataactggtaattgcagctctaggtcaggttgagaggttggagacttccagaatggtgaagtaataaccttccaaaaatccactcttaagaatacgtggcc

SEQ ID NO: 213496 - DNA, 461 bp, Homo sapiens
cagattgaatgaggtgaatattaaactgctttaaatgtactcttcataaagtactaattacacactcccaagagagaacagccaaggaatactaaacagtagagaagtcaacagagggttctttttatagtatgttgctgggctctgtgtttttctgtctccttctttctcgctctctctctttctctctttttttttacagtaaaatcacagcacgctaaagaatacacatttatagcacaatgcttctcatctaattatatggcaatcattagttttaagctggatgcattatattttctttgatatattatgcctaaggcataactctgcatttattgttgctactggcagattttagctcccccacaagcccccttttccaaaccccaactactttctaacccccaccttttaacaaattatttaacccctatgttagtttgcttattgtgccagaa

SEQ ID NO: 213497 - DNA, 499 bp, Homo sapiens
ccttgttcagaaagctgtgggaggcaagagtagttaagttaggaacagctgtctggagctttacctcttgctttttatctcagccgaaagtaggtggtgattttttatatgtctaatgcatatggtataaactagcatctgataactccaaggtcttctaatatgagcagctggtttctctttagttagccctaagaggcctccgaaataagtcctaaaagtcccccaaataagaacattcctctcctgaaaaaaaaactttgttgaaacgaaagtattatatacttccagcactgatgaatgtttcaattaatatacttttaaaaataaattttagactttctttgttatagaggctgcttctcttaaaagccttctcttggccaggtatggtggctcatgcctgtaatctcatcactttgggaggctgaggcgggcagatcatgaggtcaggagatcggggccatcatggctaacatggtgaaaccccgtctctact

SEQ ID NO: 213498 - DNA, 469 bp, Homo sapiens
tgttattaaacaaaaatcctactggtgggggttcctgtgagtctcatttattctttacccatctaaagaatgactttttctttgtcattggcattagttgcaattatgtagtcatgcctgggtttgtagagcctcctatcctcagctctaatgtgagggagaagtccctctctagagttaaaagtgtagtgtgattccctccagagcttctcctgtgtgtttactcctatacctgcacatctagaaataaacccttctgttgtgtagcatttttgacataataatagctttagtaatagattattaggcctttagtcttttacatttaggttgttttcagcttttgatgacatcattatgaacaacggcttggaaatccttgtatgaacttcactgtttactgttttgaacatttttctaggatacatatcaagtggaattactaggttgaatggtatgcatatttaat

SEQ ID NO: 213499 - DNA, 696 bp, Homo sapiens
aggtgctttttgtccactctttaattaccagaataaggtgggatgcttactctttcttgtctataactggatgcccctcactttgattttgaaagcttcattgaatatggaatctattctttcagaactttaaaaaggatgtttccatcttcataggtctgtttttttttctgctaagaagttagcagttattcttattggcccatttataatgtatttctttctgtggctttcaagatttgcttgttatttttggttttgtaaggatggctgtcttttgtttattgtgctttgggttcgtagagctgcttttatctgtgggttgatatttgtcttcaaattggaaaggttttgtatgatttcatcaatttgtttcatgccttaatctctcttatttctctgagttccaaatacatgcatgttagaatactttacctttttcataggcagctaaataactatttttttaaatcagtcttttatgttgctgtacctcaggttgggtggtggtgtttttttgttcaatgttggcttgccccaccacgatgaagacacttccagttttccttcctttctggtgctgggaaagcatcccgctgcaatatcttggagctgacccacatcaccattgcgataagagaaagaagggcgtttttgataagcatcaacaccctgggggctcggtcctggtacacc

SEQ ID NO: 213500 - DNA, 399 bp, Homo sapiens
atgtggagactcctgtctctacaaaaaggaaaaaaaaaattagctgggcattgcagtgtgtgcctgtggtcccagctactcaggaagatgagatgggaggatcgcttgagcccagcaggccaaggccaaggctgcaatgagccatgatagtaccaagaccctgtctcggaaaaaaacaaaaacaaaaacaaacaaaaaatatatatatatgaatgacagaaagaaagaaaaaaaaagactaaacagcaaaataatgtacctacagaaacccatgcacatcagaaagacccagtcataaaataaatgaagactgtaacccaatatttaataagctaaaagaaattaagaaaatgacagaactataaaagtcagacttggaataacttagaaacaaggcga

SEQ ID NO: 213501 - DNA, 288 bp, Homo sapiens
ttgaaacagccttgggtcaagccacaaactgagtcacagacatgccaaagaacataccacagaacacgcgcccaggcaaatgcaactcagtgtgaaactcaccacaaaatggtgcttagatgccattagctacttggaaactacataataaatgactaagtggcaactgtatttattatgagtcagaatttataggatgcagcccaagcagtatgtaaagataaaatgttatttatttagagatacggtcttgctctagcactcaggccggagtgctgtttcaaacca

SEQ ID NO: 213502 - DNA, 407 bp, Homo sapiens
cggctccggggctgtcagctgcccgcctggctcctccaaggcctggagctcggacgcgggctctgggggcttctggggcgcggaagcgggctcgcggggagcagtggccgcccccggccgccgcggtggctgtgctcagaagccggccctggcgtcaggaggccgggcgcgcggcgcggggcgcgagttcccctgcccgcctgtgcgccccgcaacgggcctttcctgggccctaacgacagctcgcccgtgcttcgccctcgcagctctcctgtgtccccaaaatgcctttcccgcgtcccccgcccttcagcggtgactgcccaggggactctgtaacgcgacactcagactgccgagcctgccaggcacttcgcggagggcgctaggggccgggacgcggccgc

SEQ ID NO: 213503 - DNA, 462 bp, Homo sapiens
gtcagggattatccaggaatgttaggggctagcaggtgaggcacagccctccagaagtcctcacccaaagatacagcccaggcagaggtgggtggtctgagttacttgttgggtcatgacccaggcttgaaacggattattgttcaaaaaatatgacaggcagatggcattatctctcagtgccccttgaggtgtgctgaacccagggcagactctgtgcaatggcttatgaaggattggcaggcagtactgtcttgccagagcattgtagtgctggacaggagtgtcttgacagggaccaatgagcaggtggagctaactagccatcgtaacacttcaaagcttggtaaacaactcttcttctccgacagcatagctaaatgattcttattctttcctccattttctctgtttactttcatttcatcttcttaattcagtctgtattcccctctacctttc

SEQ ID NO: 213504 - DNA, 402 bp, Homo sapiens
atgatggtctcctctgagacacattttttacaatgtactatacctaaaaaagaaggcattgcctgtgctcttcgaaccatgaagacatagcattatgctcaacctctagttagcaagaagtgcaatcaaacctgtcatgacaatacatttttgtctatgaaagaagcacaagtttaaaaactgtgaaaatgatcaatgatactggctcatgaaggtcctgtaacccagcattgctatactgttggtaaatgtacagtcatggcctttttggaaaacagtctggcaacttttattattagccttaaaacatttacactgtcttactctgaatctagcctcaagatatgaggaaaaaaagaataaacattaagtatcacgtttttgataatatttaaaaaaact

SEQ ID NO: 213505 - DNA, 644 bp, Homo sapiens
ttttaaaaaacaaacattaatggccaggcacggtggctcacacctgtaatcccagcactttgggaggccgaggctagtggatcacctgaggtcaggagttcgagacaagcctggccaacatggtgaaaccccaactcttttaaaaatacaaaaattagccgggcgttagcatgcacctatagtcccagctactcggaaggctggagtgggaaaatcgcttgaatccaggaggcggaggttgcagtgagctgagattgcaccactgcactccagcctgggtgacagagcaagactccctctcaaaaaacaaacaaacaaacaagcaaacaaacattagttagtacacactagttactcttctagttacttcattaacatcctgacatttaattttcacacaaaccaatgaggtatattatccccattttgagcaccttatccaaggttacctagctagtaaggcagatttaaataaagaaacctcaggtaatctcattttcctcctgcttttgtcaagaatccacaagtcagtagttagactgcgaatagcacttaaacatacagatttcactcatttactgagcacctgctatgtccagcatggtgccaggcactggggataggaaaaaaagagacctagccca

SEQ ID NO: 213506 - DNA, 408 bp, Homo sapiens
aaatatcaaaaggttttaaagcaagaatgtctaaaacagtgatgatgatgtaagaataggtgtgttacccagataccagaagagacttctctgtctgttggagatttaagtatacattttctggccaggcccagtggctcacgcttgtaatcccagcactttgggaggccaaggaggtcagatcacttgagatcaggagttcaagaccagcctggccaacatggtaaaaccccatctctactaaaaatagagaaattagctgggtgtggtggtgcacgcctgtagtctcagctactcgggaggctaaggcagaagagtcacttgaccccaggtggcaggggttgcagtgagatgagattgtgccactgcactccagactgggcgacagtgagactgtctcaaaaaaaa

SEQ ID NO: 213507 - DNA, 531 bp, Homo sapiens
tatcggctgttgtgtattttctttggagaaatatctcttcaacttctttgtcaattttttgttgggttatttttctttttattattgagttgtaagaattctttatataatttgtgaaagtcaccaatgctgtggtagagtcacttacatccgacccaaacaaagtggaaccgggaggtcatgacgaaggtctcacgcttgtatgtctgagataagaactatcacaaggatcttctaaaaactcataagaggctgggcgcagtggctcatgcctgtaatcccagcactttgggaggccaaggcgggtggatcatgaggtcaggagttccagaccagcctggccaagatggtgaaatctcgtctctgctaaaaatacaaaatttagctgggtgcagtggcgggcgcccataatctcagctactcaggaggctgaggcaggagaatctcttgaacctgggaggcaggttgcagtgagccaagtttgcgccactgcactctagcctgggtgatggagcaagactatgtctcatt

SEQ ID NO: 213508 - DNA, 358 bp, Homo sapiens
cagggaatgatgcaaataaatatgaacaggttatcgtacattgtctaaatgtattcacatttaaaatgtaagtaaaaaacaatatgtagcggattgtaatttttcaagagatgaccttaggatgggtgaaattgtcaggggctggcctggtttcccagaataatcctttaaattaagaattctctcattgggggcagtgtatccagaggtggaggaactgaatcaaggatagttttaaaaactggatcatctgatggctgtgtattaaataggtttaattcttttgattgtatttcctgtctgcatctgaggccgtatccactgcagaataataaaatggaggtactggcaactattt

SEQ ID NO: 213509 - DNA, 523 bp, Homo sapiens
cttttgttaggctgtatcccaaagagtagggaaagatctttacttcatgtcagtgggtgataccactattaaaggtaacttgtgtttttaaaacaaaatacttttatcacccagaattacaatttcttaaaaatattgttatgctgaatccctcaaacaaaaatggtttatcaatttctttggacataggtagcagggaagaaaaaccactttaggtaaaaaaatttaaatatacttatggagataaataacccaagatgaggatttcttgaaatataggaaatttattaattgaattaatcttgaaagttaaattatgaatgtgataaattcacattttaaagaattttctctgttaattagctcatatgttcaaatgatatttgttaaataatctcttggaatttctgaatctttagtttatataagattcaaattattggctggttcttggtattgcacattcttgttcataaataatgcagtggttcttagaattgaggcacattgagaataaaatcag

SEQ ID NO: 213510 - DNA, 367 bp, Homo sapiens
atgcatagctcttcccagcatccgcccagcactgtgccccccacggtgttcaggccctggacacacagactagaaagcaggtcagcctccggaaatctccaagctccctgtgactgtgggctggggactgcccttccccttcatcgggccctcaggctgaagctcagaaccctcctgtaaggaaggcttcctggggtgcccgaatctgatgctcgctctgtccccaggcgcttgccttcctgaggccccctgtcccttccccttccaccaaagagcctctgtgggctgttctctctatccaggaagtgggtcccatccttcacctctttcatttctcactcgggagctacttcctctccagtgagcc

SEQ ID NO: 213511 - DNA, 434 bp, Homo sapiens
  misc_feature (426)..(426): n is a, c, g, or t
ctccacagataattacgaaagaacagaaaacaaactctacattgtgtttatgtagatgtatagcaaaatatatacacaaatttaaaaaacaaaatgctgagctaaactctaccaggcaaattcaagaaaagcagggctttgaatgtcaagagagggagtttgatcttggtcctttaggtcatagggagccccagtcaattttaaaatcagaagagccaaatttattttattttatttttatttatttatttatttttagacggagtttcgctcttgttgggagcttaagctcccaacaagataagctttctagagacttttataatttcttacatttttttcccaatctctttctttcctcaactttctatatccattcagttttgtttggtttttttttccctgagagggagtttcgctctggtngggagctt

SEQ ID NO: 213512 - DNA, 353 bp, Homo sapiens
tcgagacctggcagaactgggggagctagtcaagcaggtgtctggggagagggcattacatatagagggaagagcaggtatagaggccctgaggcaggagcgtgccctgagtatctgaggaatagtaaggtgaccagtgtgactgaagcagagagaatcaagggaagagtaggaggcgatgaggctggagaggaaaccagcggaccactctccttacaggttgtattagtccgttctcacactgctatgaagaaatacctgagactgggtaatttataaaggaaagaggtttaattgactcacagttccacattgctggggaggcctcaggaaacttacaatcatggcagaag

SEQ ID NO: 213513 - DNA, 402 bp, Homo sapiens
atggcgctggatattccagactctcttttaaaatattcacatttcagagggttgccctagtattaaatgtccatgaattgagcctgcaagaggagagtttcacacaatttgttaccctccttgcaagcatgtgaagcctctccagaagtgttggcatgagtagattgtctccgtttcattagttccttatgaaatctgtaaaaatagaatgaaattctcagtagcctatccaactgaagagtaatcctgttgaagtacaataaattgctctttggtgaaaatggttcagcttttctgcaactagaagagttaatgggagtctgccaccccctctagagagtggttcacacttttctagccagagagattgtattttaccacgctttttgtccatggatggtg

SEQ ID NO: 213514 - DNA, 232 bp, Homo sapiens
catctgcatccttccttgctctatttttcttcctttttctctttccctctcttctgttcttctacctttctccattagctattatcataatatagaactgagatgtttttatttatgaaatatcttgcaccttaaataaagtggaaaccatgataatactaactacgttgggttcttgtgaggattaaataatatacataaaatgcttagaacaatgccaaggagagatgaa

SEQ ID NO: 213515 - DNA, 567 bp, Homo sapiens
cctgtggccacccagggggaatgtgaccagggccacagggaagaacgtcactgagccagacctcctcacccaaagtcccgtggcaagaactgcccccaggcaggcaagtggctctgcagagataaagtgacggggaagaaggaaggcatgacaaagccacactgaagtcctagcaggaacagggcaccatgaggggaaagttcccaaggactccagattcttggaacaagagcttctcggaacaagagcttctcagttaccctagccaagaagaggcaggggtgtgcagggaaataactgcaccaatgagctcaaaaactgcctttagtcctaaaagcccattctcctcagatgtgccagagtgtctttcagatttgcaaatagtcataaatgcctcctatgtgccaggcaccagccagaaccaggtagacttggtttaaaccttcactcctgtcctcgcaaggtctgtgatgttaaagtccccaagcctcagtgattattccccctcagtatgatgaaaataatatcgtcttgcaggccggacgcagtggctcacacctgtaatcc

SEQ ID NO: 213516 - DNA, 203 bp, Homo sapiens
accagttaggagcaatatagtacctgcatcccctcagtgctcctagggaatgctattggcttctttgttagacctttgaatgtcactgggcctcagtctcccaagtagttagagacacttccattgcctctgtccacagctgagaactgtcacaaatagaaaagactgaatctccaatgccttaaattaagtgaaaacaactg

SEQ ID NO: 213517 - DNA, 439 bp, Homo sapiens
ttccgtcaattaatgctgaaaccattctaggagatattccatattcccagtttcactgagaagggaactgagtctcaggaaagttaaactaattgctcaaggtcacatagctcatatgctgctgagtagaaatattgaacccagatttttctcccaaggccaaagattcttttatgagagaggctccctgctagcattcatccaactaggaaatgaaagatgcatgaattgttatttcacacacatcccaccactgtctatgcttctacttcctccattcaacaggcaaagccaatttggtgcacatctgatgccttgcttgaatttcttttggaaggcataaacgatgacgttagtaccaactgttttgagcagctgcagaaaatcattaacccaaattgctcattacacctttatagacaccaagcaaatctgcctg

SEQ ID NO: 213518 - DNA, 396 bp, Homo sapiens
ttgagcctgggaggtcgaggctgcagagagctgagatggtgccactgcactccagccagggtgacaaagggagaccttgtctaaacaaaaaaaagaaagaaagaaagaaaaagaactagaaatgcaaactcaagcccctcctatccccccagacctacagaatcagaattactgagagtagagctcaggaatttgtgtctaaccagctctccaggtggaggtcaaaggaaacggtggaaaaaggaagctaaagtttgagggaaaactgatctaaccaattttatttacagatatttggatatttatataatttaaagatctttgagcagaattattccattgctttaactcactcaacaacccttccctacatgaaacaaatctcattattggtta

SEQ ID NO: 213519 - DNA, 924 bp, Homo sapiens
agatgccctctccttgtctgtttactgaatgtgtttccagcttgcagagtgttactttcaattctgcaaagaggaggtggggagggcagcatgcactaagatgttcctccccgcatcccactaaccccaggaaacagatggtaaaatgcttaagacactgctgcttccctcagcacccttggtgccccaccccccagccccagacttggctccttctctcctaaggctgaaatgcaatcagcccagatgggctctggcagtcaactctatccttctaactctgggcaccaagcagggtgggatgaaagtctgtatttagtcagctattttccttcttcttcccgcaaacttcccagccttcctcaatcctcttaaacttgtgttcacattccttttttaatactccaagtgccatttctcaggctgtagcttaactcattctacatcagtctgacagcaacacattcctcctgtgtgcagggttctggaccaggcagggagtgattgggctggcgggggaggtcatatgctggttaacaatatatgaatcccaccctggtactcacagttgatgggaggaaacagacttgcccgtctataagcccagtgtagggagaagccccatgtggctggagaaccaagtcagggctggggaagcaggtggcttttatggcagggcagctaatgggtctcaggcattctcctttctgagaaggtgaaaggcactcaaggaggaaatgcagaagcaaaggcaccatcagaaagagccaggcatgtataggcaggaaccagtagatacagagcctgggagataaacctgtgaaggcaggtgggggctgttcgtggaagctcttgaatgtcaagtggagactgatctgaatccagtgagcaatagggagccattgaagatctatgagctggggg

SEQ ID NO: 213520 - DNA, 666 bp, Homo sapiens
accacagtaagacctggcaaagtgatcaaacatgaacacaaattgttataggatcaaaactgggggaacaactctttttttcttggatggggttatggtcaaggaaaattcaggaaggaagaggtgtttaattaggtgtttgggggatgagtagaggttcatgaaagggaaaaagggcattagaacttttgtggtgacaaggacaaacttagagctctcctcctataaccccaaatctcaggaaagccttgggttgcggcttactttgatttaggtcttgaatcacaccatttttgttgggtttgtctttctacatgtctttttgcctttgaagtgatccagacaagcttagcagtggggtttgtaaaaacagtgtaataaacattgcccatttgccaggactgtcctctgtgtagctctcttgggagtctgtagaggccgtaggtggctggttaaaggctggggatttgggattatcaccaaatggcctccttgaagatacagcacacaaggacaatccagaaagagggaacagcataatcccacaatattttgtttgccaaatggaaatctctttagtgacaaacatttaacttagcaccaggtgtgaccttcagttatgcaatagaattgtggatcagctaggatgaaatttcttatttccct

SEQ ID NO: 213521 - DNA, 521 bp, Homo sapiens
tgagatgaagattagtgggtaggagatttggattgccacctgtggaaagaaaggaaactccactgggtggaggaagaatatggactatgatgcaatctcaaaggtggccttagctgacactaaggggaactctgaagctaggatggtctttcagattgttctaatatggggcaatgggactagtctttgcatgcagcctggcccaagaaggaagtgtgacttcagatgaggtggctcttttcacttaagagggcaattctactgacagctgagggccgttgggtgcacactgccagagcgagaaaacaaaatcctctgtagggaaggggactgtgtggcatatcacagcacaccccgagaacaagggagcggctcttcatcaaataacacaatatgggcccacatattcccagaggctgctatagtgctgggcacattagtgctcaataacttattgaattagtattatcatattgtgctattgccatcctcatcttttaaagtcacttatcacttaatgg

SEQ ID NO: 213522 - DNA, 463 bp, Homo sapiens
ctgagatgtggatctgacccaagccaggtcaatgagacagtctggccctttgctaggatgacgaggaaagacaggctctcttcccattagaattgttaacactggtggccatgttgccttcaaaagggaagagaccacccaagatttcagtttacagaaaggaaagaaaatatgacagagggagaaaaaaactgtgataacattgagcaccacacttggagccagtgctacccctggactcataagttcctggagagggggactttgcttaatatttttcaaatctgaatcccttatgcctagaacagtgcctgacacgaaggaagcaatcaataaatatctgttgaataattgagctgataaattccttttttgtttttcttttttgtatatgtaactggtttgttggaagtctcaattcattggggagtataaataaaaagtaactttatttttcccagta

SEQ ID NO: 213523 - DNA, 278 bp, Homo sapiens
agttattcagggcctggaaaaaaaagtcaatagcgctcaaactggtagcttcaaacagctcacagtcaaggaagctgtgttgaatgtttcagaggtcactggggtgtggatgtggttttatgtcacagagatcataggtgagtgtggcatcactggctacaatgtttgaagatccatctttaacatttgatttatatttgatttatgatttgactgttcttagaccatatgtgatcagactactatctgaataaaatgtgtcaaaaattttaaattta

SEQ ID NO: 213524 - DNA, 521 bp, Homo sapiens
caaactctggaccttgtaatctgcctgccttgggctcccaaagtgctgggattacaggagtgagccaaagcacccagcctagccaccacttcttatgcaaatgcctgaagctggcacatccctcacccagatccccccacctcacccccaggaacagcatgactcagtgagcctgggccctacccaggcgtctccagggagcgtgggccaaaaagcgtggatgccaaaggcccatgtcggagaggctgcaaggccagaaggttcctccaaaactctgccggtcaggtacctcacagtgacagaattttagctggggaggtgcgactccccagagggtttgcctccccttgcgacaccccaagtggcccaagcctcctttccctccaaggagtctagaccccgcggcccgagctgggaggaggccagctggtgaacaagtgtcctttgtgcttgcagcaaggaccccacctcctctccgcacaccccagccagggcagccccactctgtccatccctgaggt

SEQ ID NO: 213525 - DNA, 570 bp, Homo sapiens
ttgtaagacagtacatgtcttttggttttaaattttatttgcatggtgaagccttggagaattttctgagggtatcagagaagaaactgttggaaaatccattcaaatttaaaatgatctaaaaattaatcaaaatcattacattcaagtttcaatatatttccaaaattttcattttattacacatgtcagtcatctatacagataatggaaaccaaattggggggaagaaggttttcttttttcaataccaatcattattttgttcttgaaacaatgaatgacatgaatttcagtaactgatttttccaaggatttttggactcaagtttcatatagtctagagatactggtgagtagcaggtggtttgtatagagaaaaatggaaagaaaatgaaacataagtaactgcaatgtaggtggagagacatctttaaatggtgggtactcaatagagtgaatgtaccttcataggttactttgtaaactaatcatgttcaaaataaaagggacgcttgctaaataccaaattatgaatctttttaaaaaaacaaaaaattctttcctaaa

SEQ ID NO: 213526 - DNA, 177 bp, Homo sapiens
gcgccccgtctgcatctctgtcttcatctgcctgtgtctgtctttactcctgtccctctgtctctccatctgactctctgtgtgctgcgtctcccctcaactccttctccttctctgcccctccttcccttcctgtccccatgccacctctggctctctgagcgtgtctgcccccag

SEQ ID NO: 213527 - DNA, 447 bp, Homo sapiens
atgctacatcacaaacacacgcaccgcacacatcacacacacaggccaaactcctgacctcacacacacaccatcacacacatcccaatcacatctcatagcccaatattgtaagagtggtatcctagatcctgaatttcaaatgccatgagattagtatgaaaacagaatctgattttcttattttctatttatttgttttttgagacagcatctcactctgttgcccaggctgcagtgcaatggcacagtcacagctcactgcagcctcgacctcccaggctcaagcagtcctcccacttcagcctcccaagtagctggactacaggcatgcaccaccacaccctactaatcttttttaattttttttttggtagagatagggtgccactgtgttgctcaagttggtctcaaactcctgggctcaagcaatcttcctgcctcagc

SEQ ID NO: 213528 - DNA, 629 bp, Homo sapiens
gtgttttgatggaaactaatccatgatttagggtaaatggagttattgtgcatgaccatgtggaatatgttatcaatatgagtcaatcagaatcactaaggtggtattaaactgcttatatgtcttgtttataattagttgtgttattgtctttgttacttgacttccatattacttaactgttgatgtggttaatcagaacatgagctttttgagggtgaattctatgcccatatctctcaaaggcctaaataggaatgtttgcacacaatacttaaaatagtttttccactaataaagatttctgatacagattcaacatactataaaactgatttcaaccgggtgcagtggctcatgcctgtaattctagcactttgggaggccagggcgggcagagtgctttgagctcaggagttcaaggccagcccggacaacatggagaaaccccatctgtacaaaaagtacaaaaaaatgagtcaggtatggtggcttgtgcctgtggtcccagctactcgggaggctgacgctggaggattgcttgaattgggaagtggaggttgcagtgagccaagattgcgccactgcactccagcctgggcgtcagagccaaaccctctctgtcttta

SEQ ID NO: 213529 - DNA, 190 bp, Homo sapiens
acgaacacgtttagcacacatggaaccaccataggccctgctgacatgtttctttgttttggacaatctcataagaactttaggtcttacagcacgaacccctcgaagtcggcctgggtacacaccacatgcagattttggtgctttcccaaccttcttggtataaaggtgaacaattctattaccaggg

SEQ ID NO: 213530 - DNA, 370 bp, Homo sapiens
ctgtgccgaggcctcccaactccagctgcctcacagccctacacatccaaggcttgctttaaatctcctaagtcctgaagaaaatgaagacagaaagaacagcacctactttcaaggaaaaggaggccacgcccctcagcggcttcaggagcccagacctttgggggcccaccttccgcagctttccattggccccacggtggaagcccgtaggttcaggccctccgaacacagctcgctttccacaccagcggggccgtaccagagcaagaccatgtctcacaaaataataataatacttaaaaaatggtaaattttatgttatgtatattttccacactataaataaatatttgtgcatgtatatata

SEQ ID NO: 213531 - DNA, 462 bp, Homo sapiens
tggaatgtcaatgcccaataaaacaaaattgtataggtttacgtcaatgtcagggcatcagctttcctcttgtatgagccctacaaacattttcacaaaaagacatcctaacaaggaagtattcctctgcagctacaatctgatatttactatactataccttgttcaacagattactaggcatcatgagttctgaaacaaaacataaacactttaaaaagttatattgaatacccttttagaatgttatattttcaccttaagaatattgtggtggaaccagaatagtctcaaagaccagttaaagcaggggaccccaacccctgggcaatagaccagtactggtccgtggcctgttaggaaccaagctacacagcaggaggtgagcggcaggcaagtgagggaagcttcaactttatttacagctgctccccaaccctcgcattgccacttgagctccac

SEQ ID NO: 213532 - DNA, 426 bp, Homo sapiens
gggctgctcagcaataaaaaagaatgcactgccagttcagcaacatgggtaattctcaaatgcattatgccagttgacagaggtcagactcaaaatactatgtacagtgtgattctacttatatgacactgaaaaaagcagaactataaggacagaaaacaggttagcggttgccaaggagtgggagaagcagccagggagaactttgaggagatgaaaatgtgccaggccttggtcggtggtggtacgtaactgtgcatttgtcaagactcagtgctatatgctgaaaagggcaggttttactataagtaagttgtacctcaataaacatgatttttaaatgattctttggtttttgtttgttgtggttcagttttaaggtttcccattctattggttttagattctaagttgtatataagcttc

SEQ ID NO: 213533 - DNA, 227 bp, Homo sapiens
tgagactccatctcaaaaaaaaaaaaaaaagccttctttaaaatctaaccttaaaatggtcaaattcgtcaataggttagacctaggcaaaaggcaggtttttttctttcttatatatggggaattagccccatcatgcgaagggggttcagttcctctttccgttggagagaacctctttctgaaagtgagaccgcatagcggagcagttcaggtgtactttactt

SEQ ID NO: 213534 - DNA, 395 bp, Homo sapiens
caacgcatctttctgaatgctaagcacattgcgatagcatcacccctgagtagtactcagtggaaaaaggtgagcacgtattggagaacattccttgtcagacaacatcgaggcagttccagagttggggtgggtggggcactccccatgcagggagaaggcaagaatctgtccacacaaaggctcttaaaggcctccagtcaagaaaagttactcagccccagtgtgccactgtgggagcatcctcattctctctgtagaagccggcccacagtctggcacacctgttttctgttcatggtgcttttacaaaaatagtagtcagtgggttttttttctgacttgaaaaggcatctatgctcattaataattattcaggaaagcaataacaacaa

SEQ ID NO: 213535 - DNA, 420 bp, Homo sapiens
aacacagttgacactcctgctccaaggcaaatattgtctcttgtttgagagatacatttaagtctgtccaaaatatgataaaaagttccagaagtgcagtcagtttgaatatttcaccattaagtagaaaaagcttaaaaccatcaacataaatgacagagagaagaaaacagcaagagaaggagtttctgccataagtcaggtggaagtgtttttgtttctttattcaacactgacttttgatgtcttaaagtgagtctgatttgacaaggaagataccagagaatagaacggagacatgtggaggaggcgagggtaacatttttctgtgcactgcctttcttggcatgacctttgtgagggaaagagggaggaaaaatgtgtgagacagttcggtggcaagtgaaattactgtgttta

SEQ ID NO: 213536 - DNA, 517 bp, Homo sapiens
agatgtccttgtccttggaaaagtatgccaagtggcaggactgactgttgaactaaagtctgttttcatttgaagagtttgtgttgatccactgctggagatagtctcagaatttgaagaaatgtgtttgctgtttgtagttagaaatacataattggctccagtgaattatgtgtgtgacctaattaaaactaggatcacctgtgtgttttccagaaaataaattccttttaagtgtgctgacaattaagtgccttaagtagctttaatgctgtgaggcataattccatgttataagatggtaattcatgtcacttataattaatactcaacttgaaattgccctgaggattttatttctttatcatgaagaaaacaaataggcatgcttactttaatttgtcttgagtggaaaaaatacgaatctacttgaatttaaaatccaattacatttataatatattgcattaaatctttccctgttatccattactatgtagaagaccctaagattcaa

SEQ ID NO: 213537 - DNA, 533 bp, Homo sapiens
caggccttgcagcttcctactgtggtgagtgacttggacgaggcatctgggtaaggacccctggtggccactgtgaggataaatttgtggccacttggaggcctgcaatatattttctttcagtctctaaaagaattaagctatagttctgtccaaagtaaatttctttactatcttttgttattgttgttattaataaaagtgcacatggggacaatgtggaaaataaatacatttcttggtacatctactctttagcatacatggcccccattaaaaaaaactcagaataaatcaagagttttagaaaaaggaacaaatggactgttctttataaaacaagatacctttattgttgagaatttagaaattacagattgaacaaaaaagtatcatgattaatgccaccacttagatataagtatcgtaaacgggctgggtgcggtggcttatgcttgtcatcttggcctcccaaagtgctgggattataggtgtgaaccaccgcacctggcccaaactcgctttttcttttg

SEQ ID NO: 213538 - DNA, 1089 bp, Homo sapiens
tagctaatgggatgaggcatttcaaggttgaacttcagcaagagcaagtgggataaagggcaaaaagcagcacattcctttcaaaatgtccccattttaaactgcaggctagagtagacaatggaaatatatgacatataaagaaactggtgagattattaagcagagggccttctggggagcattaaagagtgagcaagaaaaatttctcagacatggtgattctagaattgaaaaatcatagactctttctcttctctctcctttgagagtttccagatgaattcttggatctggctactgagcaaatatatgaataataacctaggatcagctgggtataagaggtttccaccagaagtccatgaaaaccaatgtttttaagcatctattgggcaactaccataaacaatcagcaagatgtttaaacagttgattctgccggcggcccaaccagtttttaactgtatcacgaaaactggcctgggggtacagtctgagattattccagccctgcttttacaccgccagaaattccctttctgttacaaatttctaccccagagaggtttgcatattcttggcattttcactgtgcatcagtgaatcagctagcctacgggccaaggagaggggaaaaaaatcccaaataaaactcaacccagttaggatgtcttcatctatttttcagtgggaaaaaatacagctggactcagtgacttcagtcaaaagcaaacattactagttgcttcatttttctaatttttatttttgactctcaagttttggagggcataataaagacatagcctcagcaaagtcacttagaagattgagttcgttattttgcaaagcttgggtagtgacacttctgcaaaatgcacaagcacatgagcagagagatgtgtgaattcaggaaagcagccaaatgcacatcagagctgaggaatgtcacagcgaaatgaagaaaacttgtaaacacctatctgtatttttaggtagagaatgttctaacatattgccaatgggtgctgcctgtgtgttccttcccctaagctttaaactcaactgatattaaaggtgatttga

SEQ ID NO: 213539 - DNA, 634 bp, Homo sapiens
caggctggtctcaaattcctgggctcaatcaatccgcctgcctcagctcccaaagtgctgggatcgctggcgtgaggcagtgcgcctggcctgtagttttattctcgtgtatttacatagttattgcatgccatgtccacgtaagtgaaactacaatccccagtgttcctgcactaagagtaggtgactgaggagacgaatccacagccacagcctgtctctgcccagagggaacagccactccagctctgctgtattagggaagaaaatctgtgtgagcacttacgtgcaaggctctccctatacaagggagaccctctattttccaaacaaacttcaccttctattcagtgataagccacacattttacaagatgtggctgaggctgggcgcggtggctcacgcctgtaatcccagcactttgggaggttgaggcaggcggatcacgaggtcaggagtttgagaccagcctgaccacacggtaaaaccctgtctctactaaaaatacaaaaattagctgggtgtggtggcgcgtgcctgtaagcccagctactcaggaggctgaggcaggagaactgcttgaacccgagaggcagaggttacagtgagccgagatcgtgccactgcactcca

SEQ ID NO: 213540 - DNA, 106 bp, Homo sapiens
cagactgcgtgtgtgataagctcatggaggctttttggggagcagtatcaattgctgccaagggtttttgctataacctataaagccattttgcatctttcttacc

SEQ ID NO: 213541 - DNA, 417 bp, Homo sapiens
agtatgctgccttaaaattgtttttaattaaattcttttttaaaaattacaaaagtaatatgtattcacttgcaactagtgaagtagtacaaagttatataaagatagtgttaataatccccctgtttctccaagatagtgttagcagccgagggtgtattcttctatacatttatacacatatagacataaatattcatatataagatatataaggggttttgtatgtggcttttttttaatttaaaaaatggcattatattgtacatattactgtgtagcttatggacacccctccaagtagttacagatcaaacattgtatatagctttgtttttttgttttcttgttttctttttgagatggaatcccgctctgcactctagcctgggcaacagagtgagactccaaaaaaaa

SEQ ID NO: 213542 - DNA, 353 bp, Homo sapiens
ttttgagatagtctcgctctgtcgcccaggctggagtgatctcggctcactgcaacctctgcctctcaggttcaagctattctcctgcctcggcctcccgagtagctggggttacaggctcctagcaccacgcctggctttttttttttttcttttgtatttttagtagaggtggcttttcacctgttagccaggctggtctcgaactcctgacctcaggtgatccacccgccttggcctcccaaagtgctgggattacaggcgtgagccaccgtgctaaaccgccttctattaattctatctgcagccacaagtccttatataatccagacattcccttctgtcgtcttctc

SEQ ID NO: 213543 - DNA, 773 bp, Homo sapiens
tgtagtggcaggcacctgtaattccagctgctccggaggctgagacaggagaatcacttgaacccgggaggcagaggttgcagtgagccaagatcgtgccattgcactccagcctgggcaacaagagcaaaactctgtctcaaaaatatatatatataagattttaaaggacaaaatctgtacaagtggacagttactctttacctcagttactcttgcctgacattatctgccaaggcatcataaaaacagtatgtgcccttcaaataggtttaataatactaggcttacaaaaaacttccatactgtgcttacttaaaattatgctcaatgtatgccaaatgcttaatcaataaaagaaaaactatgccatacaaggagggaagagggagttattaagcaagggagttacttagcgggggagttccagtttagcctcatagcagtttagtctaaacaaattttttaagttattttttaataggcttagcttgaaaacccaaaaactgtcagctggcttacagtttaaatattaaaccatgttatgtttattactgaatctattattcaaaaattatgtactatcctagcaccaaaaatcaaggaaactgggcacttctcatatgaatgaaactaaataaactgaagtcaagagaccacaaacaagaatatagttaactccaagaaaataaaaatttctgcctttaagacagttattggccgggcacagtgctcacgcctataatcccagcactttgggaggccaaggcggt

SEQ ID NO: 213544 - DNA, 560 bp, Homo sapiens
ttggtgtaaaacttgagacctttagagaaggagccctttgagattcctcttagaaccacactgccatcatcctctgcctcccttgtgctaatctcttctgactccatgactcctaaatattcttctggggaaaagcaatattttgaactgagcgacggtatgagtttcagatcccagcgtaaatcctgacttgggtagatgaaggtacgggatgtgttatactcagtctcatggaatgtcaactctgagtgttagagaaagtaattcttccatagcaaagtttctgaaaataataggactcaagaaaactcattgagtccaaaatgttgatttcagcaggaacaaagcaagtacaacctgaccccaaaggggaatcaattttaacaaacgtgtggaaacagtctcagaacggaacacatctgagttacttgtaattaattgactttaaaagtcatgattaaaacctatccagtggcccttaaaaaactgactcagtaactttgaaaataatctctgtattgacatggttcaggtaacggaccctcaaaatggaagtgtta

SEQ ID NO: 213545 - DNA, 346 bp, Homo sapiens
cgcacccggtctccccctctttgacgcttcttggcagctgtagtctcccccagtcctggccaccagctgcccccacccgtgagcacctgcccctcaccatgtttggtgctgccaggctttgtggagtgcctttgtgcacaggagtttggccttttgacttcttccctgggagcttaaaccatcgatcagggccacgaggtaggcgctgggaccttcttggacactgagttgcctcttagaactgccctgcccctccagccacaccccaaccagcgccggctgttcgtttatttttagagatcattttatgttctgaaaagactagaaagtggtaagtcctttcttc

SEQ ID NO: 213546 - DNA, 364 bp, Homo sapiens
ttggaaaaatgctgaagtgtggacaaactggtggtagatatggcaatgttcagggaacctgtcaaaatcaaggtattgatcaggcacagtggctcacacctgtaatcccagcactttgggaggcagaagtgggtggatcacaaggtcagaagatcaagaccagcctgaccaacacggtaaaaccccgtctctactaaaaatacaaaaatgagttgggtgtggtggcacatgcctgtaatcccagctactcgggaggctgaggcacgagaatcacttgaacccaggaggcgaaggttgcagtaagctgagattgcaccactgcactccagcctggtgacagagtgagactcagtctcaaaaaaaa

SEQ ID NO: 213547 - DNA, 534 bp, Homo sapiens
ccaacacacagaggactaaagcagagacgatgaacccaagttgatgctcaaccctgctacctttggcaccctggttggaaagctctgagggcatgctgcttctgtattctcaggcatgctgtatgggcactgccagccagcttcagagatgggtccaggtccttttagacatgttagttgatgcccaacctctagggacacaatttctttctgcagtggattcatgacctaacctgggcaaatgagccttgagaggacatatgctagaagctcatggaaaagaaactttcttgcttttctgaaaaagctactgagagagcccctttactctttctacaggatctggaggaggaagcaggcaggccctgggtctactggcaaccatcttgtgatcatgagttgagactatattaccaggaaatgatccctacagaaggcagagtgcagagaggaagaaaacaatctgaggacattattgagtgctgtattaagcgcagcaaattacatgggccaataaataccttttctttctta

SEQ ID NO: 213548 - DNA, 224 bp, Homo sapiens
gcctgggtgagagagtggaccctgtctcaaaacaaaacaaaacaaaaggcaaaatgctggacaaagtggctcccaaaagaagatatgtgaagcacatgggacagaaggaattttaatctttctaaaaatatatatttttcctttttttttttcattgtcataattccccaaagaactttaatcctggacttctctcttcctaggtgttctggcttgcgggctcc

SEQ ID NO: 213549 - DNA, 712 bp, Homo sapiens
gctggtgggattgtaaaatgttgcagtgactttggaatatagtttaatagctcctcagaatgttaaacttacccaacaattctacccctagttatatactcaagataaatgaaaacatatgtccactcaaaaattcatacacaaatgttcagggcagcattatttataatagccaaaaagtggaaacaatccaaatgttcatttaccaatgaatgtataaataaaatatggtatgcccatacaagaaatattaattagcagtataaaggagtgaggtactggcacaggctacaacatagaacttcaaaaacattgtgccttgggaaggaaatcacaaaagaccacatattgtatgattcaatatttaggaaatgagaataagcatatccgtagagatagtgtgttaatggttgccaagggctggagaagtagagctaaaggttgtggggcagactctgtgaccgtgcctgcggtctcaactactcgggagtctgaggcaggtggctcacttgagtccaggagttcgggctgtagtgtgctatgctgattgggtgttcactcgtgccgaattcgggacgagcacaggtgtaagctcgctaacaggttcatcagtagctgactagcatagttgagatcccctcctaatgtcggccaacgtgggcagggggtggttcccaccctgggcccaggaaggtgttgccggacggcaggg

SEQ ID NO: 213550 - DNA, 474 bp, Homo sapiens
tgctgccttgaacttcctacttacttcattagcagattgtcaggggagatgtgtcagctatcctgggaccccttggcggggcggggggggcgggggcagccccctccccagctctgtactctggggccctcacccctgaatcctgggaaagcttagcacctaagagtaatcctgccggcttaagaccctcccctgctggggtttctttttaaggacccgtgtgacaaggtgctgatgaatcaacgttatcacctctgtcaggaataataagtaaattttttgagagtttatgaaatgctgggaactaagttagcatttgcttgcatgatctcattatatctgtaagacagcatttctgaaactacttgctacaacccatagtaaaaactatatggtacgccatgacccaggacacacatgtataaacatcccataaaactgaagcaaaagttcccagaactcatacaaaacctt

SEQ ID NO: 213551 - DNA, 463 bp, Homo sapiens
acagaataagatgaagtataaataaataaattctattaaaaatataaacatataataaataacataaatattcaacagtaggaggataagtgaataaataatagaaagtccatttttgtagagacagtgttttgatagaagatgctcatgatacaatgttaaattaaaaaggtaaaaagcaagaagtgatcctactttggttttcaaccagcaggctgtgcggcttaatatatttactgctgttcttagtgcacaaaaggtacttacttacttttaagaattttttaaagtacatcaaaatgtgcatgtatacacgtacatctgaatctgtatcttcatatgagttttgaataatgctttgacctgagacctgagacctgtagactagtataaattgagctttaaatccttacagcgacctcagggagattttattaccaacttgaggtcataattgtcttag

SEQ ID NO: 213552 - DNA, 213 bp, Homo sapiens
gggccctggccttgtcctcccactgcctattgtgggccacccgaggcctccacactccccgtcacatgacagcgcccaccttgcagcaatgtacatgaagggcccagggccccctttcctcctgtgaggcccagcatgctgccagacacatgcgaggtccttggtcagcacctcggggtcacaggacctgaggcctctctctggattctgacc

SEQ ID NO: 213553 - DNA, 153 bp, Homo sapiens
tgtactatattaaatttggtcttactagattttgactatttggggttggacagcatggtcccatatagccataaaattggaaactgaaggccatttcttacttcaatggtgtattgaagccatttgaagactccccgccccccattctttttt

SEQ ID NO: 213554 - DNA, 501 bp, Homo sapiens
tccctgactcaagaagcatcccatctggtcaagcatggggggacatagctgatagcctagcttcctcggggataagaagcaggatgacctggatgaccctccccaggcaaacgtgtctccagagaagtgaagagacactgaaagtgagggggagagctgacagcagcagaggtcccttctaggtggggactgtgcttcaccaggactgctgtctaccttcagccttgtggactccccttggtggatctctgcacagcctctgttgtcctccatttaaaataatgaggctatttaatacttcatgctggaatccccaaattattccaacatacaaaaaatctttgaagtccctaggaagagattgtatacagcctcaattttaatggaaaagggggctaatatatatatacagtgttttggttttgtataaaaaataagtcaaagattgtccaacagtgagggtagctttttttattctgcactatggagtgttgagttcat

SEQ ID NO: 213555 - DNA, 271 bp, Homo sapiens
ttttttgaaaaagtaatttcaacttttagattcagggggtacatgtgcaggtttgttacatggtatattacgtgacactgaggtttggggtacaaatgaccccatcagcacaccatggaatactgcacagatataaaaaaggacagtggtggccaggtgcggtggctcacgcctgtaatcccagcactttgggaggccaaggtgggcagatcacttgaggtcaggaatttgagactagcctggcagacatggtgaaacccagtctccacta

SEQ ID NO: 213556 - DNA, 173 bp, Homo sapiens
agggcaggccccaccctcaaaccaatggtttgtctatgggcaggaggggtgattctcacttcaatgtcctgtccattcaccaccctacatcctggacatctcccctggatgccgctcgggtgccccaactctactctgatccctcaaactttccccgtcactgcacagggcca

SEQ ID NO: 213557 - DNA, 453 bp, Homo sapiens
tccggtttctccccatttgtatctctcctcccatttcagagtccttccctcccttggcttatgtactagggacttgatggccccttaaagtgtgctgatgatattcagagggcaagattttgcctgcacctttgttctcttttgctcctgcaaggctacttgtggatcagagcccttgatcccactcagaaaggaccccatcaatgagaagcttttcagtggtgtgtcctttcacccggacgtcactcatatctctttgtcacttgttgtgtatgtcaccacgcagtgatacacccctgaactagatctttcaggacagctttggtgacacgaagctgccacttgttgttgttctttttctcctctttctttcttcttcttcttcctttttcctttcactttcagctctctgcgggacaaatgttctatcgagactgcttcttctgctcattg

SEQ ID NO: 213558 - DNA, 438 bp, Homo sapiens
cacacatttaaaaatcatcatagaaatccccaagaacatcagcatctaacctaggaagctacgggaggactgaaggctgatgaactgactagatggggctcagggccctgcagcgatcctgctggcctgccagccactgaaccgtctcaggcagcaaaggaatgggtatgagtgctacgctagattctgtatcatctcaatcacacgtgtgtttagtttcaattaagcatttgcgccaatggcactgggatgactaaaggaacacgcaatgattctgaggaaggcgtggacctacccaggtaagaggtcttgggctgggagtgggggagggaaatccctttcagtactaggctggccaagaaccacagacctcaccaaacaagccatggggccaaaatgctggacctgctctctctgcttctaaactacacatgggtt

SEQ ID NO: 213559 - DNA, 477 bp, Homo sapiens
cactccttcaacccaaaggcaggccagagtcatgtagtgccaaggcactgtatttgtttcccagtacctagaaatggcctgcacagaactggcactgagtgaatgctttggtgatgcttttaagagatgtttggtggggtttcaggaaattggactttaacatggctgaccacattccttctatctgctcactacatatattgtatatgtgctgaaaatgtatctgatttctttccttcctctgttgtttagcaaaacagacaaaagtgcaaacttagagttggagggtaacctccaagagaaaaacaggctggtcagtgtcaaatacaagattttaaaatattttcttaaacattaaacaaatacttcaaccattgagaatcattctaaagaaattgtctgaaatgtaaaatgtatcaagatattaattatattgttgatacaagataaaagaaaaattaaatgtcccaaaataag

SEQ ID NO: 213560 - DNA, 454 bp, Homo sapiens
cttattcctttttttttcagctatagttcctttattaaaagaacgagatgaaaaaatagactttgagaaatttttttacctcaattttacaaatactgtatcacaaatgttttgcaatacaaatttaaatatagcagctttccactttcttaaaagattcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaa

SEQ ID NO: 213561 - DNA, 525 bp, Homo sapiens
accagtctgttttccacctcaaaggggccatgcttgttcctttcacccgttatcccccatctctacgtccccagaatcactcactctagaatccttccagtgaaaaccgcaggctccaccttgcctctcgtttgaccattcttgggttttcagggtgaatctcttcccttcaatagctcccacccttcatttgcacagtacgcagtatttaacttttctccacaggttccaaaggctgatttcttgcaagcaaaggccacctgatgtgtctttttttacaaatctctgctgaacaggtaacaggtgcccaataaaactttgtgagttggcagtctaagggcatctaccctcaaaacagctaacgtagcattttatgggagtggaaacggagtcgtgtggaaagacgaccaggcactttcgtttttgagatggagtctagctctgtcccccaggatggagtacagtgctgcgatctcagctcactgtgggcatgcaccacaaagcctggctaatttttgtattttt

SEQ ID NO: 213562 - DNA, 432 bp, Homo sapiens
tgtgtgtgaggtgaccagggtgatttaggagcaccattagaaaacctgacatcactgcttgtggttctgctgaccgtttcagccactggcttgaatggagtcattttggcttcttcactggcacctctctgaatttctaggaatgtgcctttacctttaccgagggcccctcttcagccaacattctcacgatgtggaataattgcttggaagtgtagaagggcttctcattttgagaagctgatcatccttccaggttgagccacaaataagtcctcctcctctactccctggggacattagttctggtccctcatctctaaaacattgatgtgcctaagagtaatacacattttggtcttcctctgaactttaatatagcttgcaaacaaatatggattcaatctgatttttaaagttttatttctaaaa

SEQ ID NO: 213563 - DNA, 448 bp, Homo sapiens
acacattaatctgtcaatattcttttaaggattggtaaaatggcttggaaaagaagctgtttctgttacctgcattgtactcctaattatcacagctctctgaagcttcaacttcagaaatgtgtagaaggaaaatatttcccttggtaaatgaacccttgctttattcaattggtggaagtttagagtagagcaaaatatttaaagctttgctatactggtctgagagcaaactattttttttccaagtgatattgaattaaaaactccatccattttctgcccatgcaaggcagtgcaattccctggaaattgattttttttttttttttcagggcttgcagtggctttccccaagctttagctatatggaaaagaacacctttattaaatccacttagtgaataaagttggcagttaatttttaagcatctggaccagtgtgtag

SEQ ID NO: 213564 - DNA, 463 bp, Homo sapiens
tcgcttgacaccaggagtttgagtccagtctgggcaacatagggagaccctgtatctaaaaaaaattaaaactaatcttccagattaaaggacactaaagagatagatacgactttttaatttttatgtgatcctggtcttgaaggaggaaatgctataaagatattgagtcagttggaatgtggatggtgaattagggaaaagtatcatatattgtcagatttcctaaaactgataactgtgctccagttataagaaaatgtttttattccaaggaaatgcacattgaattattttgtgatacgtaactttcaaattattcagaaaatctatgtgtttagagaagaaaaatatggggcaaaatattagtaattgttgtgtttgagtagagtacacaggacttcattgtattattcttctaactttcctgaaagttcaaagttacttccaaatagagagctta

SEQ ID NO: 213565 - DNA, 365 bp, Homo sapiens
gcggccagcggcattctttgcgtgtttcctgagcacggatcccagcttcgtggtcagctcctcccccacccagcctgcttcccggcctgactcctggtagctcagagcagtcccctctcctgtcctgcccagggtcctcccccagttcccgtctctaccgtggacagatctggacagagaagggaaactcccaggagcttggccactgggccttcggtgggggttgggggacaagtggaggttcaactccatcccagctccagctgactttggtgggtttcgccgagcctctgttgatatgttctcatctgtaaagatggggaaaataaccaccccttggggctatcaggcagattcaatgtctc

SEQ ID NO: 213566 - DNA, 193 bp, Homo sapiens
cagggtgaaggagctgagcttgagtcctgggtgctgggccagagtttcctgtctactggtttattataaagaatattacagcgtttttttatttttgagacagtctcactctgtctcccaagttagtttgcagtgagccgagatcgcaccactgcactccagcctgggtgacagagtgagactctgtctcaaa

SEQ ID NO: 213567 - DNA, 410 bp, Homo sapiens
gcatttcacgtgtaaaaaagggaggttcataaagcatttcacgtgtaaaataaaacttgtctgtcttggcaggcatgggtgtcaccagcctgcctgcctgcttttccgctcatgaaacccacagaatgttctgagtgttgacatgtctttcattccaggaagaagccttttgggatcatgtatttcacagtgcagatgaaacaatatgaattacccatacaaatcaatgtcatttttcacttagaaaagtaactaggattatcagatccaagaatcatcaatcagatatttagggaaaaactgtatttagaagaatgaaaagggcaaccgataccagaagattcatgtacaattcagggattaccagaaacttttaaaaaggtgtctaattaataccctcagcagaattt

SEQ ID NO: 213568 - DNA, 579 bp, Homo sapiens
ccatttttatatattgttgatggctttggaaatagtaccacctttatggaacttacttaccaacatgctttattccattggatctaagataccatcatgtgtaagaaacatcgttattttatgtgtcaccaaagaaaaaaaatgctgccagttatcattgtaaaatgctgtcctaatttcagtgaattaaagttagaaaaagagcgagtcttaaaattgatgagatgtgatatgtcattaaccataaaaataacattagccttttgcacaacaatttggaatgtatcctatggacatcatctaatagtggggaagctttattcatggaagatgttagctgtagcaatagaaacaccagttaaaatggaacatttgaaaaatttgaagaattacttcaattttcaaacactagctcataaccacagaagtaacgttgtatactatctccagtttgtgttttatagaaagaacattgttgccatatgacactcttttacaaaggagttctgaggtcactgaccagcctgcagagcagcactcttaggttctggtgcccagccatggtccagtcatctgtgg

SEQ ID NO: 213569 - DNA, 617 bp, Homo sapiens
tagagaggtctgagtgcagttaacagataaacgtcaggtttaatgagatgagaattgcaaaagccttaagttgtggtctgtgtgcagacactgctgctaacacatagaagtagctagcataggagagaataggaggtgcttgggctggaagtgtgaaagtggaagggaggctgaggtcctagcagaagaaataactggtcactaatcctttgggtatagtcagagtgtgaagagtgttgtctgagaggctgtcagacaaaaggcaaggtctttgcagtttagacttactctaaggtcaggagacgatgtaggaagacagtgtttgtgtctccccgaaccccagatagtctagtttctaaagatgtcttctgcaataatgttctctggagcataacttttggagagattgttctgcattatcatgcttacatgataaatgaaatgaggccatgttatatatgttatatttacatggaataaaatcttctaaacagcttttggccagtcacggtggttcacacctataatcccagcactttgggaggccaaggcaggtggattgcatgagctcaggagttcaagaccagactggccaacatggcaaaacccccgtctct

SEQ ID NO: 213570 - DNA, 198 bp, Homo sapiens
gcccctcaggtgtgtccccgtggttgccagatgctggctgtgggctgggctggcacagcaggcttcttggaggaggtgggcacagcgtcgtgaccagaacaacgcacgatgccaggccccaggtctgactcatgcagtctaaagagaaaggattctgctgtcagactgagggcggctcttcagatggggcactctccg

SEQ ID NO: 213571 - DNA, 564 bp, Homo sapiens
gtcaggtttaatggcaagacagattagggaagaggaaaggaagaagcttacctcctgtgtagctaaggagaccttgttatgtagatgaaggctccctcatagagaataggtgggaaatgctgcttttcagacttttatttagacttttaagtaatagggacaggattatgctatgttgcccaggctgttatctaattctttttctcaagcaatcctcccagctcagtctccgaaagtgctaggattacaagcatgagccgccatacccagacagggtttgttcccttgtaaagaattatttgttgctggacacagtggctcacagaggccaaggaaggaggatcacttgagcccaggagctcaagacctgccatggcaacatgacaaaacctcttctctacaaaaaatacaaaaaattagctggatatggtggcacgtacctgtactcccagctatccaggaggctgaggcagaaggataacctgagcctgggagattgatgctgcagtgaactgtgattgcagcactgcactccggcctgggccacagagtgagagcccttct

SEQ ID NO: 213572 - DNA, 653 bp, Homo sapiens
gctggtctcaaactcctgacgtcaagtgatctgcccgccttggcctcccaaagtgctgggatcacaggcatgagccactgcgcccggcccagaggaggtctttttgtcaaaatcatgtctactgcctctgcctcatcaccaaaggctgctttggactactcttgccttgacaagaggctgccctctttctccaaaaccgggaggtacagctccaggagctgcccggacagaccacttcctctgtgaagcacctgctggagcgcgtcctgcgaacctggatggtggcacagccttggcttagttcctgagccagatctgaacacagaatatgaatgagcacgggacagtcttcctctgataggaggatggcactggatggagccttgttcagctgcctggccacattcttctgcttcaaccatgccccgctatagttcatccacatcaaaggatgcctggaaacccaagccatatctccatcagaattgtcctatgccctcgtctcgttattggtcaatgccatactcttagtattggaaggcagacacaggaagtaatcctcatcaccgtggtgccagcctctgcaggaccagggtgatcagtggcagggacttgtcaatggccaggctgtcacaggccttgctgctcaggtc

SEQ ID NO: 213573 - DNA, 648 bp, Homo sapiens
tttctcaatacattaagtttacgtaagcaattatgccattttatataagagacttgaactctgcagattttagtatctgtgggggtcccggaacaaatgtcctgtggatacttgaaagacccccgtggatatgttttttaaaatcattttattcatcaacttaaaagaaaaaagccacgtaagaaacaaatcctaccacaacttgatataacttttcttggagtttctgctatatggaaaaaaaatatgatttgctagttgtgtgacttgctttctttagtaacaacatttaggtgtgttaaaataatatagatgtaatgatcatattcatttaattcattacttttctcactaaatatagcagatctccaatgtgccagaaaccataccaaatgctagacataaaaacaagaaaaatactctaagacatgtacatgaaacataaattataaagttgttttaataaatacaatttattaagtgttttaatagatgcataaacaaaatgctgtcaaagcacaaaggatttcgctgtggtgataggaccaaaaaaatgatacccaatcacaaatcaacaacaagacacaactttaattttaccacatttaaagtaacttagatttctgaaggagacaaaatcataaggat

SEQ ID NO: 213574 - DNA, 206 bp, Homo sapiens
tttgaactgtcaacttattttggacactgaatggaaaggtttgatatggttcagattcccttatctacaacttttataaaatttgatcctaagaggaattatgccttgcaaactcctttttactagactaatgaagaaccaagtacaaacgctgccaataggaacttcatctttgcttttaaaatgtgtttgcccatatcatttga

SEQ ID NO: 213575 - DNA, 461 bp, Homo sapiens
tggatgtttgtaagcctaaatatccagtcaagcagaatattctttaacttttttattctttttaaaaacagggaagattttcagaagaaattgcctattgtcgtcttctttttttttgagatggagtctcgctctgttgcccaggctggagtgcagcggcaccatctcggctcactgcaacctccagctcctgggttccagcgattctcctgcctcaacccctggagtagctgggactacaggcatgcatgagtacgcctgctaattattgtatttttagtagagacagggtttcaccatattggccaggctggtcttgaactcctgacctcaggtgatctgctcgcctcggcctcccaaagtgctgggattacaggggtgagccaccatgcccagccaactgatgttagttttatagcaaaattctttcttaagctgtttaagacttaagacaggttctt

SEQ ID NO: 213576 - DNA, 350 bp, Homo sapiens
aatataagtgcttaggtacttcttaacttgatgggtccctctatcacgagtctacacttttatcagtagactagactatatttctactaccagtttgggcacatgaagttagagtatccacttctaaattataattatccatatgaataggagtttattttttattttcttataaaataaatcaatgataatcatttgattctgtgctggataaaaattattcttcatggagactgtctgacatggggaagagtgagaattctagaggcaaatcaaattgaatcctgcttccaaccataacaaaaccataaccttgggtacagtaacctctcagagactccctcatttgt

SEQ ID NO: 213577 - DNA, 598 bp, Homo sapiens
tctaacctgcaacactatctcaatctgtatctggttaaatgaattaaaaagttgaaaataaactaatttgtttaaatgcgcttgagggaaacatgttcattcttgtgagtggctttaggccttgaacagtccatagattcagagatcctgggagttagaagggtctttaagatcctctttccaactgcttctctgtgaaatctgtatatttgaatccccagggcaggtaaaaaacaagcaaaaacaccaatgcccatacccaagcccagatctgagaggtctgaatttagttgctctgggagggagcctggagatcatcatttgtcaaaagaggtttctagcatataaccaggtttgaagactattgaactagggtaatattttcatttgagtaaatgagagacagagattaagtgacttatccaaggtaatactaaacaccagggacagatcaatagtaattattgaagtccatagttatgagagagtggtggatcagaaaatagtttgcataatctgtccctcctttcccttctagatacctgtgatcagaactggcatcctgtccactttgattgagactgctgtccccatcaaa

SEQ ID NO: 213578 - DNA, 156 bp, Homo sapiens
caattgagactgaagcagggagcagggaacccctaagatgtggctaggctctatctcagaaaaaagccagtgccaaagaaagcagaacaagaaaaatgaaacaagaaagaagaaatcgaaatgacatagtttgagcacctggatccagctgcacct

SEQ ID NO: 213579 - DNA, 263 bp, Homo sapiens
ttaatacatacgtaactttcatacacttccacttactatatcttgtttaatccttatgacattctattgacaaatgcagtataatttgtatttaaagtaaagtattagaagagtaatctaagcttttttctttgaaggagtatagttgagtattatggagctggagttggagaatattgtgtctgctgggttggtgtgtgccatgcctaaattataaaactcttggctctgaacttctataagcaagcaaggatattacttct

SEQ ID NO: 213580 - DNA, 480 bp, Homo sapiens
tcacctcaaggaaaaaggatcaaccctggatagtgatgccccttacatatgtattcacagagacgaggaaagcaatcacgggcatgccccagaggccaggacattttagagctctttctctgcaatctctgcttttgggaaatctctgcttaatcaaagtatctgtttttttgccgcctaaagagtgctttcatttgtaagatccattgtgtatctgtttttgtgctttaaaagtaaatatcagaagaaatttcctgttgctgtgcagtaatcttagtcaaatctcagcttccaataccaccaaccatcaccatcagcatttcagtattttttttttttttgctttttaatgtaatttctggtgaccatttgtgtggattagtcttcacatttgtggactgagactcgcaggaatgagtttcctaacatatgtaggggtaaagggaattttccctacccttcaaatgtttgaattagcta

SEQ ID NO: 213581 - DNA, 794 bp, Homo sapiens
cgcggtggctgatgcctgtaagcccagcactttgggaggctgaggcaggtagatcacgaggtcaagaaatcaagaccatcctggccaacatgatgaagccccatctctactaaaaatacaaaaattagctgggcatagtggcgcatgcctgtagtctcagctacttgggaggctgaggcaggagaattgcttcaacccaggaggcagaggttgcagtgagccgagatcatgccactgtactccagcctggcgacagagtgagactccatctcaaaaaaaaaaaaaacatcttgagaattcaggtcactgtatgaatgacactaaaaaaatcaagtccctaaatcaggtgaagaagaagtctcttgctgtctctgcaatatcttggtgaagtcgtgcccccaaactgtcacagactaagatgtaagtttaaaatatttggttgtcctccttaaatgaaaagggatacaggtcactgaacaggaaagagcactgccaattcttcactgggggcctggactccagtcacatccatctgtcatcatgggccccatgggtgtgtatgctgtctggttcagtccaggtttgcagaactgatttaagaactccggccaggtgcagtggctcatgcctgtaatcccagcactttgggaggctgaggcgggtggatcacctgaggtcgggagttcgagaccagcctgaccaacatggagaaaccctgtctctactaaaaatacaaaaaattagccgagcatggtggtgcatgcctgtaatcccagctacccgggaggttgagg

SEQ ID NO: 213582 - DNA, 528 bp, Homo sapiens
agggaagctgtgttttccaccatcttgagaattcaggtcactgtatgaatgacactaaaaaaatcaagtccctaaatcaggtgaagaagaagtctcttgctgtctctgcaatatcttggtgaagtcgtgcccccaaactgtcacagactaagatgtaagtttaaaatatttggttgtcctccttaaatgaaaagggatacaggtcactgaacaggaaagagcactgccaattcttcactgggggcctggactccagtcacatccatctgtcatcatgggccccatgggtgtgtatgctgtctggttcagtccaggtttgcagaactgatttaagaactccggccaggtgcagtggctcatgcctgtaatcccagcactttgggaggctgaggcgggtggatcacctgaggtcgggagttcgagaccagcctgaccaacatggagaaaccctgtctctactaaaaatacaaaaaattagccgagcatggtggtgcatgcctgtaatcccagctacccgggaggttgagg

SEQ ID NO: 213583 - DNA, 238 bp, Homo sapiens
ttccccccagtggaaaaggcagatagttggtgctatggtttgactgtgtcctccaaaaagcatgtgtttgaaatgtaacctccagtggaactttgttgggcggtggggcctaatgggaggtgtttagttcacgagggctccacccttatgagtggaatagtgccattatgaaagggcttgatgctgcaagttccatctcttgctctctttgtgttcttttgcccttctgccttctgcc

SEQ ID NO: 213584 - DNA, 639 bp, Homo sapiens
tccagtgggagtagggtggggtgcaggagtctcaaataatgtgccaacaaattggcacaaaatcccttaataagcagctggcactggctgcgttccactgcaggattgtggtcttgcaaaccaagcccatgagaggattcaagagacagccctaaaaacctgccgggaagagtcttctccaatgtaaatacaaacctacacgaaccaggaccatggccaacaatggcaagcccttccaagggtaacagcagaatgttaagaaattagagaggtcatttaaaacaagggaggaaggtagctacaattccattacagcaaatcccttactggcatttacattcccagccctaattcctaacactgtgttcaatgtcaatagcaaaatgaagctcttaaaaagaattaagctttcaaagatcataaggaagttagccccctgttttaaaaagcactgcttagaaaggtccatcaaataacatttcaagggttgatgggaaaccaaatataattcaataaatatacatgggtaatactcagacatcctcatttgtctatgtaatgactcagatttgacactctgatccttgactgaacacaaagactatattccagaagaattgtgcagagtacaaagggaga

SEQ ID NO: 213585 - DNA, 389 bp, Homo sapiens
atccctttccctgagtcagcgagagcccttcccccaagtcctctcagctcctccctcctgagccccaacagtctccccggccctgcttggcagatggtcccacctgtcaggagcttggcatcgccgagtccgctcctcaagcaggcccaggggccgtcaggtgaggataattagcagagacaggctggggagggggcagagaattgccatctgggcaacgggtaagatcttgcccacccccgccattcaggcttggaacagggttggatcgatcatcaacttagtcttcctgtcccagccatagaagctctatcaaatgccagcgcttgagtccttcattccagtcccgtccccattccgggatgatggaagccatagccatgcggccg

SEQ ID NO: 213586 - DNA, 514 bp, Homo sapiens
cagacttactgtatgtcacccctccaccactattccctggctttgctaatttacctgttcctgccacagatttacctaaagaaagaacttgttcagtttatatcttttcaaccccctctggctttgcccttcacattgtgtcatcaatcctttaagtctgttctttagagccctagggaatcattttttattggagccaggaaagtgacaccacataatataagatctttcaagatgtcacagcatataatacaagttactaagtaatgaacaattatctacaaagtcagaacttagttaatatctttggattataggtcttgttcactacaaaaacagataaaaaagcagtcattgtatactgtaagagcctgaaacttgtagagtaagcagcaaaatgatacttaactttaaaaaaaagacaacagtattatattttgcaatttttaaatttatttattatttttgagacagggtcccactttgtcacccaggctgggatgcagtgatgcaa

SEQ ID NO: 213587 - DNA, 364 bp, Homo sapiens
atcaaagaaggcttcttcagggtaagagctagctaattaaatctttagagggcacaggggttagccaggtctaggactgagaaggaagggcatggtttctgcatgggtctataagtgattttgttgtgttaggaaataagatatgagcagagaatgacaaagatgactgactggtttccttgcgagctgagtactagactattagattctctagattttcacaaggccccagggcaagtagtaataggaggattctataggaatgtttatcttgctttcctcaccacatcatggtggtgtttgcagcattttacaggtattatcagttagctcatcctttgcttttatctgtagtgatagcaaa

SEQ ID NO: 213588 - DNA, 478 bp, Homo sapiens
tttttatttatttatttgttttttgagacagggtctcactctgttacccaggctggagtgcagtgatgcaatcacagcttgctgcagtcttgacctcccgagctcaagtgaccctccaacctcagcttcccaaatagctgggactacagccatgtgccattatacctggctaatttaaaaatgaagttctgggttcaagccatcctcccgcctcagcctcccaaactgctgggattacaggcgtaagccaccacacctggccaataatgtacctttctgtgctaactcaatgttccactgatacagctggctgcacaaccgcctctgagaccatgtgacacttgggcttcagctgccactgtgtttccacacttgtggcaccccaggtcccctggctctgacccctgaccacatgtagcttgctactgacatctactcctcagacacacatggaaagtgtttgggcctgcccctgctc

SEQ ID NO: 213589 - DNA, 561 bp, Homo sapiens
aagaccagcccaggtctgttaaatagcaaactgtaggtccaaatctcaattttttagaattttaagttatgaagtgcaggttgtttcctgcacttcccggatttaaaaaagagtcacacgaaggatcttggaatcagaatgacattgtatttcttaacagcaacacgtgaagttagaaaacagactgaacatagacttctttgaaaataattttccctcagaattttgaaggtgttcctccactaattattaattaaggatagaataaagatgtttgggccgggcgtggtggctcatgcctgtaatcccagcactttgggagtctaaggcaggtggatcacttgaggtcaggagttcaagaccagcctggccaacacggtgaaacctcgtctctactgaaaatactttcacatgtcacttctaggaaacttatggagaatatgtcccaccaaagtgagggagtaaaccaagaaagggggaggtttgggatcttggaaacagaaagaggcagaaggaattctcaaacaaaggtgttttcagggcagtggctcttgtagtaca

SEQ ID NO: 213590 - DNA, 413 bp, Homo sapiens
  misc_feature (180)..(180): n is a, c, g, or t
gccggtaccgcatttctcccatcagaaggtaagcagtatgaagttagggaactgttttacttaatgtgtatccacagcatctagaatagcacacgtcagagtagacactggttgaatgaaagaatgaataaactggccaggtgcggtggctcaagcctgtaatcctagcactttgggagnccaaggtggtaggatcatctgagcctaggaattcaagaccagcctgggcaacaggagaccctatctttacaaaaagcaaactgggaaaacgtaactaccacacatatcacaaagggttactatactttatacaaagggattgctcgcactgcacagtgcagtgcatggtactgtacaccgcctcacaagtatggctttattcagtggtccttcacagctggtggggcctgagg

SEQ ID NO: 213591 - DNA, 440 bp, Homo sapiens
atacaagtaagatggaagtgccatggttgtcttgtgtttcagattatgctttttatgtaagagtattggagtacgatagaatttattcctgaatgtttttgtcttcagtgtgttccctggatattgtttaaattgagtgttgtgcatcagcatattttgaatgtatgaagcatgcatgtttttctgtttcttgagacaggatctcattatgttgcccaggttggagtgcaggggcatgccacaatcacagctcactgcagcctcagcctttcctgggcttaagccaagcttgtccaacccgctgcttgcaggccacatgcggcccaagaatgcttttaatgcagtgcaacacaaattcttaaacttatgaggttgcagtgagttgagatcatgccactgcaatctagcctgggtgacagagcaaaactttgtctcaaaac

SEQ ID NO: 213592 - DNA, 167 bp, Homo sapiens
cagcagagacaatagcgcagagcagtagaaatgcctcaggcttggaatgtggggcctcggttccaaatgcagctccaccacctgactgtgtggccttgaagaaagcacagcctctctacctacctgcacaaagagcacgaagccctgcccagctcccctcagtgtgc

SEQ ID NO: 213593 - DNA, 528 bp, Homo sapiens
aacatcccatcagtaggtgcagttaagaataccacactacatgaaaacacatgatttggtaaaactgactttaaaatacacaaataattttgggaaaacacagcagctccacttgcaaaagggcaaaggaatcacagctaacagatgctaacatcaacatacagcactaacaagggatcactggaagaagtcttaaactctgctgggaggagtgttacttgagatatttctcaaaataaatttagcaattaaaaaaagccttgaggccaggcgcggtggctcacgcctgtaatcccagctgctcaggagcctggcaacaagagcaaaactccagctcaaaaaaaaaaagaaagaaaagaaagctggagctggtggcttaggccatcacccttccctgggctggaactacgggacagaccctttggagatgtgcctgtggtgctgatgggagaagatgcgcatctggctcccatcagggtaaaagtttggctactgcatctcaccggaatactgatgggagcaagatgg

SEQ ID NO: 213594 - DNA, 248 bp, Homo sapiens
gggaggctgaagtgagaggatttcttgggcccaggagttcaagtctgcagtgagctatgagagcaccactgcactccagcttaggcaacagagtgagacctcaactttaaaaaacaaatttttttgaaaggaaatgaatattaaaaccacttgtaatttggaaggttactttaaaggaactaattctaaatcttttattatagcaatatttgtacaatgcatagtgcaactaataaatagcttcagag

SEQ ID NO: 213595 - DNA, 638 bp, Homo sapiens
gaggatccacgcagtcttgatcccatgcaggagggaacagcttccgcgaatgaagccagctcagaggaaagccaagctcagatatttttttttgagatggagtcttgctctgttgcccaggctggagtgcagtggcgctgtctcattgcaacatccgcctcccaggttcaagcgattctcctcccaagtagctgggattataggcacccgctaccacacctggctaatttttgtatttttagtagagacgggggtttcaccatgttggccaggctggtctccaactcctgacctcaggtgatccacctgcctcagccttggcctctcaaagtgttgggattacaggcgtgacccactgtgccccgcacatttgtacttttgactggtcttgccaaattgcctttgagacggaaccatgtccttggtcaggtcctttctcatctctaagcgtcccctggaaagttggggagataatttctatttctcagggccattaggaagtggaaacgagatcgagtttgtcaatcgcttagttttgggagtgggcgcaaagttacggctccaccggtaaagcacagtagaagggccccaagcagtgtttgttctcttcccccatgcctctctgctgagtgccactg

SEQ ID NO: 213596 - DNA, 347 bp, Homo sapiens
gctcttggatattcttccttaacttccccctgcccaggatacttaataggtttaattaagtaattgcagctgacaaaacaagtaggacctgatttcatcagctactgcattctctcctgcaggaatttttgggacatgaaaatctaaaatgcctggtttacctatttggaatcagaaaaaaaaacaatgggatcaaaccacaagttaaaacctcaaaaaaagttatcctgccattttctttgcttgtaaattcgtttcagccaagagaatgtacttcccatttcaatgtcccccactgagaggacggaccctaggtctctgtccagagttggacaactctcattcac

SEQ ID NO: 213597 - DNA, 429 bp, Homo sapiens
taatgtcttctcctcctattttctttggcttgtcatgagctttgaaagtttgatctgagatccctcacttttaataatctgtaactctgatttggtaatctcctacatatgaataaaatgtctgtgttcatttatttctaatgaataaatgaacatgcctgctgagccaagccttaaatgtgattaaggagactgacttgggttcagatcctggctctgccttgagtaagtttctaacattcctctgcttgtatttccttatctgtaaaatgggagtgatttctttgaatgaaattatattacatttatcaagcattttatcacagtttcaacaataaggtgtaattattattaattcagactatatgattctgtgcccttggataaagtttaccattatataataaactacttttctcacttaatgca

SEQ ID NO: 213598 - DNA, 454 bp, Homo sapiens
atgacagaatagaaattaactaggaaacaaggaggtggtgctggttcaaggttgctggagagagtcaaagaaaggcaggttccttggggttctttttgtaatgtctttgatgtgcgttctcccgtgtggtactagaacagagtatcatttctctggaagcaactttatcctatttaaaagcaatctaaatgcccatcagggatccttgtgctatattcatgcaatgtaatgttatatagcagtgaaaatgaatgaactagagctattaatatatgaccaatgcttaaaatttcatgaacagtatattaagccaaaaataaagttgctgaaggccacgtagtacataccattatatgaagttagaaacatgtgaaatcgtactctgtactgcttaagaatatatatgtagttagagaataagtgaagacatgcaggggagtgatagaaaattcag

SEQ ID NO: 213599 - DNA, 523 bp, Homo sapiens
cattttcctgggtaatgctttttcatttttgcttaatttagttatgtaaccttagtttggctgcttaggtatgtcactggagagctacttccctattggagatgtaattctcagttctgctaagagaggagatcgtacacattagttagggttgtcataaaaggagttgaaagcatcagctgtgagcaaatcactttccttatgtgattgttttgaatttgaacaacaaatccatctgttttgccttaaacaaaaggtaagatgtgcataaagacaaatatttgtaacctagtatgagggaattcttaccctacaaaattattttaggagcaggctaattatatttacacctaggcagtgaacagccagtctttgaagagagtaaagtatcaggtaacttaccattttaaaagtctattgatggatttgtttccaggaagagagaatttaataacttattaatttaagggagcaagtgtttttgtagaaaagattatcaagattgtaatcaggccttaatggg

SEQ ID NO: 213600 - DNA, 616 bp, Homo sapiens
gctaggggcttattgagcttttttgatctgtggatttatatttttcatcaaatttgaaatttttcagccattatttctcagatatattttccccccttctctcttctttttcctcaactccattgtttgcataataggctgcttgaagttgtcccacagatgattgatggtctctcattttctttgaaccttttctttctgcttccttttgggtagtttctgttgctgtgtcatcacattcactgatgttttcttctgcagcgcctaatttgctgttaatcccatccagtgtatttttcatctcagacattgccatttttacctttttttttttttttttttgagacagggtcttgctctgttatccaggctgggctgcagtagcacaaccacggcacatttcagcctcgacctttcaggctcgatccatccttgtacctcagcctcctgagaagctgggactacaggcgcaagccaccatgcctggctaattttaaaatttttgtcaagacgaagtctcgctgttttgctggggctggtcttaaactcctggcctcaagcgatcctcccaccttagcctctcaaagtgttggaattacaggcgtgagccactgtg

SEQ ID NO: 213601 - DNA, 651 bp, Homo sapiens
ttgggagcacttattccactgtcttcttcctaggactgattttcgggtctcaagggtaactgtaggaggtccttccctggttactcctgctgcgcctgcccctcctaaccatggctggactgtccctgtcccaggctaagccagctgcagttggctgtgattaatggcctctattaacagcaagttgtaaactgataaagtacacagtgcccatgaaaatctcacctctgctaaattccacaccagtgagtacttactccttaacccccgaaacctcctgccttgcctcgtttgagagacatagtgacagagagtacacctttaaccagaggaattcaaaatgccttggaagcaggaaacaactccatgaattctttgggggaaaagcccaaatcctaaaacctggtttcacatggagtggagcctaggcgagatgaaattaaagtccaggtcaaggaaggtagtttcaatcagcctcaaagaaatcccagagccaactggccaacagctgcgtgcccttgggtaagtcactttctcctatctgggcctcggtttcattatttgttaaatgagaggtttggttcaaaatgattcctagtctcctactctactcggcagacttaagagcggttctgaatacaggaatcttta

SEQ ID NO: 213602 - DNA, 484 bp, Homo sapiens
gcacccctgcagcggcggtcacataaccccacctcttccaggagtgcagctttcccggccccccaggccagagacaggctcagaggacgcagggcaattccttaccttggcgtcgagatcatgtggggactctcggccgtgtgccacaggctgcagagccgtggagcagtggggtgcgtgacctggaggtcagcaggggccgggaggacaccgggccgcggatgggggcgcggagatttgggttctcggtgtcactgctctcgccactggcccgggatcatgagcctgctgctccgaaaactcgccgtcggacagcgactgagtatccgcttccctcccctggccctcccctgcgccaggaaggcctggccttcggcaaccgtgcctgcagcaggcgctcctgaccttttccagggactcctttgaaggtcaaaagttcgaaggcgttcgaagccgagcaggctccctccaggggctggaaggt

SEQ ID NO: 213603 - DNA, 535 bp, Homo sapiens
ttagaaagacatctctcaaagacgatctcgggcaaatctcctacttgggatggactcatatgagctgctgacatgagtggagtgcttaccatggtgcttactaacaacgcattactcttgttttgcaaatgagaaagtggcacagacaagtcagtgactggcccaaggagctggtaagtggagcccttttacccaggggcatccagactctaaaagccacctcctcactagatggaattaagtcagtcacactggaagactgtcctcatgtctcagagggatcctcgggcacctgaagcccctgaggtgaccatacccccccacctccctgtctaggcctgcaacctgatcctggctctcacatctcccgctttaaggtcccagaggtctgcccagcaacagccctgggctgccatgtggccacgaggtccatttttccagatgcattggaaatccaatttttttattttttattgaaacggagtcttgctctgtcacccaggctggagtgcagtggcgcaatctcagctcactg

SEQ ID NO: 213604 - DNA, 742 bp, Homo sapiens
ggtatagtgaaactccatatcaatatcacttttatttctgtttttggaaaaacttagagcagaaccagtatgagttttctgtcctgggaagtgttcacacggggtcactagactatctgttagaaaaaggtaggacttggatatttcagtatttaagatgctattaatttaaaaaaaaaaggtctaggattctggaaaaaaaaaaaaaaaaaaaaaaaaaaaaaaaaaaaaaaaaaaaaaaaaaaaaaaaaaaaaaaaaaaaaattaaaaaaaataaaaacaaaaaaaaatataaaaaaaaaaaaacaaaaaaaattgttgtgtctttcgggctcacttggccttttacccctaaagggattttttttccccccaaatgctctttttttttcaccatttcccctttggaaacccttttataaacccaatgtgagcgttttaaaaaacattgccttttgaaaacctggggttttaccaataagtccctttttggaaaaaccttctcttattagtggtgtggttttatttgcgaaatggcctttctcaagggtttctttctaaataaaatcccccctttaaattgctaagaaaatatgctatgtttttaatttttgggcataaaatcgggttttttttttaaaccactcattttttttaccctaaaggggctcaaattgtggaaacttttttttaataagagactaatttttctacgtggggctttcagtttttttcgtttctg

SEQ ID NO: 213605 - DNA, 223 bp, Homo sapiens
aacacttgtgaaattctagatacccacttatcttcatatcatgctgctggaatattccatggaaggaaataatcacattcttggttaaagaatagattctttacagaaaagtaatgtagtaatcctcactctctaaccctgcctcatcctggaacagggtggcctatggacctttaatcttcctctggctttggtaacccccatgagcccagagacacctgtg

SEQ ID NO: 213606 - DNA, 357 bp, Homo sapiens
ttttgtacccattaaccaactgttcttcattccccatccttcctttccttccaggcctctagtaaccaccattctactttcaaccaacatgagatccacctttttagctcccacgtgtgaaaggaaacatgtgatgtttgtctttctgtgctgtgcttatttcacttaacacagtgacctccagttccatctacattgctgcaaacgacaagattttatcctttgttatagcccattaaggttccattgtgggccgggcgcggtggctcacgccaggccgaggcaggcagattatcaggtcaggagatcaagaccatcctgtctaacacgatgaaaccccgtctctactaaaaatac

SEQ ID NO: 213607 - DNA, 906 bp, Homo sapiens
catacttacctggcaggggagataccatgatcacgaatgtggttttcccagggcgaggcttatccattgcactccggatgtgctgacccctgcgatttccccaaatgtgggaaactcgactgcataatttgtggtagtgggggactgcgttcgcgctttcccctgattttttgtagtttaaagaatagtctacacagcaagggttacttgttttttttactggcttgtgttttagtcttaatcgttactctcacagtcgaaggctgagaaatagtagtaatatgtcgctttctccccgccccgggagaaataagaatcgtcgacctttacacaagctagctagcgcgaaggccgcacagctcttcctttatctaggcggggctgctttttgcagagatttgtctgtccatggtctgcagtctcttgggttctcagggtctgtgaaaatctacgtgtttttccctagcccccagtcacatttcacacagcctctgcttctagctgcagccccctcaggagtctgtaggatttctgtgctagcggggaatgtgttctcacctcatagagccgggtacaaactatgcaggcgggggctgttctttgggatgaaagcagggcctttagggctcttagcgcgtccccgttgggttgtagacataacacgcttactttgcggagtggaacggctctcccggagcccaggtgtcctaacgcaattcatcgaggcccgcaggtcaaaaccgcagtctcacctgtcttggccgaaatgcgctgcgatcctccctgaaatataaggcgggaagttttatgaggagacgggtccagtttccctactatctcctgccgtttacatatctagtctttcttcagactttatttaagcgacagcttcttgtttgatgtctc

SEQ ID NO: 213608 - DNA, 579 bp, Homo sapiens
actcttgatgatcccattcaattgcttgttgagccatcaattcctcctgcccaaatcctacatatctgtaagattactgtgtgaaatttatgcttcttccactaagcactccttgatgcccataatcacaaatgatcatatcctcctcctccctcttctataatttccttctttttacttaaatcttttgcctcctggaaacttcattcacattgagcatcacttatatgcaaagcaccattctaggttctacagaaggtagcaaagagcaagatatgataattgcaaaggagcttagaaaccaggagggcagattgagcagttatacaaaaaatcagaattcaaattatagaagagggaggaggaggatatgatcatttgtgatcatgggcatcaaggagtgcttagtggaagaagctaaatttcaccgtaatcttacaggatgtgtaggatttgggcaggaggaattgggatgggcaatcgcattttagctaagggatatattagtaaaaatattggagtaagacatttgagtaatgatgaatcaagtaatccggaatcttgttatatatgtgggtg

SEQ ID NO: 213609 - DNA, 609 bp, Homo sapiens
attcataattctcttaaaatgtggtgtttctctaccgaaatcaaaatacttacatgggaataactattttcaaagtgttatgagactaaaattatgagagttttattctaccccctaaatgagaggtaaaataatctagtgaaaccaccaccttctttggaatcagaaatgtacatttaaactactgaacaaatatttattaactatattaacttatgaaagttagcttgtgaacctcgatcacttacctataaaatgagggcacaatctcttatgtcacattgtaagagtaaaaaacatcataatagaaaactctaccatagtgcttatgtgtcaaagtaggttctaagttctttacatatattaacttatgtctatagtatacatatatatgatttctaggatagagttcagtacatagactcaatcagggtaaatcctattagtctaataatgaaagtttatgacattttgagcatgcaaataccatgagaggaaaaaaaaatcaacgctgtttgaaataccaaaggtaatagttctattttttttaatacaaggaaggtgcataacatgtacttcttgttattcataatccttaggtaacatgaa

SEQ ID NO: 213610 - DNA, 334 bp, Homo sapiens
gaacctgggaggtggaggttgcagtgagtcgagatcgcgccactgcactccagcctgggtgacagagtgagactccatctcagaaaaaacaaaacaaaacgagaacataagagcaagatgctattgtattatggaaaaacaataaacagattttataaagaacttaaagtaacttggaaatgagaaatataatcattgaaattaaatactaagtggataggttaaacacattagtcatagctaaaaagagaattagtgaactgaaaaggaaatccaaagaaattacagagtaaagcacaaaaacacaggcaaaagagaagttgaaaatgagaac

SEQ ID NO: 213611 - DNA, 635 bp, Homo sapiens
tgtctaagtgtttaaaggctgagacataatcttacaatattataattcttttttggtctttaaaaaaatcataaatttttctcctcttgggtggctttttttttcttcatcttctaggcaagagagaaagactagagcaatctggagtggcacaaatgccttgacccacctggaataatcctctaacaaagtacgttgccctgaaacacaaggatttgtcatggagagtgtgctcagtgtaattcaaaagagctattcttccctaccaactgccggaaccatgaggggatccttctttgatattcaccacaaggacctcgtgagatgtctagaggtaaatcccataaaagctttggggtcctctaagactacagcccccgggtacccagaaagtttatattctcgcgctagtgtacactaaacaaatttaagttagcagtgcattattggaatagatatgtgtattgatgatttttactttcctctacttatcaaaaattatcttcttttcttcgtttaaatttataaataacaaatcttcaataaagacataaggactcttaaactcaactgtttctcatacacagttacaacatatgatatattctgcttgttttttaaaaccatagttgcac

SEQ ID NO: 213612 - DNA, 698 bp, Homo sapiens
ttgtccagcatttttaagcagtaatttgttggactatgaaaaatcagttttttagtatgtggcttcttgaaaagatttcctttaaaaactttaaggtacagagacgtggtcctgttggtatcctatctcctttttgccccactcttctgttttcagttctactgaacattgtacttatatgtgagtacttatttatacagcagtcctagaaagagatatctcagtttttttccttacctacactaaaaactagactaaacacaagtcatttctgagaactgggtatacagtcagttacgacaggtgctgaatccagtgaagacctctttggaagtcataatttaagactgatggaatccggggtacctattatcagaaaataggacacgtgaaaaatagaggaataagacgaaaacacttgaccaggctcagcggctcatacctgtaatcccagcactctgggaggctgaggcgggtggatcactcgagcccagagttcaagactagcctgggaacatagtgaaaccccatttctataaaaaatacaaaaatcagccaggcgtgatggcatgtacctgcagccccagctgctcgagaggctaaagcagaaagatcgcttgagcccaggaggttgaggctgcaatgagccatgacttcagcctgcacttcagcctgggtgacagagccagaacctgtct

SEQ ID NO: 213613 - DNA, 494 bp, Homo sapiens
ttcgtcttgctcaccaagcagtcagggcaccatgccaggaactgacctttttttgtataaaaggaaacagagaaaagttctcaacagaatgtagtcagatttttatattacgggagcccaaggccattctgccatctaactgggtctgcaaaaatgtcagggtttaggaggctatgcctttatatctgttttttctcttgacccacaaccgactttctgcccttgtccaataatccctaagatggggtctatcttcctttatgtctggcccagactgtctttcccttcagaggccgtccatgctcatgggcttccacttgaacaccgataactaactttaaacatgtcctaagtttttcaggagaaagataaaagctttcttttctttttaaagtattttttatcctgcattataaagacatatatgcttactatggaaaatttgaaaagagaaaaagaagaaccattaaaatgatctataactctaccatcca

SEQ ID NO: 213614 - DNA, 477 bp, Homo sapiens
tccacggggagcggcagcgctccagcagggcaggcctcactctccccacctcgcccctcagccggcccagcctgccgggtctgatggtgtctacgggagcccaaggccattctgccatctaactgggtctgcaaaaatgtcagggtttaggaggctatgcctttatatctgttttttctcttgacccacaaccgactttctgcccttgtccaataatccctaagatggggtctatcttcctttatgtctggcccagactgtctttcccttcagaggccgtccatgctcatgggcttccacttgaacaccgataactaactttaaacatgtcctaagtttttcaggagaaagataaaagctttcttttctttttaaagtattttttatcctgcattataaagacatatatgcttactatggaaaatttgaaaagagaaaaagaagaaccattaaaatgatctataactctaccatcca

SEQ ID NO: 213615 - DNA, 352 bp, Homo sapiens
actctgctctaggtggcacgctctcttgcctcatcaccacagagggcagcagggctgagctactcgaacagtaagaaccgccaccctcgccaccacctgcaaggctctgctggaagccaggcgtgtgcctgcagctgctcaatcctcatgaaccccatgatggaagaatggctcaaaccacaccccgagaaacacatcggattattatcccgggcaagcccaggacaaccctttggctcagagacagaaggcacctgccagaggtcatacagcacaggtgacagagctgggttctgtacccggagcgtctgtgggggacaggcatgctttgacctctccgtgggctggagag

SEQ ID NO: 213616 - DNA, 607 bp, Homo sapiens
accttagttgatctgcccacctcggcctcccaaagtgctgggattacaggcatgagccactgtgcccaaccaagaatgtttttttacacctctttgtttaactgtatggctatactcacacactcgcgtgttctgaaaacaagtgcacacgtcgcgtgtgttacctttgggtggaaggtgagaaggcaagcacgtcctccattcctggatagttcagtggatgaaggagcctttcccaggtagtgggacaccgacctgcataacatgactgacgtccgtgtatccgtttttgttatgagtaaacatagccttggcagctgtgctgtggcctgtgcaatggtgagctctctggtgtcagtcttatgttttgtgggcattttacgtgacagcgacgagagtctgtaggcacaaagtgacctttttgcgcactacttgaaccacacatacaccataaacttgcttttacggttttgttttggttttggttaactgtagcgtttgtttaggcctgacacggtggctcttgcctgtaatcccagcattttgggagaccaaggcaggaggatcacttgagcccaggagttcgagatgagcctgggcaacatag

SEQ ID NO: 213617 - DNA, 543 bp, Homo sapiens
ccatgatgttacctggcactgtatctggttgtgatataagaacatgatggtttctgagtaaggttctgtgtgtgcatgtatgttctgtaaatatctgtttattgatatgtttcttctactggactgcaaactcacttatagcaatcatggtgcttatttatttttatatctccatcacccagaatatggcctgacatgtaaaaggcatgcaaaaaaaatgtttttgggaggaaggaagccaggaaggaaggaagggtgggaaggagggaaagagggagggctacacaatttgcctcaaatgaaggttctatttaaaagattcaaccaaaaagtgaaagtaaaataaatctgtggctacttgagaaaagtagaaaaactttcttatttgcctgaggagtagaagtcctctgcattcccttctcttttgttccccctttccttccttgtttcaacttactagtttcaaatgatttttaaaaatgaataatgctacatagagaaaagactggagaaaagataacgaaatgctgtaataatagaagt

SEQ ID NO: 213618 - DNA, 1425 bp, Homo sapiens
ccgtccatgtgtcctgacacccagtctggtactttcattatgccacaggcctcaattgaaaaatcacagtagggaatttaggccaaggaaagccatcaagttgcaattatttcctaaattttctttggaaaatttcatttcaaataccaaaaccatcctataaaaagaaaacttaccttcttaggtcaaatctctaatatttgactaggttcaaaaagtttatttctggccaggcacagtagcttactcctgaaatcccagcactttgggagaccaaggtgggaggatcacttgaggccaggaattcaagaccagcccgggcgacatagcaagaccccatttctacaaaaaatttaaaaattgtcatggtggtgcacgcctgtggtcccagctactcaggaggctgaggcaggtggatcacatgagcctgagaggtcgaggctacagtaagctgtgtgatttcatcattgcactctagcctgggtgatagagtgagactttgtctcaaaaaaaaaaaaaaaaaaaaaaaaaaaaaaaaaggtcttagagaccagaagtctctgtaatctctaataatctctaggccctagagcagtggtttgtaaatggaggtgatttgctcccctccccccagaggacattggacaatgtctggagacatttttgattgtcctaaccggcaggaatcgggtgctactggcatctggtgagtagaggcccaggatgatgctgtgatcctcaggtgtgatcctgttgagaatgaaacactgtagactttatgaaaacatacaagaccctcatcatttttcctttgcctgagctccctccccagaggttacctctgttcatggttttgtgcatccgtctagtccccctattacgcgtttacaggaatatggtttgcaacagtgttttcatctaaatagaattatacaaaatagcgatttctgatttctcttgcatattgcacattcttcttatacttcctccctacctttatctgacacagaaatgctgtatgtccagaacttctatcagaggcacctatggaagtctaagggaagaccacatcgcttttaaaaaccctaaaattttgtagtcactagatgaaaatattcagccagtgacccaaaaaattgctaccaatgagactctccattttgccatgtagccagaacttactttgatctatgtgcctggggtagtgaccaagtaggtgggtaggagtaatctcagggaaacttgaggccccagcctcatggctagggtcataatttgaacccaggtctgtctgacatcagaatccatgatgttaaccccaattctaaggggttcaactaccctttctaaatggaatcctgctatattaggcactatttattcattttatataaactagaaacattttatgtagtaagtagttga

SEQ ID NO: 213619 - DNA, 509 bp, Homo sapiens
tttttgaaggacgatcccttctgatgatcacttctgtgatctcttctctacacaccagacctcacagtggaaactgcagccactccactagaaaacctgaatgcaataggagtaattggatcccagggtggcaggagacaaggggaggaccctactgctagaggcatggtgggcagagttggtgtgatgaatagcagagtcaaacgagcaaccagaactgtctgactgaaacagacctatggcattgttgagttaattatggcatttctggaaatgaaacaggaaacctactgaattcttacttgatctgtatataagcagaaaagctttaggtcaaatgaacaaaggtctaacttgaatcaaaaatggagaatcatggctcctcaattaactctcagacttgagccaatttacagacctagaacccccggatgaagacgaaggcacatccccttaaagaagtaacctagtaacatgccgaaaatttatactgctgatctttctcccag

SEQ ID NO: 213620 - DNA, 208 bp, Homo sapiens
ccgcaggatgttcgcagcatctcaaacttttaccctctaaatgccagtagcatcccctgccttgcccaggttatacaaccagaaatgtctctagacactgccaaaagtcccctaggacaaatacaagttaaaacattttaagtaatgtcaacataatatgatacaatttcataattaattatatatctctctctaaagatggcggtaa

SEQ ID NO: 213621 - DNA, 304 bp, Homo sapiens
agctcggacgatagtgccgcgtcttacaacgatactgatggctggtgaacacccatggacgccacttggaatgtgcaccagcagaggccgttctttggactcatcccattttctgggcttcatattttaaatgctagttaatttttcccacatttgttgccacaagataataaattattaatgtatttactgagattttactcgtttaggtactgtgttagggatacaacagtgaacagggtagacatatttctgacctccgagtgataaaacttttgtgttggagtgaggatgataatttgat

SEQ ID NO: 213622 - DNA, 658 bp, Homo sapiens
gcgcccggccccttcttttcttttttgtggtggagtttctctcttattgcccaggccagagtgcaacggcatgatcttggctcactgcaaactctgcctccgggattcaattgattctcctgcctcagcctcccaagtagctgggactacaggatgtgccaccatgccctgctaattttgtatttttagtagtgacagagtttcactatgttggtcaggctggtgtagaactcctgacctcaggtgatccacccacctcggcctcccaaagtgctgggattacaggcatgagctatggtgcccggcccttttttcttttccttcctttctttcctttttttcctttccttccttcctttccttttttcttttctttcttcctttccctttctttccttcctttcttccttgagatggtccccctatgtcaccaggcatgatctgcactggcgtgatcatagctcactgcagcctacaactcttgggttcaagcgatcctcctgcctcaacctcctgagtagctgggactacagacacgtgctatcatgcccagctaatttttaattttggttgaggtttcattatgttgcctaggctgatcttgaactcctggcttcaagtgatcctcctaccttggcctcccagaatgctgggattc

SEQ ID NO: 213623 - DNA, 501 bp, Homo sapiens
aaaaaaaaaaagaatacaaatgtcttacagtttcctttcctcctatatacataaatggtaagtttgagtgattttgctggattcttcaaacacaggatattttcttacttaaaaataagtgaaactgggcatgagctatggtgcccggcccttttttcttttccttcctttctttcctttttttcctttccttccttcctttccttttttcttttctttcttcctttccctttctttccttcctttcttccttgagatggtccccctatgtcaccaggcatgatctgcactggcgtgatcatagctcactgcagcctacaactcttgggttcaagcgatcctcctgcctcaacctcctgagtagctgggactacagacacgtgctatcatgcccagctaatttttaattttggttgaggtttcattatgttgcctaggctgatcttgaactcctggcttcaagtgatcctcctaccttggcctcccagaatgctgggattc

SEQ ID NO: 213624 - DNA, 1209 bp, Homo sapiens
acctggttcaagcctagtgtccaggtaggaacccaggctctgtgggaaggctgacacctgtccgcagccctgaccccaaggctcttctctgcccacctagaagagggtgtggccccttcactgggcccccgaccccctctctgggcctggcagtctgagaggaagaaggctccatgttggcagctgtagcgggagagggcatctgcccacgtgcctgggagcccagggcgaggggctgaggacaaagctggagagaatgggggcccagaggtgccaccagcttcctttctccacaagcagagggagctctggaccgcagggcagagaaactggacccctgaggcatatggagaggatggggtgggggcctcctcaacacagcccaagggtcttcttagaaacccgagcctcgcagagcacctgccccagggcctcctccaagactaaggggctgtagagtctatttccacggcctgcaatgtcggggtccctgggccaggatgccctcggcagcctcaaatctggcagtgaccccgggaaaatgacccctcccaggtcaaaggaggcagccttccctgcgctcctgctctaagtcttgaggttgtgctcttgtgggtgtccaagttctgaggcctgaaagcttctgcagacgggcatagaacagggctcagaggaggggtccctgcttccctaaacttgggtagccagagttcgggatcctctcacaatcaggaccagggatcaaagcccagccctaggcaggctgatgtggggcagctcccccagcatgtagccctgtctcaggccccacattcccctcaggtgggaaggctgcagaagacagacccggaagtcccaggctggcctcaccctgggtcctggcaaccatgggctaggccgagggaagggggctcttcagggcactgtaagctttgttttccatgtgccctaaaagaacagactcccacctgtgcggaaccatttgagaggaagtggggcctggataagaggccaccaagagcagtgtggggacagggcccccggcatcagccactctgggctagggtccgcaaagtacgaagccatcaggtccgagggaagggaaagccccgttgggcccacaaacgcccttggaagggccacgcaggaacgcgaaccactctacaacagagacccaagcacgaaaccccgggaacgagagcgcgccgc

SEQ ID NO: 213625 - DNA, 497 bp, Homo sapiens
agccaatgttcgttatccttccagagatagtttatatcatggagtaatataaaaatttatgatttatatgtactgtataatagagcaattatattcttacctacccccaacatgctttaactcgaatgatagtgtagtacacttctgagtttgtctgggcttgtagctcttgtctgtcattagattctgaaagatacctattaacaataccctaaaaagatcaggagcctttaggccaagtctcaaacgtttcagatgagaaaaactcagggatggtgacttgacggaagttgcattaactaacaacgctcacatgctattctccggacttggaatgtccaagcaccctgggcttgctgacacccactcacttttcaaacatcaattcttgggaagcttttcccttccttaatgtcccccagataggtgatgtccccttgttacaggttttagaccattatgtacatctccttcctagcacatacatatattaaaat

SEQ ID NO: 213626 - DNA, 414 bp, Homo sapiens
acaagaggacacaaatgcatccagctattctctgtgctgcttggtgtaatagattaaacttcaatgcaccttgggctcttttcatgggctttgcctgtcacctttacacccttcagagttctataaggaattatcagcactacgactctttggcagtcttagtgggaaaccctgggaggtcaggaatatgggcctgtgaaatgacatcttcctgcctcgtccaaagatagcattcatcatcatttaggcagatgtatgatgctgctaggcaaaacgccagccatggatcacattggtgtcccattacagagcctacgctgtcccagtgtctacacagagtgggaatctcaaggctggatactgagagccttcctggaacttcagggaaaataaatgtactaaatcagttggtta

SEQ ID NO: 213627 - DNA, 468 bp, Homo sapiens
tgggtttaagcgattttcctgtctcagcctccccggtagctggaattagaggtgtgtgccaccatgatcagattatttttgtgtttttagtaaagatggggtttcaccatgttggccaggctggtctcgaactcctgacttcaggtgatccacccgcctcggcctctcaaagtgctgggattacaggtgtgagccaccacgcctggccttaatttttaaatactgtaaggcttataaagaaaagaatattccccttctgtttctttcctctcacgtagcaaccttcacccctagtttggtttcatatacagtgttttaactctttttgctatttttttctcttactttctactatatttccaaatacaatgcttctataatgattccttttttttttctatcagtttttgataatcattgactccttatggtcaaagaagacttaattcccttctgtcactcttcata

SEQ ID NO: 213628 - DNA, 472 bp, Homo sapiens
gaaagagaaacttctgtttgacatagtcagcttgcagtctaagcttttgaattttcactccagttttagtaaagatggggagtgcctgggaaggattgcatgatcattatcagtatttaagcgtgtcaggcactgttcaaaacagttagtgtgaattacctgatttaatccccacaatgaggtgggagctgtttatacttcctattttacttatgaggatgcggatgttcaaggcactcaggaagtctttcccacccagctaagattttaatcctgccagtccaggttgtggggataaggctctgtgctcctaatcactatgcatgctgcctcttgccatagtacgacatctgcaacttagatttctgtaggtcagtgctacagatcatttgctttaggtgagctttcttgaccctccagtgcagaaaccagatctcattagagtacaataggcttgtagcaagaagtaaaa

SEQ ID NO: 213629 - DNA, 303 bp, Homo sapiens
tgctcccaccaaaaagctaaggcagttttctactgaaggacgcatacatcgttaagtaagctagaaacaaaaagttagaacctcgggaaaacaagtatccagactatcctaatggtataggagctaatgcatatttggtgcctatcatataccaggcactgttcttgtgctttatgtatgttaaattgtttaaacatcccacagcaaccctacaaggtgggcactgttactcccattttatacatgaggaaacaggcatagagagattatatgggaagttgttggtgatcttgttgggtggtt

SEQ ID NO: 213630 - DNA, 480 bp, Homo sapiens
gtcttgaactcctgacctcagttgattcccctgcctccgcctcttaaagtgctgggattgcaggtgtgagccaccgtgcctggcctgatttaacaattttaatacagggattcttagcaaataaaatatctcatcaaattgtgaagacacagagctgatagctgaaaaatgattcctggttaaaatctgatactttagaaaatacttggaatgctgcctccaatttggtgtaatttccaatatcaaaaacaaatgaatcttatgtatttgagtctgaacttttttttggataatatgaatatgagtctctactaaagaaaaatacaaaaaattagccgggcgtggtggcggatgcctgtagtcccagctactcgggaggctgaggcaggagaatggcgtgaaccctggaggccaagcttgcagtgagctgagatagcgccactgcactccagcctgggtgacagagcgagactccatctc

SEQ ID NO: 213631 - DNA, 286 bp, Homo sapiens
tttcttccacctcatagattcaagtcctagttaaaaagacaccaagaaaaccaagaaactaattctaatatccttattaggattactatatcaccttaatatatgtgagggtgtaacagcggtatctaaaacagaattatcgacaaaccactgttagaggagaacatagagatttctttttgggaaatgaagtttataaagtcaaggtagaatgggtgagcttgggacaggtggatgttcaggagagagaatttcagaatgtaattgagtagacccacgtagctgt

SEQ ID NO: 213632 - DNA, 595 bp, Homo sapiens
acacccaggatctttccctcaagctataaaactggatgccacttttgaaatattctcttctccctttccatatagcccaaccattaaaatctccattcttcttcagtttctctgtgtctagaattaatttaagggtatgctgaagccaattcataccaacttgcaagagccaattgttaagttttcaggaattttgtgagccagttgatcttacaccagtagcctgaattcagccattgttatttacatcccagaaggggccaaattctcaaatcacggctttttcccccaccgaaagccaattgctaagtatttatcagtacaccattggataaattcacttttttcatgaatggtttaattcattgacacccagattttcagagtaatttctcagctgctttcttgccttttctgccatctcatagcaattcgcccaaatcaaatcaatgttttaagatttaaattagttcctactatcaagatgctcaaatataaatgtgtagtcagctaatatgttattgatgatattaaaaaaataaatcacataagataattcgtggaatgcacttaacacattgctttgagccataga

SEQ ID NO: 213633 - DNA, 226 bp, Homo sapiens
agtcgttcctcagacctgttcctgagcatttgtgagtcttcctggtgcccgaagaaaccctgggggcggcttgacatgaaacaagagcaggaagggggcaagagcctgtgacactgtcagggtgaccctgtggcttcttcaggggagggtgggtggtgcagaagcttgggttttggaatcacacggactggagagtgtcctagttgagtcttatgctgactggctg

SEQ ID NO: 213634 - DNA, 444 bp, Homo sapiens
ggaaaagaaatgagaagaaccacaaagtatgggaataggaaccggaggcaaaaaataagaataagccaaagcagatataaatatacttgaaacgaagtcttaaaaacaaattaaggaagtttaaggaaactaaaacagagggattgcaaccacacccctgcttctttctattattaaaaaagtaagccaagatatgtaaaagagagggctgcctgtaggcgctttggcatgaagttatcatgtgcaaaggtaaaattatgtaaccccaaggactaaaaagagtgtttgatgaatactcagtcatgccaaagttacccaaaacattttccgtctcaagcatcctaattacacaacgcttctggaactacagtgggacccacaggaccagagttaataacttagtatcaaaaacccaggagagttttcaacaactgttaaagaaac

SEQ ID NO: 213635 - DNA, 527 bp, Homo sapiens
agacagacagacaggcaggcagagaaagagagtaagacagaagaccgacacagtgagagagaaaggcagagagagagagagacagacggggagagaaagagagtaagacagaagacagacacagtgagacaggcagagagggagagagagagacaaagacagagacagagacagagagaaagaaagagacagacagacagagaaagagacacagagagaaagacagagacgaacagagagaaacagacagagagaaggccctagcccagtagcaatacagtgccttttctttcattttctctttcttttcttttctttttttctttcttgtatatctgtatgtatgtatgtatgtatgtatgtatgtgtgtgtgtatgtatgtatgtatgtatgtatttatttatgtacgtatttatctggagaccgggtctcactctgtcgccaaggctgtagtgcagtggtgcgatcttgggtcactgcaacctccgcctgccaggttcaagcaattcttccgccccagcctcct

SEQ ID NO: 213636 - DNA, 892 bp, Homo sapiens
ggcggtggctcatgcctgtaatcccagcactttgggaggctgaggcaggcggatcacaaggtcaggagatcaagaccatcctggctaacacagtgaaaccccgtctccactaaaattacaaaaaattagccggccgtggtagcgggcgcctgtagtcccagctacttagggggctgacgcaggagaatggcgtgaacccgggaggcggagcttgcagtgagcagagatcgtgccactgcactctggcctgggtgcaagagcgagactcggtatcaaaaaacaaaacaaaacaaaacaaaacaaaacaaaacaaaacaaaacctgtatctggagcagtagtagagcttcagattcttccccagttccattcccctaaaggtaggatatttattctctggcaaataaatctttcctaggtaacactcttgtgtccctaccaccccccatctcccacacacgacatgcaataatctccgcaggagtttaggcatggggtcagtataaggaataaaagaaaatttatatactcagtattgagacccacagactcttttgtggtcatgtttctacaatgctgtcaggagactaagggattctactcttggatcaccaaacacccgtgataagatttctgaatgtcatctgaaatgtttccactttaaaggttagccttccactagaccattctatcctacaacaaaggctgctagtcaccaggagtttctcatcagaatttttaatgcttccctctaactgacaaacatcaaggactaccatgtaatcaaggaaggcctccaatatgaaagaaggaccaaagtaaacaacaataaaaacaaaactttaagatgttgcagggagaggaaaatttgggggaaaggggcttatttctatc

SEQ ID NO: 213637 - DNA, 554 bp, Homo sapiens
tcaagtgagcagttttgtggaaggcatccattttggagctgagctcaaatactactggagctcagtattgtagaacagcctgattcaccaccaggtctgcagtagagtccaggtatggcattaccctttgatttacctaatctgggaagaagccaattggcctatggaacacctgaaagtaaaacactgcccaccagagatgagaaactttgcctgcctataaactctgataagatgcccttgataactgaaaaccacaggaatgccaacaataagtctcagttattgagaagtttgctgtccagtgggaaaggcaggtaataacaatcctcaaaaataatacattaagtgctatactaagggtatatccagggtgctgtcagaatgcagaagaggcagtacctaatccagcctgacagtgagggtcagggaaggctgccactatatctagatttaagaaattcagagcacagttgacatagcttgtcttaaggatgacacttggccttctaaataaatcaaacttttcccagaaccatttcaaaaaaaaaaaa

SEQ ID NO: 213638 - DNA, 510 bp, Homo sapiens
ctgacctaagataaacttcttactctcctacctctaaaccttccctcacaacatgtctctacttgttttgctacagcccaaaatggatattctaggaaaccaatgaaactgaagcttaggggcccctcacttcacaggaccctccttagaaaggtgtatgtgctcttacaattttgtaaaattcggaaagggatatttaaaaattctttttattttttctctgttgcccaggctggagtgcagttgcaggatcatggctcactgtaacctcaacattctgggctcaagctatcctcccgcctcagcctcctgggtaggtaggactgcaggcggacaccaccacgccctgctaattttttttttttttttttagtacaaacgaagtctagttatgttgcccaggctagtctcaaacgcctgggctcaagtgatcctcttgcctctgcctcttaaagtgctgggattataggcgtgagccactgcacctggccttaaaattctttttcttga

SEQ ID NO: 213639 - DNA, 461 bp, Homo sapiens
cggcccacgggccgcgcggagccccagctgcgtccttatcagcgccgggcagaagggcgtcgcggcgcgagggtggggcgccggtgcgcgctgagatcgacgcccacacgcgccgcgccagctctgcggcggggagagaagccgcggcctgcggggcggggactgcggggcgggcgcccagcgcgggcgttgcacgaccctcggccttccgcagcgccgaccgctctcccgtccggcggctgcagctgctgggtcggccgccgcacccgctcgcccattcccggcccctccagttggagggggtctcggccccgcccccctccccgaggggcccacgctggaaagcccacgctccccacgccacgccccccagggcgccagcccctctgcgggggtttagcacgctgcgcccagaagttgggtgggagacggctaactaggggaggtgtccgtgtgaatga

SEQ ID NO: 213640 - DNA, 829 bp, Homo sapiens
cgcgaagcgccaggcggccgggccagcgagctcgggggccgaaggggaccccgggaccctcggggcgggacccgggccgaccagcggcgggggcggcgcggcgctgcaggcggacacccggcggggggcaccgcgcggggccgggcagaggcgcgggggccgctatgggccgccgccgcctgctcgtctggctgtgcgccgtcgcggcgctgctctcgggggcgcaggccaggggcaccccgctcctggcgcggcctgcgccgcccggtgcctcccgctacagtctctacacgacgggatggcgcccgcggctgcgcccggggccgcacaaggccctctgtgcctatgtggtgcacaggaatgtgacctgcatcctacaggagggagcggagagctacgtaaaggctgaataccggcagtgtagatgggggcccaagtgccccgggacagtcacgtaccgcacagtactcagacccaaatacaaggttggctacaagacagtgacagacctcgcctggcgttgctgtcccggcttcactgggaaacgctgccctgagcacctcacggaccatggggctgcctcaccccagctggagcctgagcctcagattccttcagggcagctggacccaggccccaggcccccttcctacagcagagcagcccccagccctcatggaaggaaaggcccagggctgtttggtgagcggctggaacgcctggagggtgatgtccagcgcctggctcaaacatatggtaccctcagtggcctggtggctagccacgaggatcccaacaggatgactggtggccccagggctcctgctgt

SEQ ID NO: 213641 - DNA, 590 bp, Homo sapiens
agtcagaagctgggaaatcacttgagcctaggagttcgaggttgcagtgagctatgattgcaccactgcactccagcctgggccatagggcaagaccctgtccctaagaaaaagaaaaaatcaaataaatatatccccaaatgacacttctagcagtacaaaaatacgtatacaaaatattattcactgtagcattatttataatgtaaacattggaaacaaacctaactgcccataaccaggagaacgattcaataaactgtttcaatcatgccataaagtactacataactcttaaaacaaataaggatcatatggagtgatctcaaagatattttaagtgaaaaatgtcaagtgtgggactatctgtagtatgctgtattttgtataagaaggataaataacttttgaaatatttgtactaaatacaatttggttaacgacaaaaaaagaacagtaagtaaataactaaactctacatactagggtttttaccacagggtaagtaaatctttttttttttgttttttgagacagagtttcactctgtcacccaggctggagggcaagattccataaaaaaaaaaaaa

SEQ ID NO: 213642 - DNA, 340 bp, Homo sapiens
gaaaatatcattaagtcaaaaatgcagtgaatacacctaacttactgaacatatagcttagcctagtccatctgaaacatgctcagagcatgtatattggtctacagtcgggcagaatcatctgcatcacagtccacaggagagtatcggtgtttaccctcatgatggtgtggctgactgcaagctgtggctcgctgctgctgcccccataccacttatcactggcccaggaaaagatcaaaattcaaaaatcgaagtactgtttctactgaatgtgtgttgctttcataccatcgtgatgttgaaaaacagtaagtcgaaccctcattaagtaggggac

SEQ ID NO: 213643 - DNA, 680 bp, Homo sapiens
  misc_feature (632)..(632): n is a, c, g, or t
  misc_feature (663)..(663): n is a, c, g, or t
  misc_feature (680)..(680): n is a, c, g, or t
agtggcaggagcgggaggcggggacccacctggaagcgccgcggcgccgctatcgagcttcctgcagcggtggccacccgagcaagtgccgtggcgggggcggagagcggccacggcggcggcgcctccccaagtggcccgttgcgtccgaccccgcgtgaaagatatcaagttattctagtacaaccatataaataaataatacctgaagtctcagtgtaacatggacaattaacagtgatgacagataaatacagacgcatggggatcaaatactaggcaaaacgctttttaaaagtgtatcaggcttttaagaaacactgcaggatcctgtctatcttaatgctgatagagctcagctaaaaatttaggaggttctagtattcttcatggctgaagctgagagagtctgaaaccctgatgcttaagctccattctagatcatagctccaactccttcaggatataaggaaaagagattatatttccacaatgatagatctttggttgtacagttatcagagactattacagacgattgctgtactcgaggctcagcgttctcaagcagtccaagaccttgaaagtttaggcaggcaccagagagaagcactgaaaaatcccattggatntgtggaaaaactccagaagaaggctgatatngggcttccatatccacn

SEQ ID NO: 213644 - DNA, 578 bp, Homo sapiens
cgattctcgcgggacctcgttggcagagcagttgtcctggatggcggagccttgggttccgggggcctgggacctgcaactctttctacaaggctggagtgcagtggcaccatctcggctcactgcagcctctaccccccgggttcaagcaattctcctgcctcagcctcctgagtagctgggactacagatgcacaccaccacgcccggctaatttttgtatttttgtagagatggggtttcaccatgttagtcaggctggtctggaactcctgacctgaggtgatccacttacctcggcctcccaaagtgctggattacaggggtgagccacggtgcctggcccaaacatcttgatataattttgttctgctgattttatgaaattcctcccttttcagaactgtaataaacaatattggtttaattctgtttgtttagttttttttctaagttagatttaaataaatttaagtttttacctcatctggcattggtgtgaaatgagaatctaaatgttttcctccaaattggtaattttctcaactctgttaaataatgctttatttaatttttta

SEQ ID NO: 213645 - DNA, 719 bp, Homo sapiens
cgattctcgcgggacctcgttggcagagcagttgtcctggatggcggagccttgggttccgggggcctgggacctgcaactctttctacaagatatcaagttattctagtacaaccatataaataaataatacctgaagtctcagtgtaacatggacaattaacagtgatgacagataaatacagacgcatggggatcaaatactaggcaaaacgctttttaaaagtgtatcaggcttttaagaaacactgcaggatcctgtctatcttaatgctgatagagctcagctgtaagtatcagttctgtgaaaataacagttgcagatgttcttgcctgctaaatatcgtagtggataatcttcctatagtgaactctattcaaatagagtagttatgtggttgattagaacttgatagagtgctactagggcacattccagtatgctcagagatatactttaagttgtagatgttctttgcttttgatgattgctactaccatcacacactgtaaaacgtaatgttttgccatgtttgtgaaaggcttcagtgtttggtacaaaggagttgtcacttggagtctgttataagaagagtgggttttcaagtcaagggttactttatgtaggatcatgttttcgctgagcttctccccatgttaacttagaacatttcttaatgtactgtagtattaaatggttattagacaattttcctacc

SEQ ID NO: 213646 - DNA, 368 bp, Homo sapiens
ctaatagtattttcttatttgttcacttgatttggttattgttctgttggttgtaacttgttttacaggactcacttgtgtccacacatctgtgatccctttgaaccttaagaatcaaaccattgtctgggagcggtggctcacgcctgtaatcctagcactttgggaggctgaggcgggccaatcacgaggtcaagagagtgagaccatcctggccaacatggtgaaaccccacctctactaaaaatacaaaaattagctgggcgtggtggtgtgcgcctgtaatcccagatactcgggaggctgaggcgggagaatcacttgaacccgggacgcagaggtttcagtgagtcgagatcatgccacta

SEQ ID NO: 213647 - DNA, 591 bp, Homo sapiens
atcggggaaaaaaagaatcaagttttgaaaagtatttcttagctcccacaaacaacaaaatctgccaataaagtatgattatgatcaccaagtgctccaactgcaattactcttctgtgtgtgtgttggggctggtgagggagcagaatacaaacaaaagcaaaaactacaaaataaggcatgagatctaactcaacaatagcatttgtagaaggcaaatagaaggtgaaaacttaagcactttagtaaacggttaagttaaaggaaatgaaagtgtgaaatggctgggggggaaacataaattataaacatgcaataaaacagaaaactgagaactagacaggaaagagtgctgctctcctatgcagtagagtgttagtgctttcagttctaggttccacctttataaatgcataaacaaactcaaacagattcttagaaaatgaccaagatggtaaatggatatcattattagatggttttctagggattctcagcctagagaactgaaatgtcagagagaacttggtaagtcttcaaataattgaaaagttatcacaaggaaaaaggattacatttgtccaatatatc

SEQ ID NO: 213648 - DNA, 1600 bp, Homo sapiens
gaaagtttaggaaccactgacctcaccaataccactttttccacagcaaataggttagaggaggcagaatccaaatccaggatgctatgaatcaaaaggtcaaccctttctcttctgccacggtgcacccccttccctcccccggccaaggccccagcggggtctgcaccctgcctcaggcccattctcttcttctgtgccccactccaccccacccaggatgacttgttcgcggacctggccaacctgagccacctcttcctccacgggaaccgcctgcggctgctcacagagcacgtgtttcgcggcctgggcagcctggaccggctgctgctgcacgggaaccggctgcagggcgtgcaccgcgcggccttccgcggcctcagccgcctcaccatcctctacctgttcaacaacagcctggcctcgctgcccggcgaggcgctcgccgacctgccctcgctcgagttcctgcggctcaacgctaacccctgggcgtgcgactgccgcgcgcggccgctctgggcctggttccagcgcgcgcgcgtgtccagctccgacgtgacctgcgccacccccccggagcgccagggccgagacctgcgcgcgctccgcgaggccgacttccaggcgtgtccgcccgcggcacccacgcggccgggcagccgcgcccgcggcaacagctcctccaaccacctgtacggggtggccgaggccggggcgcccccagccgatccctccaccctctaccgagatctgcctgccgaagactcgcgggggcgccagggcggggacgcgcctactgaggacgactactgggggggctacgggggtgaggaccagcgaggggagcagatgtgccccggcgctgcctgccaggcgcccccggactcccgaggccctgcgctctcggccgggctccccagccctctgctttgcctcctgctcctggtgccccaccacctctgactgcggtgctgagatcgaagaggccagtgtccgatccccgcttcccgtccacccggggctgcggctccggccccagtcgccccaccttccctggccttgctgcctccctttcccctcccagctcctctcctccccggggagcaggccgcctctccttgcctgccccctgggctgtcctgacttgtggcagccccaagagggcgtgtgtggtggctcagccctgccctccccagttctggccattaactcttccccatcccaaggctggggtggggccccccaggcagccgctgacccgcactcctaagggcccacagcggacaccagaggggcttttgtctgcagagcgtcttccaccagcagagcctttggaagctcccccagggagccccacccaggaccctttgggggatgcctcagtcagggccaggctgaccctgacccctgcttaccctagtcccctcaacctcctgacactggaggaatacttttctcctaagtctaccctggacactttttagggcacctggagagaactttcctctccactgtggcccctgcgtggtgaagatcaaaagaagttgtttgggaaaaaaaatttattaaaaaattctattattttatctactgt

SEQ ID NO: 213649 - DNA, 2253 bp, Homo sapiens
aagagcttcctcgctgtccccactctccctcggctagcagcctgggcacacggacagacggactgacggactctcgagcggacagcgcagctagcggggcgcgggcgctgggcgtcgacggccagccccagccttccccgccccgtcgcgccccgccccgtcccgtcggggccgatggctcctcccgaggcccgcagcccgggcggcgcagggtagagcgccgcggcccggccacgcagcccggggactcccgggccctcccggagccccgcggggtccccgccgtgcatccggcgggctcagggagcgagtgggagcgccctccccccgctgccccctcccccgagcatcgagacaagatgctgcccgggctcaggcgcctgctgcaagctcccgcctcggcctgcctcctgctgatgctcctggccctgcccctggcggcccccagctgccccatgctctgcacctgctactcatccccgcccaccgtgagctgccaggccaacaacttctcctctgtgccgctgtccctgccacccagcactcagcgactcttcctgcagaacaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacctgcgctcgctggagcccgacaccttccagggcctggagcggctgcagtcgctgcatttgtaccgctgccagctcagcagcctgcccggcaacatcttccgaggcctggtcagcctgcagtacctctacctccaggagaacagcctgctccacctacaggatgacttgttcgcggacctggccaacctgagccacctcttcctccacgggaaccgcctgcggctgctcacagagcacgtgtttcgcggcctgggcagcctggaccggctgctgctgcacgggaaccggctgcagggcgtgcaccgcgcggccttccgcggcctcagccgcctcaccatcctctacctgttcaacaacagcctggcctcgctgcccggcgaggcgctcgccgacctgccctcgctcgagttcctgcggctcaacgctaacccctgggcgtgcgactgccgcgcgcggccgctctgggcctggttccagcgcgcgcgcgtgtccagctccgacgtgacctgcgccacccccccggagcgccagggccgagacctgcgcgcgctccgcgaggccgacttccaggcgtgtccgcccgcggcacccacgcggccgggcagccgcgcccgcggcaacagctcctccaaccacctgtacggggtggccgaggccggggcgcccccagccgatccctccaccctctaccgagatctgcctgccgaagactcgcgggggcgccagggcggggacgcgcctactgaggacgactactgggggggctacgggggtgaggaccagcgaggggagcagatgtgccccggcgctgcctgccaggcgcccccggactcccgaggccctgcgctctcggccgggctccccagccctctgctttgcctcctgctcctggtgccccaccacctctgactgcggtgctgagatcgaagaggccagtgtccgatccccgcttcccgtccacccggggctgcggctccggccccagtcgccccaccttccctggccttgctgcctccctttcccctcccagctcctctcctccccggggagcaggccgcctctccttgcctgccccctgggctgtcctgacttgtggcagccccaagagggcgtgtgtggtggctcagccctgccctccccagttctggccattaactcttccccatcccaaggctggggtggggccccccaggcagccgctgacccgcactcctaagggcccacagcggacaccagaggggcttttgtctgcagagcgtcttccaccagcagagcctttggaagctcccccagggagccccacccaggaccctttgggggatgcctcagtcagggccaggctgaccctgacccctgcttaccctagtcccctcaacctcctgacactggaggaatacttttctcctaagtctaccctggacactttttagggcacctggagagaactttcctctccactgtggcccctgcgtggtgaagatcaaaagaagttgtttgggaaaaaaaatttattaaaaaattctattattttatctactgt

SEQ ID NO: 213650 - DNA, 855 bp, Homo sapiens
gaacaccttcaacacttggaaactgaacagcacacttataaataatctatgggtcaaagaagaggtctcgagggaaatccaaaaacatactgaactgaatgaaaatgaggataaaatatcaaaaattgtgagacatggctttatccactgctttaatacagccgcactgagaggaaattttgggcaagaagaaaattctgaaatgaatagtttatgctcttacctccataacctagaaaaaggagaacaaactagacccaaggcaagcagaaggaaggagataataaaaatctaagcagaaatttaaaaagatacagagaagtaatagagaaaataaatgaaagaagtggttctttgaaaagatcaataaaattgacaaacctctagcaagactaacaaaaaaatggaggacatagattactattgttaggaaggaaacaggcaccatcactaaagaccctgcagacaccaaaagaataatgaaggaatacacaaactactctacatgcatagtttttaaaacttaggttaaatagaccagttccttaatgagcatgaactgtcacaactcacccaataggaaatagactacttgaataccctgtaactataaggaaattgacctagtaatttataatctcccaaaaaagaaatcttcaggtttcactggataattctaccaaacatgtaaagaagaattaacactgattctacgcaataccttccagaaaacagaagaggggggatcatgtcctaattcattttgtgaagctagtattaccctgataccaaaaccaggcaaaaagaacagaaaaagaaaactacagaccaatatccctcgcagattcagataca

SEQ ID NO: 213651 - DNA, 482 bp, Homo sapiens
ggacagtggagcccctgcaagtcatgaaaactgatggggcagggaggggagctccagccagaaatgggaagtgtctcaaaccttagtgaagtgatcttgaatctgatttacagggctgattttgacacattattctcaagaaaacagtggtttaggtcatggtctcaagctctatctagattgaaattctgtcaggcatgttagctcacatttgtaatccaagcactttgggaggcaaaggtgggaggatcgcttgagctcagaagtttgagaccagtctgagcaacatagtgagataccatctctacaaaaaattcaaaaattagctgggcatggtggcacacacctgtaattccagctactgaggaggctgaggcagaaggatcacttgatcccaggaggttgaggttgtgatgagctgtgatcatgccacagcactccagcctgggcaacagagcaagaccctgcctcaaaaaaaaaaa

SEQ ID NO: 213652 - DNA, 335 bp, Homo sapiens
ttacatccaaccaccttatacatttgaacacttcacgatagaaagccatgagacacagctgcttttattcaaaggccattgaataaagtagtagagaaagggttcaaataaccaaatgtaaaataactgtacagtttcatttaacttctactttattcataactatgcagatgtctgtgtgtaagcacaggccaaactcctaccttgcaaatctatcataatcttctggaattacactaatttttcatggagaagctcagcaagcattgctttgcaagaaatgaagagaagctttaaataatttacagagcctatctgttaggcctaagtctgat

SEQ ID NO: 213653 - DNA, 531 bp, Homo sapiens
cttgttgcacattgcatcttcagataggttcatgtacataattacgatttgtacctcttgacctacaccttcccattttctcctcctcacactgataactacttttctactatctccacttctatgtatttaacattttttagattccatgtataaataaagtcatgcagtatttttctttctgtgtttggtttatttcactttgcataatgtcttccaggttcatctatactgtcacaaatggaagcatcctcttatcttttaagtctgaataatattcctttgcaccacaatttcttttttattgtttatatctagaatgtatgtgaatatatatatatatacacccgtatatatacatatgtgtgtatattatatgtaatatataggttatataatgtaatatataagtttcaggaccctcaaacttccctgggagggtggaagaaatcatttctctagtgcttgatgctcaccagttattaactccatgtatacacaaggcgtgtgagttcatattaaaatctattt

SEQ ID NO: 213654 - DNA, 226 bp, Homo sapiens
cctgcctgcgggaggactaggttcctcaatccttctcctgaggtcaggctgggactagagtgaggcaagcaaggtgcctagggcaaaattttaaggaggcttgccctcccaggtgcacctgaatggccctgagggccagtgcccccttaaattgtgggcccttaggtgcctccttgctttacccaccatgcccccagccagccctgaccctgctgggtgttctggc

SEQ ID NO: 213655 - DNA, 203 bp, Homo sapiens
ggaatggaatggaatggaacaacccgaatggaatcgaatgtaatggagagtaagggagttgaatagaatcaatccgaatgtagtggaatggaatggaacggaatggaatggaatggaatggaatggaatggaatcgaatggaatggaatgcaatggaatggaatcaaccgagtgcaatcgaatggaatcgaatggaatggaat

SEQ ID NO: 213656 - DNA, 681 bp, Homo sapiens
agtaattcaaatatttaagctggtggatctctatcttgaagcaatgcaatcatggggttgagtcacatgacacacagctttcacatagccagctggaactctcctttccctgattacagattcgccttctttcttacctatagtgttttgtaaaatgttgtaaatgactgaagggaaacaggaaagaccctttccctcttcactttttttttattaatttaataattttttcacaattttatactgcctcaggactatttttctgtgtctatattttaggaaaaagttggaaagaccagaacattgaatatgagtaccaaaaccccaggagaaacttcaggtaatttgtacttacaagacaaagcagtgtctctctagacaatcttagaatatgacaatatattaaaaataagtaaaagaactaagtccaggatcaaatacatttatttttagaatatttgatcaaaaaacatatatataaatgtgacctaggctgtgggctcactcctgtaatcccaatcctttgagaagtggagataggaggatagcttgaggccagcagttcaagaacagcctgggcaacataacgagaccacatatcaacaacagcaaaaaattagctgggcattgtggtctgtagtcccagctactcaggaggctgaggcaggaggatcacttgag

SEQ ID NO: 213657 - DNA, 819 bp, Homo sapiens
tgttcctccagacactgagggggtcgcattccttacctcacctttgtccctgcgcgggctgcggctgggatccggtctttccagccccgagagggacctggttcctctgcccaggcttctgtcactctgtcacctacgctatgccctgctgtagtcacaggaggtgtagagaggaccccgggacatctgaaagccaggaaatggacccagtggcctttgatgatgttgctgtgaacttcacccaggaggagtgggctttgctggatatttcccagaggaaactctacaaggaagtgatgctggaaactttcaggaacctgacctctgtaggaaaaagttggaaagaccagaacattgaatatgagtaccaaaaccccaggagaaacttcaggagtctcatagaaaagaaagtcaatgaaattaaagatgacagtcattgtggagaaacttttacccaggttccagatgacaggctgaacttccaggagaagaaagcttctcctgaaataaaatcatgtgacagctttgtgtgtggagaagttggcctaggtaactcatcttttaatatgaacatcagaggtgacattggacacaaggcctatgagtatcaggaatatggaccgaagccatgtaagtgtcaacaacctaaaaaagccttcagatatcacccctcctttagaacaccacaaagggatcacactggagagaaaccctatgcttgtaaagaatgtggaaaaacttttatttcccattcaagcattcaaagacacgtggtaatgcacagtggggatggaccttataaatgtaaattttgtggga

SEQ ID NO: 213658 - DNA, 707 bp, Homo sapiens
tgttcctccagacactgagggggtcgcattccttacctcacctttgtccctgcgcgggctgcggctgggatccggtctttccagccccgagagggacctggttcctctgcccaggcttctgtcactctgtcacctacgctatgccctgctgtagtcacaggaggtgtagagaggaccccgggacatctgaaagccaggaaatggacccagtggcctttgatgatgttgctgtgaacttcacccaggaggagtgggctttgctggatatttcccagaggaaactctacaaggaagtgatgctggaaactttcaggaacctgacctctgtaggaaaaagttggaaagaccagaacattgaatatgagtaccaaaaccccaggagaaacttcaggagtctcatagaaaagaaagtcaatgaaattaaagatgacagtcattgtggagaaacttttacccaggttccagatgacaggctgaacttccaggagaagaaagcttctcctgaaataaaatcatgtgacagctttgtgtgtggagaagttggcctaggtaactcatcttttaatatgaacatcagaggtgacattggacacaaggcctatgagtatcaggaatatggaccgaagccatacaccaatctcactctgtcacccaggctggagtgcagtgggcgtgatctcaggtcgctgcaacctcttgctccaggg

SEQ ID NO: 213659 - DNA, 453 bp, Homo sapiens
ttgctttgtagaaccctctagaaagaagacaaaatgctcttagataagctttgtaatacaatctgtattaaaaagtagatggtaggttttttagagcacacaatgttggtccattttcctcagtacgttgaatacatgtctgtgggaagacatctcatattcattctcccagtgttgatttgaggagatttttttttaggctggggagaaaagaggggcctgtaggctagcttttgccaagaccttgttccacaagtgaggctgtcttgaagagtataggacctgtgcaattgcatagggcaccgtgcttaggggagccctgagcttgggtcattgtcttaaaattgttaaaaatttgtcaggaaggaacgccacattttcatttttcactgaaccctgcaaattagccggtcctgtcaactagagtgttactcttaatgccactcatgaggc

SEQ ID NO: 213660 - DNA, 756 bp, Homo sapiens
aaagaccctgacattgatcaagaatacaagagagaagacacaaatgatcagttctatgaatgaaaacaggcattaagaggataaagagaggatattatggactattttgtataacaaaaatttagataatatggacaaaatcctagaaaaataaaacccaaagtgaagaaatagaaaactgaaatagtcctaatgtgactaaagatattgattcaattttaaacttccctacagagagaactccaggtccagatatcctcactggcaaattctatcaaacatttaagaaagaattccaatgttagctgaactatatggaaaaataaaagaagaatatacattctaactcatattatgaagccagaatacccttgataccaaggcctgaatggagtgagtattaaaaatttataggtcaagctcgtgaacaaaagtgcaaaaatcctaaacaaaacattaggaaaacgaaccagtaatacataaaaggacaatatatcacaaattaaattgggcttattctaggaatgctatattaacagcttaatggagaaatatcatacacctcaatagatgcagaccaagtgtttgataaaattcaacatatattcatggtgagcatggtaagtactcttagaaaactaagaattttttgaaaagtccttaatctaatacaggttgagtataccatccctgaaatgctgtttcagattttggaatacttgcatcatacttactggttaaacatccataatctga

SEQ ID NO: 213661 - DNA, 313 bp, Homo sapiens
gttctccttaactgcctcaattctgtgtgacatccagatgttggtacacagggaataaacttaaggatcttcatcagatgtcactgaccagcaaggctgtgaaaacaatactatgtgatgatatgattttgttcagtgatgagaggaagcagtgagttgcctgtactactgatttcatccatgaaaattaagagtagccccaaaattataagaccaactgaccctgccctctcttttaattacacaatatgtttggccaggtttgttgttgttgctgttgttgttgtgacagggtctcacttcgtcacccagg

SEQ ID NO: 213662 - DNA, 487 bp, Homo sapiens
agactgttgtcattaaaccccactcctgtttaggaaaccccagggccagaccccactgccggaacaggaccctctcgtgcctgcagatggcaaagctcctgagggcctgatggaccctccaatgtcccacggccacagtttccaccttgacgccgaagccctgggatggcccctctgcaacgcccagtgctccatcatgacctggccccaggacgctgactgagggagcggaggggatcgggaccagggggaagcagccccccagtaaatccgaagcacaggcacggcacagccccaagggagaccttgtaggcgcctggccagcagggctgaggagaaagtctccactgcagggcgcctcctgggcccacgccgtgtggtcctggccccaagctgcccactgggcattcagcctggacagctctcggcgctggagacccagaggacaaggggacagcaacatcaaagaccacagcgacccgaagcc

SEQ ID NO: 213663 - DNA, 301 bp, Homo sapiens
taggctaaattatgatgtttggtaggttaggtgtgttaatttttgacttaatgatattttcaacttatgataggtttatcagaatgcaaccccaccacaagctgaggagcatccgcatttaagcacaaagtcaaaaaggcagattctgtttgctttctcaattttatctcctcctccctttactactaaatgcacctaaaacctttcttcccaagaccaccaatagcctcccagttgctaaaccccactggacatctggcatcttggttgcaccctgaaactggtgactactctacatctt

SEQ ID NO: 213664 - DNA, 450 bp, Homo sapiens
caacagaaatacattccggatggtcaatgccttgaaaacatatcctaggcggcacaattaaagaggctgtgaatgtttactctggacgagaggatgtttggaggcagatattttcacatatctgcagggctgccatgcagatgaaaggaaggtagtggacacgactgtgtgccaggggtttccatgcactgtatacccttctcctccgcagggacatagccctgtcttcctttttttttttaaatcaagggtagttaacttgctcagaatcacagccagacacaggagcaccaggtctttattacactcagttgctcccctggaagtaaacctgttctgattggctttggggggcaaagtagggtcattgggtggatgttgaagggatatgaaatttaagctcagtacaaagtaccgtcttaacaaagtcattaaaagttagaatgcgtt

SEQ ID NO: 213665 - DNA, 237 bp, Homo sapiens
attatggctaatattatatttttggatgattagaaaaatataaaaatgagtaaaagaattttcaataatttggatcaaaatccctggaattagccagtaacagtggatcatgcctgtaatcccagcattttgggaggccagagtgggtggatcacttgagctcagcagttccagaccagcctgggtaacttagtgaatccccatctctatagagaaattaaaattttaaaatatttt

SEQ ID NO: 213666 - DNA, 508 bp, Homo sapiens
agatggaccatcccaactagtaggacctggaaaagagggaatattctttctgaatggtgcctcaggtatgatatgtttaggaaattgatgaccaaatatatgctatcagatattcattttgcctgggagaattttctcctttagtagccatgttacttttcaatcactgagaagcattttcttggctatcatatttagcctgctaaaaacagtgcattaaatggaataggcatcttgaataataagacaaaaattcatatttgccatttgaaagtatatttctttcataaatgcagtcctataataaaacgaaatcattttgtaatattgattttacttgttttagatttgcttcaaaatatagagaagtgggagagtggatgggattgaggttgaggcaggaatggtcatggtgagtcattgttggggccaggtgatggatagatggtgattcattatactatatgccccccctttgtatatttgaaataaaccaataaaatgttga

SEQ ID NO: 213667 - DNA, 145 bp, Homo sapiens
gaccacaatggtcactggaccaaaggagaacacagggcttgggcactagtcctgagtctgcctgtatttgggtgtgtgcctttggtcaagtgaccattgtggtccttagcttcttccaggtttcaaactttatccaagtataatt

SEQ ID NO: 213668 - DNA, 404 bp, Homo sapiens
aaagaaagtgtcttcttattcttccatcagtctttgcagagtaaaaggaaatggtatctgtttggtgctagcggtatcccttaaaatgttgatagagaaaagtatattttacttgccaagatatctttaagatgaaaaggaaaatgtttgatgttcaacagatgtctagtgactgaacttattacttatatcaaatcaatttgagagatttgaaaaactaaggggattggatcatgatagaagtaccatatgcatggtgtcatctctcattcgaagtacgtaagacagaaagggaatgcctttatatgtatacgaattggactgcaaggataagcaacaaaataaaatttaagtaacaggatttcaaaaatcgatgtagtcctttataaaattgatttaaccac

SEQ ID NO: 213669 - DNA, 457 bp, Homo sapiens
ggtgggagaattctgtttttcgctaaagggagctgtcagttctcaaaacacttagttcctgaccccctaccttcaaggccccgagaaagccaaacagagaatctgacagccagaaaaatttgtacataaggcattaaagaatactcaatatactttaatttctagccctgctaatccatcctgttgtcaacagcaaaacaatcaaatacagccagttgtctgcaccgaggtaactgggctgtagtatggggttaggtttgccacataacctaaggtaatgcatggcagagggcactttaaggggcaacggctctttggaactcagtggggggtgccctttcgttagaacagggaaagaaaggcaggtccttttgcatgggaaaaaaaaaatcacaataacctaatccctttagagagccatcagacccgtaaagattaaaaaacaaacaaacaaaca

SEQ ID NO: 213670 - DNA, 406 bp, Homo sapiens
tgtattagttatctattgctgtgcaacaaattaccttataatttggcagcttaaaacagttaacattttattatctcacaaagttgggatttgggaagtggcttagctggcaggctgtggtgcaggatctctcactaggctgtgctcaaaatgttgacgggggccaggcacagtggctcatgcctgtaatctcagcactttgggaggccaaggagggtggatcactttaagacaggagttcgagaccagcctggccaacatgatgaaacatgttgaaacatgttctgtatttttagaacatgtttaaatacatgaacttaaacaggtatttaaacagaaatacagaaattagccaggcatggtgacacatgcctgtaatcccagctactcgggaggctgaaacagg

SEQ ID NO: 213671 - DNA, 996 bp, Homo sapiens
tgctgggattacagacatgagccaccacacctggccgcaaggtgacttttgaactgaaacctaaaccataggaaagaaccagccacatggagatgtgggctattccaggcagagagaaaaatcccaagagcaagggccttgatgtgggaacaatcttagcagtatgacagaagcacagcgagcagggttgggaccacatcacgtagggcctcataggccatagtaagaattgtattctaagtatagcacgaggctactggagcattttaagcaaaggaaaaattattatcaactttatttcttgaaatcacactgagattcctttttttgaggaaatagagtcaatgagggaaaaagtcgaagcagagagggagaccagttatgaaattattacaccaatctaaggagatggtggtagcttagggtggtagcagtgaagatagctgaagtgatgaaatttgggactgatcggatcaactgacttgcagatgattgaataaaaggattaagggaagaaacaatggaggagacactgggttttatctgaataattgggatggtaatgggatcatgagtcaagatggggaaaactggagaatagcaagtttgtagagtagaggttgaggggttgggaacagcagaattcagagttctattttagatttattatgttggatagaccaatctgacatccgggcaggtaattgtacaaaagagtttggaatctgagggagagagagagccagagagagaaagttgagaattaccaactttgtataaataatatttaagttcaaaggactggaatccctcatcctaggaaagaatgtagatagagatatgaagaccaagccctgggacatatcaacctcatgaggagatggacccagcaaaggctacttaaaagaaacagtgagttggggacaaggagagaaactcagtagggtgtggaggtgtggaagtcaagaaaagaaagtgtttaaggaggcaatagtg

SEQ ID NO: 213672 - DNA, 245 bp, Homo sapiens
ggagaaacgaacaccctttgtaagcatgtgaaaagtttctggagtagagagatgatgaagcaggatattggagtcaacagccgaagtttttatcttattttttattttgtattatactttaagttttagggtacatgtgcacaacgtgcaggtttgttacatatgtatacatgtgccatgttggtgtgctgtacccattaactcgtcatttaacattaggtatgtctcttaatgctatccctccc

SEQ ID NO: 213673 - DNA, 405 bp, Homo sapiens
gaactctcccccattgccctcatagtatctctggcagtgatgactacaaagacacctgggggatagttaccaaaccatagctttgggaccatacaggagttctgggtggccaggtttacaatggaagcagtaaatatcttacgcaagtgggccagatacctctggctgctccacacctgcttggacaatgagcaccttcaccacaactgcaatggactgagatggtcccccaggttttccggattgggtaagccctggggtttttgcatccccacaaagtctctgaaattagatgttccacaaacctggcaggtgggggtgaagctaaatttaattggatttgaattagacagataaaagtttgatttgattcagaaataaataaataaatataatgttcttcta

SEQ ID NO: 213674 - DNA, 459 bp, Homo sapiens
cagggaaacaatgatttaaatgactagaatttctcatctgcaatcatgaaggccagaaaacagtgaacacctttaaactacagtaagaaaataactgtcaacccagaattatatatacatcataaacatttttcagatatgaaggcaaaataaagttattttaagatgagggaaaactaagagacttcttcactagcagatttactctacaaaaaatgctaaagaaaattttcaagttgaagagaaataatgtcagagagaaatctggaaacagaaatgttttgttaagagtaacaaaagtggcaaatagctgggcacacctaaaactcaatttttacctctttatattatacttacattatctattacatctacatacattgcaacctcacaaggtaatgttatgattttgattttaaagaggcatacatattttaaaaaacataagagggaaaagtt

SEQ ID NO: 213675 - DNA, 165 bp, Homo sapiens
tgcatgtagctccactgataaagaataacaatgttttatgaacctttgtcaggtcttttaaaatgtatagtgaaggataaaaatcactgactggtaaaggaagttaaaatgaatgttcatagtgctttctcctttggaaaagatactttctaagaaatgcattat

SEQ ID NO: 213676 - DNA, 657 bp, Homo sapiens
gaaggggccctgcacttcggtgagtagatctcagatttggaaggatcttagatgtcgagtttgaagctttggtttaacagagattgggctgcagagaagtgagctctaccccccaccccagaccccacagctcctggtgggaagcagagctgagattggggtgaaggggcctttccaggtcctactggcccatagtgtcaggaccctggctgtttgggctgtgggctctcatgggacctggagcagggggtgtgacaggacaggaatcccgggggcctgcaccagaacatggcagtaccttggagagaaccaccctgaatctttctggtccccatgtcctctgtttccttcctcagtttttagtcctgtccctctttctcaaggtctgtgtgtccatcccatctgtttctctgccaacttgaagctcagggcaactctcctcttccctggactcatagtggctgctgcgacccctccccccagcttcacttccttccatccagagataagatcctgggcccaaagaggggtcctgatgagcttggggggccattgatcccgagaatcggacacagctctgtgtgtgagtgcatattccaggaaaggggtctgtagctttcagtagacgcttcaagatctatgcagtcttgtctgttg

SEQ ID NO: 213677 - DNA, 552 bp, Homo sapiens
atcatttaatatccaggctgattaattcagctgggaagcagtctatagaagctagtatggattccattccttggtgagtcaaatcacttatttcttagaagaaatggcattagagcttaactgtttttctagctcttgcaaagcatgtaattgatgcaaaattagctaggtcccaagcaataagatccaagaaagatctgctagctggacaattttttctaatccacattaaaataaagacatatataactgttaaaataaaaatgtatttatacacatgcatcttacaatcccacatttgactggtgatgcatgggccatgcttggggaaacactgcaagagatgtgattagcctgggctttggggaggaactgagttcaaattttgcctccataactaacttggtaaccgagaacttaaccttcttagccttcattttctcatctcagggtggacttactagtagttcctacttcatatggcatttttcagaattacttaagctagtgtctataaaggataatgtgtagtacctacaaaatgttagtaaa

SEQ ID NO: 213678 - DNA, 428 bp, Homo sapiens
cagcttacgtaggtctttaggtatttgtggcagggagtgtttaccttaatgtcgggattaacgttaatgggaaaatgtctagaactatgctgtccaatacaggagcttctagtcaaacatgtgactatcgagcatttgaaatgtggctagtctgaactgagatgtgtgcacgtgggaaatacacaccagagtttgaagaattagtacaaaaaaactcattaatgatttttatgttgattgcatgtggaaatgctaatattttagatatattgggatgtattattagcttttcacctgtctttttttgccttttaaattgtgactattagaaaatgttaaataatcttaaattatatatatggctcacatttgtactttgcattatttttctttcagacagcactggtctagcgtgataggagaggagg

SEQ ID NO: 213679 - DNA, 103 bp, Homo sapiens
ctgctttatattacttctcctatgcctttcagcttttgtctaaggaaaatggtttttgtagacatcaaacacttggcatgcctcatcccttctgtgggattac

SEQ ID NO: 213680 - DNA, 438 bp, Homo sapiens
tagggaagaaagagagagagagagaaagagagagagacaagtaaaataaagcaccacctccttgacctgactcagggcgtttggggtcttctggggaaatgttctgaaacaatggagtattttggtctgttctttcttgtgtctttttttttttttttaagacggactctcgctcagccacccaggctggaatgcagtggtgcactgggttcactgcagcaaatatctcccgggttgaagcgattctccagtctcatcctcctgagtggccgggattacagtcacgcgccataatgccctgctaatttttgaacattagtagagaaggggtattgccatgcttgcgacgctggacttgaaggcaaaatgaaaatgaaaatgaaacgcaacaaaataattaaaaagtgagtttctggggaaaaagaagaaaagaaaaaa

SEQ ID NO: 213681 - DNA, 308 bp, Homo sapiens
tgcacgtgtaccctagaacttaaagtataataaaaaaataatgtttatatttagagcagatttagggtcacagaaaaatggaacagaaaccatcaagttcccacagagcccctgcccatccacacatacacacggcctccctcactatgtacatttattacatttgataaacctacattgagacatcataattatccagtacatagctaacattcacttgtgtgtgtgtgtgtgtgagagagagagagaaagagagagagagagagattgacagggtctcactatgtcccacagggctggagtgcagt

SEQ ID NO: 213682 - DNA, 290 bp, Homo sapiens
gtgtggtgggctcaggatggttatacccattttatagataggaaactgggtactagagaggtctaataaatgtcccagaatgacccagcaggaagtagctgactacgactccagcccagggcttggggctctgtgtctggtgctccttcctaggctggcgggatgaggccatgcttgccaaagtcacccgggctgcctctggcccaaagtgacggagcagttggtcagctagtcctccaccccgaggcctctgagaagagaggaaacaccggtctgcgggggattcctcc

SEQ ID NO: 213683 - DNA, 738 bp, Homo sapiens
gctacatgaaagtacagtgagttaaacggagagatagaaagcaggaagttggaaagggaattctgatagtgatccgttccttgattccaatttttccagagtcctaacttgagacttcttatccccttggactttgactcagcaagatgctttggtgcgttgttaatatctttgcttccttcttcagctaagtttacttggcctatttaaggacagtcacaaaagagagttaatggataccaaagtttggaagagacagcactatctcactgtaacttggaactgaaccagatggggtctcgttgtgctgcccaggttgctcttaaactactgatctcaagcaatcctcccacctctggctctcaagtagctgggattacaggcaaataatgatggaaatctggggattcttgatgggccgttgagattctaatgggatctggtataaacacattttagcagagacttacttcctctctgaagttttcctgacgttgaaatataccacaacaaactcagtactgtcaaaagtactggttcttaaatacagagcacatatatcactccagtggaagagttcatcagatagtgagaatctcacctataaatctcaagcatgcctgccaaggagtctcaagtcaggaacagaggagaaaatagccatcaaatagggcgtcttgtcagtattattcaaatgtaatagaaaatcaaattataataaaacatttaacataccaa

SEQ ID NO: 213684 - DNA, 682 bp, Homo sapiens
atcaatggaacagaacagaaattcttatattctattctgaaagagagtcacactagtagggccaaatgacttttgacagaattacaaaaccataaaattaattcaatggaggaggtagggccttttcaacaaatcatgttggaacatttgagcattaggaggaaaattttaaaaacccttccaaagctaaatactcaaaaacctttaaactaaacctcaaaccttgtacgaaagttaaattgtgaagactatagatctaaacataaaatgtataaaagtttaaggaaatataagagagaatctttgtgaattattagtttttttaggatgagtatgagtacatatataatggatacaaatctctccttttccatcattttttatagagacttacttcctctctgaagttttcctgacgttgaaatataccacaacaaactcagtactgtcaaaagtactggttcttaaatacagagcacatgtgggtattgtttccatggaggttccatattttctatggtaacatctctgttttaatgtctgctgactgtattcatgaacgggactggtgttctgtgtgtgtgtgtgtgtgtgtgtatgtacaagtgtgtatgttgtgtagtgatgttgggcagataaaataaaaaccagaagactgagtgaataaccaagagaagaaatt

SEQ ID NO: 213685 - DNA, 649 bp, Homo sapiens
gctacatgaaagtacagtgagttaaacggagagatagaaagcaggaagttggaaagggaattctgatagtgatccgttccttgattccaatttttccagagtcctaacttgagacttcttatccccttggactttgactcagcaagatgctttggtgcgttgttaatatctttgcttccttcttcagctaagtttacttggcctatttaaggacagtcacaaaagagagttaatggataccaaagtttggaagagacagcactatctcactgtaacttggaactgaaccgtaagtggaaattaatattctataggtaatgaaaattcttcaggaatatgcaaagcttttccccctaagcctcggaagtacaaaatgacatattaagtttaattcacttaatagaaaaaattaaatgacctctataattattaatattgttaatagttcctttaggatgtttggcagctttctttattacaacttttgttctttttctttagtcaaggatttgttttattatgtttaaagaaatgagcaaaatatatacattccataaaataattaaaaataactacccttgagatttcagaccccagatattggcttcaaatgttccagattacaaattgattcaccaaatctgagatg

SEQ ID NO: 213686 - DNA, 672 bp, Homo sapiens
cagattcaaccaacagctaaaaattatttactcacatgcttagtttaaaacattctggtatcataccacaccacactgaaaaacatcacgacgtactgtatgtagtggaaccaaataaatacgctaaagagtattttccagtattcgctgttacaaaatcataacatcctatgatacaaacaacgagattgtataacgtccccacatcgttttttcagaactaacaaaaaaaaaaaaaaaaagtggagaaactcagcaaaaaaaagtggcgagaaaagtcgggggaggggcggtagaagagaaggggcggagaaacacgacactgaggcggtgatatcacccacagccaacggcatggaattcagaaagttaagtgtcacccagcaatctcggtgcggactcgcggcgcgcctgcacagcgtggcggctgcatcccagccaagcaggaagggggagggggaggcctgactgagttcgctcgggggcagctgaggggagggctgcccgcctcccggacggcgcacgttcgagtcccgggtcgggagacttgtccgtcgcccgacaatgatttcatcttttcggaagagctgccgcctgggccgcggctgccacgtgcctggtctggccccgtgcgctgcgccgggggacctacccggacggggccgcggccgc

SEQ ID NO: 213687 - DNA, 1219 bp, Homo sapiens
gtgacgctttcattcttcacagctgctatctgatctcatgctaatcagtgtttttctgacaacaaagtcaaggtttctcagaagagactgccagatgaaagaatgggacaaaagacagaagcccgtttctgtacccagctggacaggtgaagtcatttaggtgcaggatgatctggccattccaaatatgcacggctttccaattttgttaaaatgaaacccagcctttgaaaaggcccggacttcctacaatgcacagtatttatagcgtggagggcactgtagagacgtcatcagtgtattcacaacagcaagatccacggaggctctgccatgtgccaggcatgagacaactgtttacagaaaacatctcatttcatcctacacagagtatacagactgcttcacagaacactaccaaagaggaccatcaaatgatccccaggaagtaatgagtgccttaaaataaagaaatatgaagggccagtaacgccccactgaagaacgctctcctggtggttatactctgtagtatggagcacaacactgccccatgctgcgcgaggctactattctatactacactactatgatcggtttgttctattctatactattccattctctacgatacaatattatactgtttcattctacactatataatactgtactatctgttctattctatactattttcttctatactgaaaggagttagccagcttgctttaggcagacagtaagcgaagggtcccagacagcctccagcccatgttttgtgcagataggggaacttgctcagggggcttgcctaaacatgctcacagtagactgagggtccccatacacatgggggaatggggtggagccaccagaaattcgctccttatgcaaacagggagcccagccccatcagcttctatgtaaaagcccttgtagtcaactgggaagggggcaaccagcaacctgctctcaggacccctctttttgctgagacctttccttttcgcttaataaattctactgcactcagtcttcgatgtccatgtgtctgtttcttcctggttgtgagacaagaacccggacccagctgagctaaagagcaaaaatcctgcagcagtgctacagaacactgtcctctctgttctgtgctatgcgactctactattccacactacgctatgtaatagtcactgccatctctgttctgtgctat

SEQ ID NO: 213688 - DNA, 993 bp, Homo sapiens
ttctcctgcctcagcctcccgagtagctgggattacaggtgtgcaccaccacgcctggctaatttttgtatttttagtagagacgggttcgctctgttggccaggctggtctcaaactcctgacctcaagtgatctgcctgcttctgcctcccaaagtgctgggattataggcgtgagccaccgcacctggcccaaattgacagttgatcagatgtgctagtgctgtttagatggagttacttaaaaggcagagcgtgtccctgcatcagctccttttggctgtgatttcctctcacacttggttcggtttctgttggttttccaagtagagctgcactcacgcttgcccaggtggggctataaagagaacgtggtgtggcagcaaatgcttctccccacagacacagatctcagcacattgctgttcaaagactttgggggtttgcttttgtttttttgttgttgttgtttttgttttgttttgtttctgcttttaatcattggcaaggtttggatttactggaaattattttagaatttctggctcattttatacaattaactgtagccagaatgaagtaaaatgtctcaccacatcgaaaggaatctaggccacatgagaatttgcatttttaaattggcattgatgtgggaggtgagatagtgaagttggtcacatgcgtagatggttgccaggcatttcactgtgcccatttccagaatccaccccgagatcatagacaacccactacaaatgggtcagaatgaaggtgttgggtcagattctctttttatttgattttgaaaattatttccttgtgtccttcctactttcaagtaggaaattagcccttgcctgcctctacattgtgggttcatttgatcagctcaagtccatttaaagctgattttccaagcagtagctgcacattcgggctctagaacctagtaggggttctggatgctaggggccgtgtttcaagattctcaca

SEQ ID NO: 213689 - DNA, 596 bp, Homo sapiens
cgcgccctccctccccatcccacccccctccttcccctcgatccagccctcatgaccctgaccctggccgcggctgcaggcggctcgccaggcgcgcaccctcggtcccacctccctctggctcgggcctgagcattccgcagcctcggccggcccgggcctcttctccgctgctctgctcccccaaggactttctgtgccccactcctacccaggcagggctgccctgtcttgggtcctttacgggggaccattccccagcgtccctgagacactcatcctgggatttcttcccctaaatacagacattctcaaaccaaatgagacctcgaggtccctacacctgatcctgcctcccactccctgagccacactgagaaggaaggtctctcctttagggaggactctggcgcctgcaaccttgatcgacagcaaagatgtccagtgtgtatcctgcatctgcctttcctgaccattctcgtgccccattctccgtgggatagattctatggggagtgggggagcttcggtgtggagaacgcatgatggaattcataaggtgagcagaaactcaaggaaaactgtccaaataccgg

SEQ ID NO: 213690 - DNA, 526 bp, Homo sapiens
tgggggcctggtagcaagcttcactgacagccacagacagcccttgctaggagcacagattgggacctcacagtccaggccctctcatcctccccccaaagtcacatcattcccctgtcctcacctcctagaggaacccagtggggaggcccccagctgtgggtagcattaatacccccacatatatccatccccctggggaaatgagagcacccagaagacttaactgcagcgggaaagaaattatccttaaaacagatgagcttggtcagaatggaaactcatttccccaccggaggaaaacaaggaagagaaacagacaaggaggaagaaagaaggcaggaacaaggcctggagctcttgtcgtcatgaaggtgatgaaagtgtttacttgcaaagtatagccatttcttccctagaaacaccctctttgctgaggcagcgggaaagggtcggcctggtctgttattccaggggctgaactggttggtgttattaaacttttgttagttatcatatcataata

SEQ ID NO: 213691 - DNA, 295 bp, Homo sapiens
aattaggttaatggttaaaagcacaggttttggaattgaaaataattgtttcaacccttaccttcccctttcgtgctgagctaagtagtaataccatcatattttgggttgttgtaggaataaatgcagtaacacttgtaaatcacttaactgagtgcatatcttcaaaaatactgtgtaaatgttttataaaagcataattatttttattttttatttgtatattttatttgtatatttagaagtttccaatagttgctaatttgaataaagagtaatagaatgaaataataga

SEQ ID NO: 213692 - DNA, 820 bp, Homo sapiens
gatatatatatatatatatatcatccatatatatatatcatccatatatatatataaaatccatatatatatatatatctccatggagatatatatatatatgtgtatgaatgaagcacttagtaggagcttttgtgacccattattaagcaaaatgaataaagttcattaaaatgaaactgtatttgattgctttagagctttgattttttttttttttcttgaacaaattctgcagaaaagctaagtggaattatttaccacttgggttggatttttggttatccttcctatttaaggccacacccagcaatcctaatagagttgaatggctgtgtttttaaatacgcagtgattctattggactcatgccaagcagcatcctggattttctgtgcatcagtgtctatgtgtggattagcactgacatattacataccagccaatgtcctctgctctcttcatgtatgctggtttgcaaaaaaaaaaaaaaaaaaaaaaaaagtagaaaaattaaaaatgctgaatcccgcagaaagtttccactccccagaccaaactgtgtgcatagcggggagaagggaccagatggccagtgggttgaaatcagtggaaaaccagctgggatgcatgagagggcatttcctcttccacttccctggaagcctggtcggggcaagtcctggaggtctgagcaggacaagaggtgtcaatgtcatggcctctgtctggctttctggatccttagatgaattgcagttggattggaatttggcacaaaaatctgaggataagctgttagttttctgctttctggaaa

SEQ ID NO: 213693 - DNA, 397 bp, Homo sapiens
aatggcttttccctgatgtcggagttgttatgtcagttctgggagaccaataagaccttgtccttcctttggatccatcagaaaaagcccctgggtgggtaagatggatggcagggctctcctactctatgtcttttctcacacctagtgggtataagagaggggaccacaaacagagggggctctggtaccacttatccagggtctggaaacattttctgtaaagggccagataataaatgtttcaggtacaactactcaaccttgcatcatttcagaaaagcagtcagataatacataaatgaatgggtgtggctggacttgtcctgcggtcccctgtcttatatcattgtattatatcattttttcttacatacaaatttagaagcaatactta

SEQ ID NO: 213694 - DNA, 385 bp, Homo sapiens
atttattattattattagtttaatgtttgcatgatggcttgcatatttttgaaacaagttatttagtataaacattaggcagtttatatttactgtatttactgtttgctttatcaacaggtagaaggtcttgagttcgctgacgttactctcaaaatactttcaggtaattgttgtcaaacaagagttgacaatttgcattttcttgattactaatggtgagtattttttctttttattttattttatttatttatttatttatttttatttttaattttttttgagatggcgtctccctctgtcacctaggctgggttaggttatttgccagacaaacaataatgacaaataaccttggaaaagaaagtatgttaatatctct

SEQ ID NO: 213695 - DNA, 991 bp, Homo sapiens
accgttttcaagtgaccaggatgaagacactccagtttttcttccttttctgttgctggaaagcaatctgctgcaatagctgtgagctgaccaacatcaccattgcaatagagaaagaagaatgtcgtttctgcataagcatcaacaccacttggtgtgctggctactgctacaccagggatctggtgtataaggacccagccaggcccaaaatccagaaaacatgtaccttcaaggaactggtatatgaaacagtgagagtgcccggctgtgctcaccatgcagattccttgtatacatacccagtggccacccagtgtcactgtggcaagtgtgacagcgacagcactgattgtactgtgcgaggcctggggcccagctactgctcctttggtgaaatgaaagaataaagatcagtggacatttcaggccacatacccttgtcctgaaggaccaagatattcagtctgtgtgtgtgcaatgtgcccaggggacaaaccactggatcaggggattcagactctactgatccctggtctactggcagagggaactctgggaattgagagtgctgggggccaggactccatcatgattcagctctatattcctaggtctgatttcataaggtttattcagtcttaactcacagacttgtgcctggtttcttctttaaaaatcttagaaatcttctcaggcaatgcctctctcttagggggaaacataagcctagaaggaggaagcagtaatgggagtgagtgaaagaactaactgcagcagtcttctggtagactcttgggccctctagagcaaggtcagcatcttcagcattgtagcgtcaatgcctagcactctgcctggaacttagaaacacaacaatgacttctttagatcagaaaggtcaagggtagaaaatactggaagacgatgtttgaggtaagctgatgaggctgcccgcagccacaccagtcccatgaaagttagtggcatc

SEQ ID NO: 213696 - DNA, 984 bp, Homo sapiens
ggaaactcaatttggaaaataatttcgaaaatgattgtgagcctgaatacccagcatgccaaatgttttgtcacatagcattttaaaattttatttatttgtttgttttttgagacaagtctcactctgttgcccatgctggagtgcaggggtatgatctcagctcactgcagcctttgcctcctaggttcaagtgattctcctcccttagcctcctgagtagctgggactacaggtgtatgccaccatgcctggctaattattgtatttttttttttagtagagatggcgtttcaccatgttggccaggctgatctcaaactcctgacctcaagtgatccacctacctcagcctcccaaagtgctgggactataagtgtgagccaccgcacctgccatttggattggcaatctgcaagattttattacttaaatgcaacagatgttctcattcattgttctgaagcttggagttccaatgaaaaatttaggtggagaactgagtttagaaaatccatataatgtttagtaaaactagtatttcataaatgctgaatgacagagattggtctttaaattaaaacaacagtgtgatgttgggtattttttttctttcaaaatactaaggattagatcagtggtcagcaaactacagctgatagcctgtttttgtaaataaagttttactggaaaacagccactcttactcatttgcagattgtgtatggctgctttcatgctatgatggcagagttgaatagttgtaacagagattgtataacccacaaaatccgatatgtttacgaactggctcttcatggaaaaagtttcctgacctctcatctagatcaatggggttgtacgttaccatttaaaaatatttaggttgtaatctatcctcttattacttgtatttatgggtaactattttgtaagtaaggctgtttcgtatagaattaacgtggtttaggtaagcattcagaa

SEQ ID NO: 213697 - DNA, 930 bp, Homo sapiens
ggaaactcaatttggaaaataatttcgaaaatgattgtgagcctgaatacccagcatgccaaatgttttgtcacatagcattttaaaattttatttatttgtttgttttttgagacaagtctcactctgttgcccatgctggagtgcaggggtatgatctcagctcactgcagcctttgcctcctaggttcaagtgattctcctcccttagcctcctgagtagctgggactacaggtgtatgccaccatgcctggctaattattgtatttttttttttagtagagatggcgtttcaccatgttggccaggctgatctcaaactcctgacctcaagtgatccacctacctcagcctcccaaagtgctgggactataagtgtgagccaccgcacctgccatttggattggcaatctgcaagattttattacttaaatgcaacagatgttctcattcattgttctgaagcttggagttccaatgaaaaatttaggtggagaactgagtttagaaaatccatataatgtttagtaaaactagtatttcataaatgctgaatgacagagattggtctttaaattaaaacaacagtgtgatgttgggtattttttttctttcaaaatactaaggattagatcagtggtcagcaaactacagctgatagcctgtttttgtaaataaagttttactggatggcagagttgaatagttgtaacagagattgtataacccacaaaatccgatatgtttacgaactggctcttcatggaaaaagtttcctgacctctcatctagatcaatggggttgtacgttaccatttaaaaatatttaggttgtaatctatcctcttattacttgtatttatgggtaactattttgtaagtaaggctgtttcgtatagaattaacgtggtttaggtaagcattcagaa

SEQ ID NO: 213698 - DNA, 524 bp, Homo sapiens
cagcaatgccagcgtcatccttgagggcgaggacctgcgcttctcctgcagcgtccgcatggcaggaaggctgcagggtcgcttctctgtcatctggcagcttgtggacaggcagaaccgccgcagcgatatcatgtggctagaccgggatggcaccgtgcagccaggctcgtcctactgggagcgcagcagctttgggagcgtccagatggagcaggtgcagcccaactcattcagcctgggcatcttcaacagcaggaaggaggacgagggccagtatgaatgccatgtgactgaatgggtgcgggtggtggatggcgagtggcagattgttggggagcgccgggccagcactcccatctccatcatagctcttggtgagtgagcggtgggactggcagtgggtctggcatggagacagcttcagtgtcaaacaccttatcctgacttttgtctgtcagagttctagcaggaaactatggccagtcttttacctatagagtttgaagtactttcctttaaaa

SEQ ID NO: 213699 - DNA, 428 bp, Homo sapiens
agtaaaatgggttatcaaaggcttagtttgactagaaggttaaaaggagctaaaatctagaacttgctgttagtcgtataccaaatgctaagcactcctttgcaaatgcagggaccaggtagtaaccatagtttccattgtaaagcctggacatagactgacagcatcaaaacttatcatttgtatcatctgtgaagacagcaccatcacaaaactaaaccacatgggtttcaaattacttcagcaaggcacatggtagtagtggattgtgtatcttaaactatctctgagatttactttacacatacatgtaaaggaccttggcctattaaataagactatttcttaaaatagagtgacagtcccaattctcttcaaatttctgagtactcaaatacaagaagacaaaaatacactcatgctttaag

SEQ ID NO: 213700 - DNA, 456 bp, Homo sapiens
aaaatttgcatatgaatgttcacagaagcactattcataacatccaaaaggtggaaacaatccaaatgtctatcacctgatgaatggatacataaaaagtggtatatccacacaacggcgtagtattcagtcataaaaagtagtgaagtactaacatatgctataacatgatgaaccttagaaacatacacgaagtgaaaaacgcccgtcacaaaaggccaaacgttgtgtgattccatatatgaaatgtccagaataggcaaatccataaaaacaaaaaacagattactagttaccagggactggcagtggggggaaaggagaggatggggggtgactgctaatgggtatggagcttctctttggtgtgatgaaaatattctaaaattaattacgattatgattgtacaactccatgaacatgctaaattaaatcactgaattgtatacttaaaa

SEQ ID NO: 213701 - DNA, 270 bp, Homo sapiens
  misc_feature (232)..(232): n is a, c, g, or t
  misc_feature (255)..(255): n is a, c, g, or t
cagaaaaagtttgatctagaaagatacacaacaaactatgaatcagcagttacctctggggtggaagttgagatggaaatagggagatttttcacttttatttgatagacctttatgttgtatttatgtatgtatgtatgtatgtatgtatgtatgtatgtatgtatgtatttgagactgtgtctcactctgtggcccaggctggaggttgcagtgagccgagattacaccnctgcactccagcctgggagacanagagagactctgtca

SEQ ID NO: 213702 - DNA, 448 bp, Homo sapiens
tcttgttcttcgatgtagttttgccatgtcgcccaggctggagtgcagtggcgcaatctccactcacggcaacttctgcctcccgggttcaagcgattcgtctacctcagccttccgagtagctgggattataggcacccgccactatgcccagctaattttcgtattttagtagagacggggtttcactatgttgttggccaggctggtctcgacttgccttggtctcccaaaatgctgggattacaggtgtgagccaatatgcctggcttcttctttttaaattttatttatttatttattttaaaaagaaaaaggttttaacctgtcttggtcagcatgcctccaagaactccgactttctttctttctttctttctttctttctttctttctttctttctttctttctttctttctttctttctttctttctttcctttctttc

SEQ ID NO: 213703 - DNA, 606 bp, Homo sapiens
gggcatgagagtattcagtcttatacacatcaggatacactggatttctgcatttgtatcagtagtgttttttcaactctgctgtgattatctcatggaaggaaggattgaagcaaacatgtagtcagagtcctctttgagcttatgtagaacttggggtaaatcctacagttacttcttcattatccttcctctttactcactagaattttgaataggataaaatcaggttaatagaatgctgaggccagcctcaagggaagaaagctacacatggtaagaggatagctgggagcttggatgctatttggtgaaacgggcagatttgccttagtgctggtcattgggatgatagtggttatagatagccctctacacatttggaaagatgtacattcaacatgttacttcatcctcacaactgtaggaggtgtgaaacaggtatttttattcctgttccgagtggggggatcctgttccgagggcaatggtttgattcacagggggagctgggtcttctaccttattcaggtccctcttattatctgcccccgggaaggtaatcacgtctgcaccttaacgatcacactgctgggattagagttt

SEQ ID NO: 213704 - DNA, 537 bp, Homo sapiens
gagccaccacccacagccatgttttgtttttgtttttggagacagaatcttgctcgtagtcccagctggagtgcaatggcacaatcttggctcattgctacctccacctcttggtctcaagtgatcttcccacctcagcctcccaagtagctgggaccacaggtgtgtactgccatgcccagcaaatttttaaatatttttttgttgagagacgagccttcactctgttgcccagtctggtcttgaactcctcggctcaagtgttcatcccaactcagcttcccaaagtgctgggattacaggcatgagccaccatgcctgcccagctatgggtttctcataataccctttatcatgttgagaaattttgtttccattcttagttttctgagcttttctttcttaaatcatggaaggtattagattttgtcaaatactttttctgtgtaaattgagataattatgtggatttttttcccttaattctattaatgtggtgtattacattgattgattttctcatgttgaaccatcctt

SEQ ID NO: 213705 - DNA, 429 bp, Homo sapiens
tctgtcttgcatgagattgagtgtgattctggggatgcaaatcaggatgtctctgggaagaattgcattgtgtaggttatttcaatttaagaagtagctgcaagaagattccaaacacattttgcctcaagtcacctcaagtttctaatcttcctgctggagctgcctttgcagtgaaaataagaactggcctaatgatgtgaagacaaaaccaacagaaatactgatgtcattgggacatattagcagaatggccttttaatttgtaaaattctccaaagctatgtctatttgactggatgtaaatatagacatgaagtagtttggagaatttgttgggggaaggatatgaagaaaatattctcattgggcagtcaatggtgtttttaaaaaatatcaaaaaaattaaaatccccatcattgctgttg

SEQ ID NO: 213706 - DNA, 476 bp, Homo sapiens
attttttttttccacatttatcatggttattttacgtctctatctgataattccaattctatgtgtgggtctgcttctatggaccactctcaagaatattctgttgatcttgggccacactttttttccctcatgtcttataattttttattgagtgccagatggtttctgtaaaagagcagtagaaatttacagaaataatagtcatccccagaaaagggcacaccacttctcttattaggctgctaattaggagactgagtggattaagtctacagttaagcagagtctgggttgtgccgctgctttagttagattcggttcttcattgccttcaaatgtgtcgagagcagaaccttctcttcagcaggacttgggacttgagtcccagaaagactctagaatctctttacttattgttaatccagtaaccaactttctgaaccaagggatatctcttgctgctttacaggcca

SEQ ID NO: 213707 - DNA, 205 bp, Homo sapiens
tatgtcccttgaagagacagcacaagggagagctgcttaagtcttgtaaaaaaaaattctggaaaactttagctccctaaaactgaagaattgtatcaaaactgaagaactgtatcagttctagcaggtttctactgactttcctattttaaacaattatctttgtttctgaaaactgattcaataaactagtttttaaaagaga

SEQ ID NO: 213708 - DNA, 501 bp, Homo sapiens
attgtggcacatgtctccagtcctagctacttgggaggctgaggcaggagaatggattgagcccagaaggcagagattgcagtgagctatgatcgcgccactaactccagcctgggtgacggagcaagaccctgtctcaaaaaaaaaaaaaaaaaaaaaaaaaaaaaaaatcatcatttgacacgtattttgattttaaaattttagtataaatgttctcaaaaagtctattgactcagtattgaatcttggctttccaattctgccataagtttttcttttttgtggagattctcaggaatcatcttgtgataggatattttaaattctagttgctcggtggatacacagaaaactgttaaatttgtttacattagggaacctcgaacacaaataccatataagttagtatttgttctttcatatgaaatattttaaatgctttttaaggatatcttgtgcaatctactgatttagtaccatcagaactttgatttaaca

SEQ ID NO: 213709 - DNA, 421 bp, Homo sapiens
ctatttcctggaaaagaagcataaagccaaagggcctgagggcagccgcaggtctttttgaagcgatgaggtgtgcagaggcagatcagggggtatatgtgcaggggttgtgggaagcaggcctaaaagagggaagaggaaggtcaggtcaaggatgaggccaggtgcggtggctcacgcctgtaatctcagcactttgggaggctgaggtgagtggaaaacttgatgctaggagttcgagaccagcctgaccaacatgacaaaaccccaactctacaaaaattagccgggtatggtggcacgcctttgtagtcccagctgcttgggaggctgaagcaggaaaatcgcttgaacctgggaggcagaggttgcagtgagctgagacgctccaacctgggcgacagagtgagactccttctca

SEQ ID NO: 213710 - DNA, 527 bp, Homo sapiens
aataaaaacaagtaagatagaccgggcatggtggctcatgtctgtaatcccagcactttgggaagctgaggcgagtagatcacttagggccaggagttcaagaccaacctggccaacatggtgaaaccctgtctaccaaaaatacaaaaattagccatgtgtggtggcacacacgtgcaattccagctacataggaggctgaggcaggagaatccttgaacctgggagacggaggttgtagtgagccaagatagtgccactatactccagcctgggtgacagagcgagactctgcctcaaaacgaacaaacaaaaaaacaagtaagatagtgatttaccttcttatttctgttcaaggacttgggtggcccagagcctatcccagcagctcagggtaccaggtggccaccaagccctgaacagggcaccatcccatcgctgcacctttcacacacacccacacacactcacactgggactgtgtaggcatgccagttaacctcatgtgcacatttttgggattctgc

SEQ ID NO: 213711 - DNA, 183 bp, Homo sapiens
acctagagtagcttctgtttcctgatcagatgcagactgctaagattgcatctttcgcctactttaacaagggacaaaagccatgggataatacagcaagaaggcctacaccagaagccaacatcacacttttggacttctcagccccagaactgtgagccaaaataaataacttttctttat

SEQ ID NO: 213712 - DNA, 788 bp, Homo sapiens
  misc_feature (593)..(593): n is a, c, g, or t
  misc_feature (634)..(634): n is a, c, g, or t
  misc_feature (676)..(677): n is a, c, g, or t
  misc_feature (681)..(681): n is a, c, g, or t
  misc_feature (706)..(706): n is a, c, g, or t
  misc_feature (718)..(718): n is a, c, g, or t
  misc_feature (750)..(750): n is a, c, g, or t
  misc_feature (754)..(754): n is a, c, g, or t
  misc_feature (787)..(788): n is a, c, g, or t
ctaactgatatgtttttatagctattgctggtttgggcaactttgacacttatgtcagcttcctattgtgatgatagatgaggatttagtttccttacactgtcaccataccatgcctttactgctttcctcccatcttcccagtgtagttttagcacaacttctgattaaattgttactcagtgttcacattactgtaattatgtaaacattgttccctgcccattcaagtgatgtactctgattttatttcctttcttgtacatgtttttttctttttttttttgagacagagtcttgctctgtcgcccaggctggagtgcagtggcatgatcttggctcactgcagcctccgcctctcgggttcaagcaattctcctgcctcagcctcctgagtagctggaattacaggcgcccgccaccatgcccagctaatttttgtatttttagtagagatggggtttcaccatgttggtcaggctggtctcgaacccctgacctcgtgatccacccgccttggcctcccaaagtgctgggattacaggcgtgagccaccacgcccggctttttttttttttttcccctggaggtanaatagtttcttatctttttatatgcttatttttaatggggngggctaatgggcttaaaattcccccccctttttttttcccanncaanggcttttttgggtccaaaacccaanaattcctttttntccccttttttttttccctgggcaattttccnaccnttaactgggggcccctttttttttttcaacttnn

SEQ ID NO: 213713 - DNA, 915 bp, Homo sapiens
acgcagaggaagccaggagaaaacagtcaatggctagtcatcactgattcgtggtcacaggcgttagaacaggaaggatctgcacagatcagcctctcccacccctcactttcctgataaaggaactaaagtccggaaagtacttgctcagagtcctactgccagtgggtgtgaaagccagaaccaccaccctcattgccttctgtatacatagctttaacagtttgcaaacactcttatatgctttaatttcatctgatcctggactgagagcaaatatttgtatttcaaccaaaaggccaaatgctcagtttcctcatctgagaggataataagagtacttttctaatggaattctttttttcttttaatttttggtagagacagggtctcactatgttgcccaggatggtcttgaactcctggcctcaagagatcctcccaactgcacctctcaagtgctaggattacaggcatgagccattgctccctgtcctctaatggaatttttgttaggattaaatgagttaatagtttggagatttgagagactataatagaggaaacctctcttcccttcccaagttctgagtaattaagagctgggcaaggagaaataaaaacaaatgggattggccaggagcagtggctctctcctgtaatcccagcactttaggaggccaaggcaagcagatcacttgaggtcaggaattcaagaccagcctggccaacatggagaaaccctgtctctactgaaaatacaaaaattatctgggtgtggtagtacacacctgtaatcccagctactcggaaggctgaggcagtagaatcacttgaacccaggaagtggaggttgcagtgagccgagatcaccccactgcattccagcctgggtgacagaacgagacttcatct

SEQ ID NO: 213714 - DNA, 537 bp, Homo sapiens
taaattttgaaatggagtttcactctttcacccaggctggagtgcagtggcacaatctcagctcactgcagcctctgcctcctgggttcaagcaattctcctgcctcagtctcccgagtagctgagactacaggcacatgccaccatgcctggctaattgttgtatttttagtagagacagggtgttgccatgttggccaggctgatctcgaactcctgacctcaggtgatctgcccgcctcagcctcccaaagtgctgtgattacaggcgtgagccaccgcacccagccgcctctttattcaagaagttttcacaagtagaggaaaatacgtgcctttttgcttatgtggcacattgtacttccttctttatagtaactgtctactcattcttctctacttctttagcctggaggatccttggagatggagactataccttcttcacagtttttaccctagtacttagcatagtaaatatttgttaattgaatgaaggaatacatttttgaaggaattgggaaagactttatgctg

SEQ ID NO: 213715 - DNA, 351 bp, Homo sapiens
attgctgagcaggagtatttgtggaagggaggagacgttagggaagcaagtctgggaagaacagactgtgatagcctttgaagatgtaataatcagtttggactctgtccccagggacaaagggagggggtctgtcagtggcagatggacacaaacagatgtttttcaggaagactgctggtagagggctgagggtgggctggatgggagaggaagatgcccatggagggccatcaggaggctgcaacactggtcaggtgaggccatcggaggccagatgaactgtgaagatggtggtatccccactctcgtatgttgttcactcaaaataaaaattattcacaaaacaca

SEQ ID NO: 213716 - DNA, 539 bp, Homo sapiens
catagtgccaaacccattcttagccaaaagggactttactgagaggggcctctaacttcctaaatcttagaagggattctaaccctcctaaatttgccttcaaatccagggtcggtcaagtttccttgctttttaataagaggggcttttaacccactttgacttaaggagagaccctaactcccctaagttgacctctaacccaatgccatccttcagccgagtacccaaccactcacccaaggtcggccaaccagtgctgtcatctctttcctttggtttggggctgagggctttcttcagtatcgtcccttcggggcttgccagaaagatgttaccagaccccaacacttacccaatattagcctttgagtcgggggttttctcactattgtcccttccatggttgccagaaggatgttacaggaaaggggtcccaatccagaccccaagggaaggttcttggatcaggcgcagaaaataattcagggtgagtccacagagtaaagtgaaagcaatttattaggaaagtaaaagaa

SEQ ID NO: 213717 - DNA, 166 bp, Homo sapiens
cgaggttccccggggcccaggcccgcgcgcaacgccccccaggctcccagtggggcctggaggacagtgtttactagagccaccccctgtattgggggtgggagcggagagaggtgagagaccgcccccgccccgtcaatagcagctaaagcctggtctacggttt

SEQ ID NO: 213718 - DNA, 465 bp, Homo sapiens
ctctccggtctcacccacctgagtagctgagtagctgggattacaggcgcacaccaccacacctggataattttcgtatttttagaagagacggggtatcaccatgttggttaggctggtctcagactcctgatcttgtgatccgcctgccttggcctcccaaagtgctgggattaaaggtgtgggccacttcacccggccaaaaacacctttgtggcttcttgataatagttttcactcatgtgttggagctaaaatgttaatcttatgaaggtaatgaatagaatgttgattaccagaggctgggaagagtactgggaaggggaaataatgcaggttgattactgtgaacaaaaataaacaaaaccaaagacaaaaaccacataattatctcaatagatgcagaaaaggcctttgacaaaattcaacaacccttcatgctaaaaactctcaatgaattaggta

SEQ ID NO: 213719 - DNA, 426 bp, Homo sapiens
tttctagcttgtaatcccagcactttgggaggctgaggcgggcagatcacttgagctcagaagttcgagaccagcttggacaacgtggagaaaccccatctctaccaaaaatacaaaaattagctgggtgtggtggtgcgtgcttgtaatcctagctacctgtgaggctgaggcacaagaatcacttgaacccaggaggcggaggttgcagtgagccgagattgcgccactgcagtccagcctggacgacagagtgacactatctaaaacaaaacaaaacaaaaaaattctatattacaaagattcccaagcattaagtgagagttgacttactaaagccctacagtactagacgtaacaggatttcagtataataaaggattttggataagattttgaaattcattaacattaaatctgccagca

SEQ ID NO: 213720 - DNA, 2428 bp, Homo sapiens
  misc_feature (2426)..(2426): n is a, c, g, or t
tggttaatctcactaatggtctattaattttgtttatcttttcaaagaatcagctttttgttacatttattttttggttttttttgttgttgttgttgtttggttttgcttcaattccatttatttctactctgatctttgttatttatcttcctctgctgggtttaggtttggtttgttcttgtttctctagttccttgaggtatgatcttagatggtctatttgtacttcaggctttttgatgtaggcatttaatgttatgacctttcctcttaaaactgcttttgctgtatcccagaggttttggtaaattttgtcactattatcattcaattcaaagaaattttaatttccatcttgatttcattgttggcccaaagatcactcaagagcagattatttaatttctatgtatttgcatagtttttatagttccttttggagttaacttctagttttattccactgttgtgtgaaagaacacatgatataattttgattttctgaaatttattgagacttgttttcgtgacctattatatgatctatcttgaagaatgttccatgtgctgatgaaaataatgtatattctgcagttgttgggtggaaagttctgtaaatatatgttaaatccatttgttctaggatacagtgtaagcccattgtttctttgtggactttctgtcttgatgacctgtctaatgctgtcagtggtgcattaaagtcgcccactattaatattgtgcagtatatctcatttctgaggtctagtagtaattgttttataaatttgggagctccagccataaatattctagagaataacatccataaaaactcttgtagacattggcttaggcaaagagtttatgaccaagaacccaaaagcatatgcaacaaaaacaaaaataaatagagtggcataattaaactaaaaagctcctgcgcagcaaaataaacaatcagcagaataaacagacaacccacaaagtggaagaaaatcttctcaaactatgtgatatggtttggctttgtgtccccacccaaatctcaccttgaattgtaataatccctacatgtcaagggcaggatgaagtggagataattaaatcatgggggtggtttctcccatactgttctcatgatagtgagtgacttctcacaagatctgatggttttacaaggggctcccaccttcactctgctctcattctctctcctgctgccctgtgaagaggtgccttctgccgtgattataagtttcttgaggcctccccagcgatgtggaactgtaagtcaattaaaccttttttaaaaaataaattacccagtctctggtatctctttacagcagtgtgagagtagactaatacactatgtatctgacaagaactaatatccagaatctacaaaaaactcaaaaaaatcagcaacaaaaaaaacaactaattccatcaaaaagcaggcaaaggacatgaatagacaattctcaaaagaagatattcaaatggccaacagacatatgaaaacaatgttcaatatcacttattatcagggaagtgcaaagtaaaaccacatgagataacactttactgctgcaagaatcaccataatttaaaaatcaaaaaagtaatagatattggcatggatgtggtgaaaagggaacatttacattgctggtggtaatataaactactaaaatcaccatggaaaacagtatggagagttcttaaagaactaaaagtagaactaccattgattcagcaatatcacttctgggtatctacccagaagaaaaggtgtcattatatgaaaaagacaccacacatgcatgtttatagcagcacaatttgcaattgcaaaaaatataaaaccagcctaaatgcccatcagtcaacagtgaataaagaaaatgtggtgtgtgtgtacgtgtgtgtgtttgtgtgtgtgtatgagtatgtgtatgcacacatgatggaatactactcagccataaaaaggaatgaaataatggcatttgcagtaacccggatggggttgaagaccattattctaactgaagtaactcaagaatagaaaaccaaatatcatacgctctcacttagaagtgggagctaagctatgagggcacaaagacataagaatgatataatggacgttggggactccagggaaagggtgggaggggagtgagggataaaatgatacacaatgggcaccttgtacactgcttgggtgacgagtgcaccaaaatctcagaaatcactattgaaaaacttttccatgtgaccaaaaaccacgtgttccccaaaaactattgaaatacataaaataaaatagtggagcatacttttaagaaatattcagagtagattttaaatagtctcaccacaaagaaatgataagtatatgagatgtgtgtgtntg

SEQ ID NO: 213721 - DNA, 411 bp, Homo sapiens
gttgcagtgagctgagatcgcgccactgcactccaacctgggtgacgagtgagactctgtctcaaaaacataaataaataataataatctcaaagtggattagacttaaacctaggacccaaaactataaaactactgacataaaacatagaggaaatactccaggacattggcctaggcaaaaattttatggctaaaacctcacaaaccaaacacaaaactgtgaacaaaccaaaacacaaaattgaaaaataggactatattaaattaaaaagcttctgcacatcaaagaaacagtcaacatagtgaagagacaacctgtagaatgggagaaggtatttgcaagtattcgtttaataaaggactaatatccagaatatataagaaactcaactcagtagcaaacaaaca

SEQ ID NO: 213722 - DNA, 269 bp, Homo sapiens
aggattccattcaccttgcttctgcgggcccagtgccacgggtactgtcctgagtggtttggaaggtgggtagccgctgatacagggacaggcagatgtgcagacacttaccaccctgtctaaaacaaaaaaaaaaaaaattgagagtgggctaggcatggtggctcacacctgtaataatcccagtgctttgggaggctgaggcaggaggatcacttgaggccaggagtttgagaccagcctgggcaacagagataacctgtctctac

SEQ ID NO: 213723 - DNA, 1029 bp, Homo sapiens
tggctatgtaagtttgtcacattaatatcttgagggagccttgttaaaaatagaaagtacccttgagcctgttattttatttcacaatctcattttggtgagacagcttttttcaaaactagtacaagttgagagaaaattgttgagaagcttcaaaacctgctttgcatttttattttatgggcttccctaaacccagtagattgagtgccaattaggaatgcctcgaacatctataagccttgtaggcttatacttgccttatataggctttgtagactatcacagtagtagatcatctattgttcattaaatctgctgcttttagaattcccagcatcagaattctgtgctttaaaagctgataccacatttttggaacattctaagactgtgggtcagtgacttcctatttgttttgatccccgccccgccttttatggaatctgatttggatttcataattcctatactcccatataacatctatgccgtgaaagatttataagaccatagtacattttttcctccatttactttctgtattgtggaagaaaagcagattttctggtgactggatgacatttattattacatgttgggagaacaggaagaagtagccaaagcgttcttttgactctgcttatgccaaaaatgcaggatggggcttgcacttcaagctcaaggatagccatgctagcatttcaaacgcattctgaaagctaataagatgatcattgctctctgctattatttaattttcaggctatttatttgaaaaaaaaattagcttgatggaggaggttatttttgaagaaataagaggatgtattaatttttttaaagacttcttcaacccgagaaaactggtatgagccttagccctggctaagactgaggtgggagatttgcttaaggccaggagttcgaggctgcagtgagctgtgatcacacctgtgagtagccactgtgctcctgcctggcaatgtagtgagtcctcatctctaaaaaataaaaattgaaaattag

SEQ ID NO: 213724 - DNA, 695 bp, Homo sapiens
tttggggtacatgtggtttctggttacatggatgaattgtgttgtggtggagtctgagattttggtgcccctatcacccaagcaccttacgtttatttttaaaaagtcttgggattttgataggaattacgttaaactggtatatcagtttggagagaattgactttgttgagtgttcaattcataaatatcatctctccatttatttgtattttctttgattttctttcagtcagcattttgtagttttcagcatatacgtcctgtatgtattttgttagatttacgagtaagtatttttattttgctcaatttaaacccataccaattaagttcagttttctaattagtgttgtcttcataattgctttatttataaatggcctttaaaaaagcattgatcagtatcaatagtagtgttactttattagatatggctcatataaagtcatgcagcatgaaatcaccatttaacatttaacaacagaatttaattctgaatggatactagaaagctagtgaatttctaaaacatacaaactagacaggttagtagtacttctccagtatttggaggctgtcagtttctgctgtttattgttacctctattaaggtactgaaaatgaaatgaagttttagtctgccagatttatgagtttttagaaactgaaaaaagattatataaggggaaaat

SEQ ID NO: 213725 - DNA, 382 bp, Homo sapiens
tgtcttccacagcagctgcaccattttgcactcccaccaccggtgcacaagggttccaatttctccacatccttaccaacatttgttattttctggttttttgatagtaaccatcataatgggtgagggctgtatctcaatgtagctttgacttgcatttgtctaatgattagtgatattgagtatctttttatgtgcttatcagccatttgtatatcttcagagaaatatctattcaagtcctttacctgtttttaatcgggttttttttttgttgttgttgttattgagttttaggagttctctgtatattccagatattactcccttcacagctatgtgatttcagaatattttctcccattaaaatgtgtttgtttta

SEQ ID NO: 213726 - DNA, 273 bp, Homo sapiens
tgttggggcgggatctgggcatcttggaatagcatttaggcggagctgggagaaagcgggagtgctctgggaataaggacaaaacttgggaaaaaaattggggatgaacagcagagggcaaggtccgagaatccccaagtgaagccttaatagaggattggggtgggacaggaaggggtgaggtctgtgtatgggatactgggaccaccccccaaccaggggtgcgtcatgagaggagccggccagggtcctagagacacggcggggaagggg

SEQ ID NO: 213727 - DNA, 209 bp, Homo sapiens
aacaagtctggaagttccactaatcttatttagggtaccctatttatagaacacctgagtgacatttatattaaaaggtacaggtaggccaggtgcaatggctcacacctgtaatcccagcactttggaaggcagaggtgcgcagatcacttgaggtcaggagtttgaaaccaccctggccaacatgatgaaattccgttatccactaa

SEQ ID NO: 213728 - DNA, 373 bp, Homo sapiens
tagagtagtagagtgtttaggaaaaggggttttgaagttgtgggcacatgctgtaatacagggaggctgcagaaaagtttctgtaagcctgcctccggttgaccatgtggtaccccactgagcagactggtgaacttacctattgagaggccctgtcccacattcctagcaaattttcagacctccttccatactggtaaaaggataaattctgtggtgatgaaaagcctattatagttacataccctttgttttcatgattccttgaagagctaagacatagagaaatagatcattaaaatgaagtttgtgttctgcaatattttatttgatgataggttggttagttttaaaattttgaccaaaataaaaa

SEQ ID NO: 213729 - DNA, 574 bp, Homo sapiens
ggcgtggtggtgtgcacctgtagtcccaagctgctcaggagactgaggtgggagaaccacttgggcccaagaggttgaggctgcagtgagctgtgaccgcactactgcactccagactgggcaacagagcgagacctatctcaaaaaaaaaaaagacttttctaaaacgaaaacctaacagaagttgttcctatgctaacagacataccttacaagaaatactaaagaaagttgttcaggctagaagcaagtgttctcaaacagcaagtaaagtccacatgaaaaaacatacaagagtacctgtaacagcaattgttaattataaaggacactataaatgtgtattttttctttcttctcttaattgatttaaaaagcaactgtataaaactatatatatatattataggccaggcatggtgactcacgcctgtaatgccagcactttgggaggccgaggcgggcagatcacgaggtcaggagttcgagaccagcctgaccaacatagcgaaaccccgtctctactaaagatacaaaaactagccaggtgtggtggcaggcgcctgtaatccca

SEQ ID NO: 213730 - DNA, 1026 bp, Homo sapiens
  misc_feature (916)..(916): n is a, c, g, or t
  misc_feature (1025)..(1026): n is a, c, g, or t
aagacagcacctttgaagggctctccttggacctcagtcccacagccagaaatttgacatcatgtttgagactcaaggatgacttggagtccattcctatcccacctgggagagagtctctgaagtcattggtcattcctctccaccctaaggaggcaaggtcgtgagcagggcacttcatctctctctcttcacatcacttctgggaaatgagtcaccagcaactattggaattccatagtggccaacttataggtctatacttaataccaaatcaaactgtttacaactttacatttctgtttgtgtgtatttataaatatatggatgttctcgaatcaacaggtaaaagaaaaatgggttaaattgttttgctaagacacccagtctttgtatatatgtctgcacacaaagacaaatgtgactgttagtctaccctttctgttctcttgttccgtcatcaaagtttctcttggctattgtcaagtgtttgaattttatcatgagtataaaattagatcccactgagatcccaccgctgctgtcccttgcttggtataaacggagtggttaactctcttgtggttgcaaagtgtttctctgtttaatggtgatgtgttcattcattcattcaacaaatatttaatgagcttctactatgtgccaggcactgttctaggagctggaaatttagcagcaaacaacagtatttgctaccggacgagagtgtccatattctgaaaactgttcaaatgtccacacaaatgccctcccggggccatttaaaacgctgccaggagtactactaggcggagcccgccgtaagtgaagtctcctaaccggcgcgctgcctagacggacacatgtggtctcagcggggcggcgaggccctctacttaactactgcgcatttttnttttagcgcacgcgacacggcgcagagcacaaggccgcgcgagcacaagagacctacagcacacccgcacgcggcaacaccccacgccgacccacggacagagcgtttnn

SEQ ID NO: 213731 - DNA, 536 bp, Homo sapiens
ttttgagcatgtaagaacatttagtataggagaactgtacagttaatatacatttttctttttgattcacttttcttctctaaagggagatttgggcatgtactttatagactgagtcaaaggtaattgactgcaaaaaaaaaattgatacagagttgccacttttaagaatgatttgatactgactagtagctctctgtcttttgtaaattccctcttattatagttagttgcctgatgattgttacaaatttactaatttggaagtaataaaaactttcgaatattcttccttttctcattgaagttctttaccttttctctttgaagttacttacatatccctagaggcactagtttatggtagaagttgttaagggctatgtttgtccatcatgaatgatggtgtaacatctgcatggtgttacttcttagatctttgttgattagaagtgataatcagctactctgactctgaatcaggtagtgtttatcaagcccatgacatctgttgttctgggtgctttgttcctagc

SEQ ID NO: 213732 - DNA, 812 bp, Homo sapiens
tattatgtggaatttcaataaataaagggaagatgagagttcccacatttatgtattgcctaactccatactataattatttgcctataactaagagaccatttttatctagtgttttgccttctgagtagaaaaactgctgaatttcagaaaagtcaaataagaatgaagtttcatcctgcagaaattttgtactttgtacataggtatcttttgatgttttgatttcaaatatatggaatgtgtagtttcaaagacacggcttttagaggtcagacctgaagaccagtcagcacttaactcactttccccagattgtttcctcaggcctcacgtgatcattttataagaaaagaatccgaatttatcaacaatgtctagtactgttcttttagtgaaaaaaaaaaaggtagtataataaattctcacttaacaatgttgataggttcatggaaactgtgacttttaagcgaagtgacatataacaaaaccatttttaccataggctaatataaacaagagttaagttcctctggcatatttctagtcacaaaaatatcacccagcttctaaatcaaaacccaaaacacttataatattaagcattgaaataaatgtcagccatatgcacatttttttaaattaataaaaacaagataattgcccaatttttggccaattactgagtaacagcagttgtggtggtgggttaaatcagggaataaatatttgcaaagataaaactgtaaggagcccctcctcccaccatacagctcaaaacaatcacaaatatggtgggctcattgagcact

SEQ ID NO: 213733 - DNA, 467 bp, Homo sapiens
cttaaggaaactagatgattttaagaccatagactagaccataaaaaaaaccataaaaaatgaggccgaattagagatactccccaaataccttgcattacacaaagaaaagctattagataaatattccaattcctggttctctctgtctctctgaatgttacagagaacaatctctgtaacattagatctctgtaacactcttcacactttctttcagagattggaggtgattctcccaggctttattattcttcatgaaagtcttctcttttgcagagtactcaaaaatttaaatagccatctaaaaacatctcaggtaaaaaatctgtcctctgcatttgaaaccaaaattattttttctcactaaaacacattttatttaatagtgaggtgaaattacattagccctcttcacatttatttgattcaaaccttttttaaaaaacttagattcttttaaaaaa

SEQ ID NO: 213734 - DNA, 559 bp, Homo sapiens
ggaaatagggtctctacagatgctcaagttaagatgaggtcattagagtaccccctaatatgaccggtaggttcccttataaagaggggaaatttagacatggagacagacacatacagaaggaagacaacgtgaagtcacacagagaccaccacctacaagccaaggaatgcctgaggtaccagaagctgagagatgcacagaacagagtctccctcccagctcgcggaaggaagcagtgctgcccacactgattttggacttccagcctccacaactgtgagacaagcctgttgtttgaaactgcccagtttgtggtagtttgctacagcagcctcagcaaactgatacaacacccagtcacctctgcaatcaacaagtcgttgccttgttcagggatctttcctggcatccctttttccttgctcctctgctcagcctctctaactcgtcacagtcagcacaggaggggtgacaacggatgagttcatactctgtgcccattcctatcttcttgtctgagcttaccgtgctcccctttctgggaacgtcttcaaat

SEQ ID NO: 213735 - DNA, 319 bp, Homo sapiens
ggaaatagggtctctacagatgctcaagttaagatgaggtcattagagtaccccctaatatgaccggtaggttcccttataaagaggggaaatttagacatggagacagacacatacagaaggaagacaacgtgaagtcacacagagaccaccacctacaagccaaggaatgcctgaggtaccagaagctgagagatgcacagaacagagtctccctcccagctcgcggaaggaagcagtgctgcccacactgattttggatcctgacctcaggtgatctgccctcctcagcctcccaaagtgctgggattacaggcgt

SEQ ID NO: 213736 - DNA, 503 bp, Homo sapiens
gcctcccaaagtgctgggattacaggtgtgagccaccgcgcccagcccaagcctgatgtatttgtttagggacagtgcttctgcgaggctcctgttgttcactgctcagtttgcacgattgcagtttactgtggtgaactggtatcagccatggagttgcacttgggctatacctggcaactcaagttttgtttctaaaccagttaaactttcggataacagaacaaagttccacagaaatcaagatgccttagaacttgggctgtcatttcttcacttgtttatgttgaagaaacaagctgcgttttggcatgttttataatgagagcagcagaacacatgagagctgtgcccgtcaacaccaggagtacacagggcccacagggtgtgtcgggagctgctccaaataacatcaacaaaaaacagcagagtggacatgtttgtgacagctcactgtgactcactaatcgcatagtctgacatacttcttttatcttccttat

SEQ ID NO: 213737 - DNA, 497 bp, Homo sapiens
tttgctgtctgcagaaccctgagttgattgccacatcctccagcctgcaaattggtccagcagtctacgctaccttattgttgagtcaactcattctgctattgtaggcctatgacaatccactgggtttcaattcagtatccaaactgcataaaaactcaaggcacctttgtaaaattaagccttcttctttctgaccatgctgtgctacatttctgtgaatgaatcctaaagttgatgcatggcataatccatttggatgtcaaaagactaatattacctcagtcttatatttttggaaaaaattctaacttcctccagacaaatgaatgcctccgacagactaaggagaagccgtaataatggcatttttatctacatcctcatcttcaattttgttgtctgatgagttcaaagcttgtgctctcttcacttcacctccaggaccttggtctggaaaggtccttgaggtctggaagattagcaggagagagaca

SEQ ID NO: 213738 - DNA, 279 bp, Homo sapiens
atttcctttttctcatactagattccaaattgtattccatgattgtggctgcttatactgctctaattccaaacctttgctcaatttgtatacagaatgtcctttcttctttccctctaaacacctacatctcccttggcttcccacactaccacctagaactaaaatccatctatcctctaagaagtctccttccctttacccagaaattcttcttcagcagaacttctatggcacttaatctgtatcttttctgacaatgattgctttgtatctttt

SEQ ID NO: 213739 - DNA, 393 bp, Homo sapiens
aaaaaaagtgaagcacagaattactccataacccagcaattccactaatagatatatacccctaaaaggatgaaaacagataaatacctgtacatgaatgtacataacagcacggttcacaataatcaaaaggtaacaacaagctaaatgtccatcaacaaatgaatgagccaggtgtagtggctcatgcctataagctcagcattttgggaggctgaggcaggaggagtgcttgaggtcaggagaatcgcttgaacccgggaggtggaggctgcagtgagctgagatcgtgcccactgcacactagcctgggcaacagagcgagactctgtctcaagaaaaaccacaaagttacaaaaattagccagggtgtggcggtgcaacacgaattag

SEQ ID NO: 213740 - DNA, 209 bp, Homo sapiens
ggcaagaacgtgctgcacattctggggactgggacaggataagcacacgagtagatctaagtcactggaaatacctggttttgctgttggaggggggcttgcaggtgctcgttatattattacgctgttgtagtaaaacgatgttagttacagtattaaattgcaaatgtcagtatccatcaccgccaaaacagcgtgcataccactag

SEQ ID NO: 213741 - DNA, 600 bp, Homo sapiens
ttatttctttccttagaaacaaatttctctagggaagcttatcagtagcagaagtgcagactgggaaatggcctatgtcaccctcccatctagaaatgcccagtgcacatccagatcccacacccccaagagcgttgtgcaatatctgttaatttatgagagctgtttcccatagatgatgctgcaggcattagtaaggagggcaaagttcaagtgatgacaccatctctactccacctggctggtttccaggtgccatctcctgatccctctccccacccccactgccctctcaccatccttcccccaaaccccacactccccaccaatctgggtcagtgataaacacagagtattccacatgcctctgatatgatgtaacattcgacacactaaagataatactgcctttaaggctcctgtccccctggctagacttaaactgtgtagaggaggagaactgtgactttattccccttgcatcctggacacccacacatggtaggtgttcagtgaatatgtgatgagttggtgaatacccactgaatgtgctatttgcattgctacttccttgtgcttccttccactgtttctatcgcc

SEQ ID NO: 213742 - DNA, 318 bp, Homo sapiens
actcccttgtctggcctgggagacttagcaccctcatctctgagaagcagatgggccagcggggaaaggggcgggggggggatccccaggagaaaggctcaggctgggagactcagccaagcagtgcagacagggtgggtgcagaggcacaggccctgccggaggagacgccgctcacaggtgcttgccagagcacagtgaggccgactcgactcagagccgtctcgataggcgcagggaccatgcagcggagacctacccacccgtggggagaggtcaggcccaactcgaatgcagcacgggcaagtggatttctag

SEQ ID NO: 213743 - DNA, 523 bp, Homo sapiens
gactgcctatttgttgcagggggaaatatacagtgaagacacagaacaatacttcaaccaagtgatcaaaattaacatcaacaagttaatcatcagaaagtctcagacaaacccaaactggaaaacattctaccaaaaaccacacacacaaacacaaattaatgactatttttgttatggacaactgatcttcatggcaaataaacatttcctgaaggcagagatcatctatcacactatctgataattttaagagttggtggtttaaatggataatccctgcctagaccataagatgctaagtctcagacagtgtctttattcctctatgtttcccaactctggttccaaagaatagtgaagacacaaagcataatagttagaagaataatgaatttttaaactaggtaaacagaaatgtttataagttatgtaatattccatagtctcatctcaaccaaatttttccaaaagtaaacattttttcaaaactttttaatgtatataaaactaaaaaaacaga

SEQ ID NO: 213744 - DNA, 202 bp, Homo sapiens
gtctttctctctttctctctctctttcttttctttctttctttctctttctttgtttcctttctttctttccttccttccttcgttccttccttccttcctttctttcttctttctctttctttctttttcttctttctttcttctctttcattctttctctttccctcccttccttctctccttccttctgtctctctctc

SEQ ID NO: 213745 - DNA, 577 bp, Homo sapiens
atcgtctgcagattgtttccaactacttcagttaaaaccttaatagtttttgatagcttctttgctatcttgtataacaagatgcacctggcccattttgtacaattcctgcgtcaaacctggaatgaaccatttgtttaagcagcactagtttcttttagtgagaaatggtatttctcattaaagactatagtctggatgctagggatgcttattgctactggattgttcattgtctctaggcctaaaattaaagtacataataacacaggttgggtgtggtggctcatgcctgtaatgtcagcactttgaaaggccaaggcaggagggttgcatgagctcaggaatttgagaccagcctgggcgatatagctcactataaataattctaaaaattagaaaaaaaatacataacacaaaagcaggagaggggtattagaatttaacatgtttaaggttctagcattgtcagggaaatggtaaaagcattttaacaactataggtagccctttttcccacagaaagtattctggttctcaaggtcacctgggatatcacattgtaactcattgcttt

SEQ ID NO: 213746 - DNA, 366 bp, Homo sapiens
aattcacaggtccgggaacaaacagatttcttaaagagaaatcagaatggatgcctgtccctgttatacctaatgtccactgacaaaatgtttgtttctatcattctggcttttggctatgttgttttggatatttcagcactcaagagatcagggtacacaaccatagttagtttaatgaggggttgaaaaaagcaactggcatttttttttcaccaaacagtgggcataaaagtcaattatttcattagctgaagtgaatggttcagattattataggggagggggttgctgttaaacaaccaatggggtcctctgaggcacctcctgtactgtcagatccaggaataaaagatgatggaaaac

SEQ ID NO: 213747 - DNA, 654 bp, Homo sapiens
ccttcctgcctgctccccctgggcctgggcatcctggccaccacccaactccagacttgctttgatccttgaaaggatcaaatagatgccaagtaatttcactgcatcccagaacaaatcccagaaacaaggaattccaaaaacctactcaacaaagtaaaattcacaatgtccagcatccaatcaaataactaaaaggtgaaaaatattaatgaaatcagaggaattaagagtatattagaacagtatgtgtttacctcaaaagaagtcattaagggaggaaatgagaaacaaaaaagacataagacatagaaaactaatagcaaggccgggtggggtggctcacgcctataatcccagcacttgggaggccaaggtggcagatcacctgaggtcaggagaattgcttgaacccaagaggtggaggttgcagtgagccaagattgcgccactgcactccagcctgggtgacaagagccaaactctgtcaaaagaaaaaaaaaaaaaggacatgtaaatccaaccatattaataattacactaaatgcgaatagtttaaacactccaattaaaaggtggagattgtcaaactgaattcaaaaagcaagctacagaaacccactttacatacaaagataggttaaaagtgatagg

SEQ ID NO: 213748 - DNA, 520 bp, Homo sapiens
gaaacaatggactttggggacttgagggaaaagggtgggaagggggtgaggaataaaacagtctgtcacaagggtggagctgcccaaggctgtgggaacccaccttttgcatcagcatgacctggatgtgagacatggagtcaaaggagatcattttggagctttaaatatttggctgtctcactgcatttcagacttgtgtgagacctgtagcccctttgttttggccaatttctcccgtttggaatggctgtatttacccaatgcctgtacacccattgtatctaggaagtaactaacttgcttttgattttacaggctcataggcagaaggaacttgttttgtctaggatgagactttggactgtagacttttgagttaatgctgagatgagttaagactttggaggactgttgggaaagcatgattggttgtgaaatgtgaggatatgagattttggaggggccaggggcagaatgatatggcttggctgtgtccccacccaaatctcatcttgaa

SEQ ID NO: 213749 - DNA, 248 bp, Homo sapiens
tgctgatattactctccacagtattatatctgatcctgcaaagtagttcagataccagagaatactcttaaacattttgactcacgcaattaattatgtttaaaatttatgtaacaagacattaaatgagaaagaatggaatgaaaaatgggttaaaagaatgcaaaatcgcaaaaagaatgctttgaatttaaatatttccaaaaatttgattttctgagaaaatatattaaaaatcatacgtaatt

SEQ ID NO: 213750 - DNA, 514 bp, Homo sapiens
cagggagttcccctgagatagtgctgtgtagatagtcaccgacgactccacagctttgtgtctgcccctcaccacacagtaggcttcattctcaccatgaaccactgttgtcatttggggacaagttgaaagagtctatttcccttcttgcattaaaggagaaactgtcagcgggattgctgttaaccactgtggtggtcaccacgacctgagtctcgtgctagtgtttgagagactaagctctgacttttctagaaggtattattccagatcctgacccagggaagaggcatggtggaccagaaatctgcattttcccagagcaaagctacagactggaaaatggattgcaaccttgcacaggcttgactgttgttgacagaagctctactttctcctgctctgttctcttattattaaagggatggatatatcagaacaagtgtgtgtttgttgttttaaagtttgttttttttttgtcttcagttaagttaggctgcagggttgagagaag

SEQ ID NO: 213751 - DNA, 546 bp, Homo sapiens
gtcttgtcatttttttcaaggctttagactatttcacaatatggctgcaaccacaatttgtttacttatttgcctagtcacatttagttttatgtatatgaaattgcgaaatacttgccaaactgtattccacagaggttataccaattatctctccagcaagtatgaggactcctgtttccctacgtactcactactacagcaaagatatcaaacattgatacccaccaatctctggatggaaaaacaaatctcagggtaggtttatttgcattttcttactatgggggtaacgttgggcattttttccatttacaaagccatgtgtcattctttctctgtgaactctgaacattctatgcccattttttgctggactgttcatctttttcttatcagtatgtaaaatctctttgaaaattagatatagccccctacaagtgacaggaactgtacaatccccacatttgtacagtctgattttgtttatgctaatatttgccaggcataatttttctttttctttttttttttttgagacggagt

SEQ ID NO: 213752 - DNA, 524 bp, Homo sapiens
ctgcaagagttttttttaattttttatttaatttaatttgatttttttcgtaccccagtggtgcctggaatcccagcaagacagaacttttcactcccctggaaagggggctgaagccagggaaccaagtggtctcactcagtgggccctaatcccacagagcccagcaagctaagaaccactggcttgaaattcttgctcccagcacagcagtctgaagtcaacctgggaaaatggagcttggtggaggcaggggcttttgccattactgaagcttgagtaagcgattttcccctcacagtgctaaggaggctggtaaattaggactgagcagatcttaccacagtgcagcaaagcggctgtggcaagactacctctctagattcctcctcagtgggcagggcatttctgaaagaaaggcagcagccccagtcaggggcttatagataaaacttcagagcacctgggggaaggagcagttgtgggcacagcttcagtggacttaaatgttcctgattgccagc

SEQ ID NO: 213753 - DNA, 865 bp, Homo sapiens
aggaaagaaagtcaagacagaacactagggaataccaatatttatggagctggacatgaaggcagatcccacagagaagtctgtggaggagcactggagaaggtaagagaacagggcagaacagtgtcatggaagtcaatgatggagaggattccaagaagaaggagagaacacttaatagtctgggaccaaaaaaaaaaaaaaagataaatgaacttgaaggcatagcaatagaacctatccaaaatgaagcttacacacagagataaaaaagaccaagaaaaataagagagacctggaggcaataacatgttgactgacatatgtaaatgggaggcttcagaagagaagagagtaaaagagaacagagataatatttaaagaaataatgaccaaacatctttcatattttatgaaaggtataaactcacagagctaagaaactcggaacatgaagcaagatacctactagggaaaccacaccaagaacttcattatcaaattacagcaagttactaattctgacaaaaatcttaaaattagagaaaaaagggcacattccatacagggaacaacataaaaataattacaacagagttttcagaaactatgcatgtcagaagacaatggagtaacatctttaaaatgctggaacaaattttgtcaatctaaaattctagacccagagaaaacacctttcaaacatgaaacatgtctttccttagacaaagaaaagttgtgagagttggccagcacacctgcagtacaaggcttgttaaaggaagttcttcaggcagaaggaaaatgatacctgatgataatgtggatctacacaaaagaataaagagctctgaaagtgataaaa

SEQ ID NO: 213754 - DNA, 541 bp, Homo sapiens
cttctgctatgattagcctttgaccatgacttcccaatgcctagaattcttctatccttgtcttgcctgtggaaatgctgttcattcatctggccactacaggtggcgcatgcctgtagtcccagctactcaggaggctgaggcagaagaatcgcttgaactgggaggtggaagttgcagtgagccgagattgcaccactgaactccagtctggcaagacagtgagacttcgtctcaaaaaacaaacaaacaaacaaacccttcctttgtattagcacatcaatattgccttaaaaagacagcatatggcagagagggaaatgactcacaattcatgtacagcccagctgtgtgtgtgtgatttgtcttcataagggattaaaaataaattactgatcaaattaaactttatagaaaaatatatctgtgtcctagatgcatacaatgtctattttttgaacatgtccatatatatttttcttggtaggaaaagaatttgaagactaagttaataatgagataggaggaatgactttaattt

SEQ ID NO: 213755 - DNA, 280 bp, Homo sapiens
ttgtctcatactacttttgataatgggaccctttggtagggtccatcagttaatgacagggatatgttctgagaaatgcatcgttaggtgaattcaatattgtgtgaccatcacagaatgtacttacacaaaccttgatgatacagcctagtacacacctatatagtatagcctattcctcctgtgctacaaacctgtgcagcacgtgactgtactaaatactgtaggcaattgtaacacaatggtaagtatttgtgtatataagtgtatctaaacacag

SEQ ID NO: 213756 - DNA, 564 bp, Homo sapiens
  misc_feature (563)..(563): n is a, c, g, or t
gccgatcgctcggtcctgcaaacgcgcgccgggcgctttccccggagctcggcggtgcgtgcgagcgcccttttgctgcagccgcggcggcggtggtccgagggggcggagaggagggggctgcggccggccggccagggggcggcgtcccccctcaaaaccgcctgcgaagtgctccgggtggcagaagcaggccgccggctccgcggagcaagccgctcgccccggggctgagcaagcgcgcggggctgccgggcagcaccacggttgcttgcgggcgccggtgccctcggcgcggggctggagctcaccatgcccctgcggggccgggccaccgggcacgagcggatccccggcttgcccccgcctcgacgcgctcggattagctgcagctggcgcccagggatttgaatctggaccccgggagggagtgcgcctaggccgacctcggagcggcggccccgtggccaacatgcttcgcaaagggtgctgtgtggaattgctgctgctgttggtagctgcggactgcccctgggtggtggctgcccacgggactgtgtgtnc

SEQ ID NO: 213757 - DNA, 431 bp, Homo sapiens
aataagaccctgaccacaaggagccctcaacctcttgaagaagacagacccaagcagatgacttcaacataatgtggtatgatggagagggatggagggtatctctcctctaagagtgaaagggctgtcaactgaaaaacggatgcctattttgtgaacttttttttttttgagatggagtctccctgtcacccaggctggagtccagtggtacaatcttggctcactgcaacctttgcctcccggattcaagcgattcttctgcctcaacctcaacctcccatgtagctgggatcacagatgcacaccaccacacccagctactttttgtgtttttagtagagatggggtttcaccatgttggccaggctgatctcgaattcctgacctcaggtgatctgcctgtttcggcctcccaaagtgctgggatt

SEQ ID NO: 213758 - DNA, 220 bp, Homo sapiens
acatttagtatagagggggtaggaagaaaacaaatggtgactgagcattgctttgtgatagtcattgtgccacatgctcaatttatcttctttatctaatatttataaaaatggtgttagaggcagtattatcctcattttattggtgaaaagaccaaggctcagagaagttgacttgtaaaaggttacataataaactagggtatttgatttgaaccca

SEQ ID NO: 213759 - DNA, 364 bp, Homo sapiens
gggaggatgtgcctgctttcatgggctgggaagtagattccagcagggtttctggctggtcgaagagtcatgcatcagccaggtgctgatttagcattcgccccccaccttctgtgtaaggaaaacctacttcatcacaggtactagtcccattgtaagtatctctcttcccactgctgggtgggatgagatataaataaattaccttgataaaattggggtgtgtgtgttgggtagaggtgaccaggggatgctcccaccactaacccagatgttccggaggctggggtccctgtctttttgtcctgtgtccctcctatccctgagccttatttcccttccagtcactacactgggtggagtg

SEQ ID NO: 213760 - DNA, 366 bp, Homo sapiens
tgtagtgaataaaatactaatagacatatatgcaactaaacggagaatgggctcgctactaaacttggacaagccaaaagcggtagttggcctggagaatatgaggaaaaatgatctagacagggaagtctagtacttgaaaaataatgtatttgcaatttgtaatttagttattacatgcttaacaatagaaattttcttgggtgggaggacggagaggattgggaaaaacaactaatgggtactgggcttaatacttgggtgatgcaataatctgtacaacaaacccccatgacacaaatttacctgtataacaaacctgtgcatgtacccctgaacttaaaatgaaagttaaattttaaaaaa

SEQ ID NO: 213761 - DNA, 477 bp, Homo sapiens
tttacaggcattgtgggctttgccatttttaggatgtggtatagaagaaagcatggtggactaattaggaaccagatctggcttcaagatacagtctgaaagcttgagaatagtgtgaccttcagcaaattacttaccttttctgaactgtaatttcctcacatgtaaaatggaaataattatcactgtcaaaacagcccccaaagcagaatgaggttcaagtatgtgaaagtcttttgtaagtgctaacatgcactatagatatgaacaataatcatgcatccacttgacttataagacttggcattcctagcttctagggcacagcttacatatggtcagtaaatgttaattgaattaattgcttagatatttggtaggcttactgtcatgtttcaggttgttgctggaatcttacatgaataactattgctgagaatttgtcaaaaccaaacagtgaaatggatgctgctccat

SEQ ID NO: 213762 - DNA, 443 bp, Homo sapiens
ttagcgttctagactgctacatttaatatggataccttgaaaagcgatgatggaataatttattgacagctttgttgtattttaaaagtaataaaggaggcatccaaccaaacaagttcattgaatttttgatggggccatgagacctgtagatcagaaggacacaggcagtgtgatttcctcaaagtgtttgacttgacaaaggagggaggaattaaagtgtaaggagacgttgatagttgattaaacaacagcgacctaaagggtgctgagaagtccactgctgttaacctggaggaaagtcccctgagtcccagctgttggggacagctcatctgccaggcaacagaatccatgttcaagatgatttcaaggcccaaaggaagagacaaaaacaaatacaaacaattcattagaaataaaagttttttaaaatgtgaaat

SEQ ID NO: 213763 - DNA, 264 bp, Homo sapiens
aagtgctgggattacaggcgtgagccaccgtgcccagccttaataaacatttttctaagcacctagcagtgctggcagtaacacacagtcctctctgggttagggaagtaggtgatcaaatcgtgaaacaatgtgaacttgccgtactggtgataggtagaaggtgacacgcacagacaggaagtacctggcccagcagggatatcaggacaggtttccaggaggtggtgaccctcaggtagttttgctttaaatcagagactg

SEQ ID NO: 213764 - DNA, 468 bp, Homo sapiens
cgcagcgtctaagctctgctgcgacgttatgggaacctggtgacccgcggcacactctgggacgccagggtagtggatagggacagtggagggcatcacgctgcagggcacgggatcagagggggatgcaaggggaggggacgccattctggccgccaagggggaaacgcggtgaagggaacgccccgactttcgagtccctaggactgagtccccaggactccaacccagcagagaggcgccggggccttagctctgagggctgtggtctagaaagggaagcagcaggcctggggctggggcgcgcgccgaccccgcagtgagaccaagggaagaagggacaggaccccgcgaagggcctaccgccccagagcgtaaacagcggtccgctccgcggaatagctgaagacctcgctggcctgcggctcagtggcctccccggcgattcgagaacagctctgggggtcc

SEQ ID NO: 213765 - DNA, 546 bp, Homo sapiens
ccctagaacattctctgatttgaaccacccactccttctaaaaagtctgcctccccaagagactcacagcagcttgccctggacaagaccaaaaaagacaatggatgtggtccgccttgggagtccccaagggctgtgcaacaaagtcaagtcaccgtccacccttcagctctgagctagaatctcagcagacacatctgggccaggtccacaaggacaaggactgtggctggcttcactaaccacggtagtgcaagcaccacacctgggcagcaggaagccccgcaccaagatttgttgagtgaatgaatgaggtagtgaatgaagcaggaggccataaacgctgagggtgtacacctgcctccctcccgcatctcctacccaccctatgaggagggaggggaggcagcaggagagctgggctacctggggtagagtccaggttctgctacttactaggtaacctgtgcctctgcgtcctccgctgtaaaacggggtctgtggggttgtcctgagaattaaatgagttaacatttgtaaagtacc

SEQ ID NO: 213766 - DNA, 504 bp, Homo sapiens
cttttctttctttctttctttttttttttttttattatgtagagacagggtctctcgctatgttgcccaggctggtcctgaactcctgggctcaagcagttctcctgccttggcctcccaaagtgctgggattacaggcaagagccattgcacccagtcccttctctcctttctttcttcatcacctgccatattccaggcactaggaataaatcatcaagtaaataaacggccttaccctccctggcaattataatggggaaagttagctaaaaacaaacaaaaattactgttccatttaaccatcgctgaataacaaaataccccagaacgtagtggtgtgaaacaacaaccttttaattttatgattctgtgagtcaggaattggagcaggattggtgtgtatctgcttcatgatgaactggagccaaaaatgaactagctggaacagctggagatggaggggaggggcatcaagggccatatatctaaggctggtggttg

SEQ ID NO: 213767 - DNA, 388 bp, Homo sapiens
caccatgttggccaggctggtctcgaactcctgacctcaggtgatctacccaccttggcctcccaaagtgctaagatgacaggcgtgggccaccgcgcccggcctcatttggattttaaaatctaacttcagtgtttgttatttttattttttttttttttgagactgagtcttgctctgtcacccaggctggagtgcagtggtgagatctcggctcactgaaagctccgcctcctgggttcacgccattctcctgcctcagcctcccgagtagctgggactacaggcgcctgtcaccatgcctggctaattttttgtatttttagtagagacagggttttgctatgttggccaggctagtcttgaactcctggcctcaagtgatcca

SEQ ID NO: 213768 - DNA, 725 bp, Homo sapiens
gaacatctcctctaacattacataaagacttcagcacctggctttatttccctcttctccattccctgcatcatcctatgacttttccaagactctggtctcatgatttcttaaaaacatctactttgccatccatattagcaacttcttttgatacatcttcatttttctttcctctgtctctttttgtaatggtcattcaacacttatatctcctttcctaacttcattcttttcttgatctgcctattcccacacaaccactaaacccacttttgacctttatggtgaccccctttctattctcccttgacttgactttaccatagagtcaagcttaggctcaagcttaggcttgagccaacactctgctcatttgctactattcctttaatgttacacaattccagacttagataaatccagtcttacattctgtctatgctttcatctgggcttgacagttatccacttttagctgaatttccagtccatttttgagagtttccccaaatctagtagagtcttatgtctactttcctactttcaacttgttaaacaagtgccttataatttttagatcagaattcaatcaaatctttcaaccaacttcaaaatcctcacttctttcatctgttcttctttctcccttgcttcataaagacatataatggtgacaggaaagaataatgactgtaacactgatgatttcggttctgcttcca

SEQ ID NO: 213769 - DNA, 493 bp, Homo sapiens
gaacatctcctctaacattacataaagacttcagcacctggctttatttccctcttctccattccctgcatcatcctatgacttttccaagactctggtctcatgatttcttaaaaacatctactttgccatccatattagcaacttcttttgatacatcttcatttttctttcctctgtctctttttgtaatggtcattcaacacttatatctcctttcctaacttcattcttttcttgatctgcctattcccacacaaccactaaacccacttttgacctttatggtgaccccctttctattctcccttgacttgactttaccatagagtcaagcttaggctcaagcttaggcttgagccaacactctgctcatttgctactattcctttaatgttacacaattccagacttagataaatccagtcttacattctgtctatgctttcatctgggcttgacaaatactagagtgaaaacacacacaccccac

SEQ ID NO: 213770 - DNA, 535 bp, Homo sapiens
aggtacagttctaaatatttttacatgtcttaaataatttagttttttctataactctaaaagaactattttgacccctacccacacacattttacagctaactttcaacagcttgtccagttactcagtcaatgctagaaccaagatcacagcccaggcagtctggcttcagagcttctgctattaaccactataacatactctagagttgcaatgtcacttgtggctattgagcacttgaaatgaggtcagtcagaattgagatgcactgacagtgtaaagtacatactggatttcaaagatgtggtacagaaaaaaaaaaagaatgtagatatctcattaatacgtctgtatattaattgtatggtaaaatggaaatatttggggtgtataagcttgcataaaatataccgttaaacttaatttcatctgtttctatactttttaaatgtgtctaccagaaatcttcaaatgtcgtaaacggctcacattataggtctgttggacagggctcctctagaggcacaatggggt

SEQ ID NO: 213771 - DNA, 537 bp, Homo sapiens
acgcctggccagtggtcagcttctcatgcacttcttctttatatttgagtattgaagacacaaatacattgaataaccacattggtaggtctcagaaagattttgtgtctagcctacacaaatacaagtaaactaaaggtccttcctgaaaatcttagatctctataccaggtttttcagtaagaaaatatttggaagtagtttgaaaaggtgaaagtgtcaaacaaaagtaaaggcattgttctcatttctcaacagcacatagggcaggtttctttttgtctattttttcctttcctggagggctcggttttggtgatggtaatgatgattttttgttaataaagagtttatataaacagttctcatatcttagcaactcagcttcttttctcaatcagaagaggtacacttgaatatgttaagtttgaagcaataacaaattcaagttttaaattaaatgtctcatgctttgatttccaattaatttctgttttctcttcccaaagtagaacctgtgcatttgtaaatctcctg

SEQ ID NO: 213772 - DNA, 361 bp, Homo sapiens
cggatatccactaaacctgggatctcatctggagacctgactggggaataacgtgcttacgagcttactcatgtaattgttggcagactcagttcattgggggctgttgggctgagggctctatttcctcactgactgttgcccagagaccaccctcaattccttgccatgtgggcctctccaacatgccagcttgctttatcacagccagctagggtgagagtctgctagtaagatgaatgtcacaatgtcttttgatgaattatggaaataaattcccctcaatgttgccatgtcctataagttagaagcaagttacttaaggggagggaaataccaagttgtgaatactagggaggca

SEQ ID NO: 213773 - DNA, 940 bp, Homo sapiens
agataggcctcccaggttaactaatttcagagcaatttttcagatttagaaaattggagtcaggcgcagtggctcacgcctgtaatcccagcactttgggaggccgaggcgggcagatcacctgaggtcaggagttcaagaccagcctggccaaaatgagtttttctctgtcacctagattgaagtgcaatactgtgatcatggcttactacagcctcagcttcccaaacgatccttctaatctcagcctcctgagtagctgggaccacaggaatgtgccatcttgcttgtctaactaaaaaaaaattttttattttagacatggagtctcactattttgcccaggctggtgtcaaactcctgggcccaaggaatttacttgttttggcctcctaaatccccttggattataggtatgagccactgtgcccagtctaagtagaattttaaaaatctccttttctaaagaaaattgaatttgttgatagtaaagttttaaaattgggaagttatattgaaatgtgtctggtgcaaccagtggagtttaaattatttttgaccaaaatggattctgaagaaatggtatggatagaaaacaaagaatatttgattaagtgaaacaaagccccagctgctggagcagaggttccactcgggttccacagacacccacagcccaaatccctggaggcctaaggcaatagctaattgagactatgcatcactattaaggcatcttcactaaagggcgctgtggaaacgctgcctgagatgcagacacctgtcagaagggggctaaatttcaaacaaggaacgtggtgttgcatcacaataaagtagattctagtattaccttcctttttcagaagaggagaccaatggggagcattggaatgatttggttgcaagcatactacactacttgtaaactgcagacaca

SEQ ID NO: 213774 - DNA, 514 bp, Homo sapiens
tacaagaatggaagtgtttattcttcagacaaaggcagagccccctcctcttcggagtgacagagtcagagcctcagtgcagtgggatctggcctgtatgctttctttgtttacacccacatccagcggatgctccctggagaggttagaatattcaaaaaaattggtaatgtacttcctatatgggtttgaggacatcgaattattttgcttgaagagaaaagggttgagtattggaaagattcactgatttccattgcaggacagcatatgattaaacaagcttagaggcaagcacgggggatttaaaatggagcacctcccccaggagactgtgaggccagggggcccttgggactttgttcaaagttctgcggtccttgggcctgacgggtgctcagcccagagcagatgcgtgggagcgcatgttgactgagtggctgaccacgtggccacataccaggaagagcttccaacagcacaggactgtcatcacaggacatttatgagaaga

SEQ ID NO: 213775 - DNA, 907 bp, Homo sapiens
ctgacactaagaacccaaaggccaaagggtttctggagtacagaagaaatcagtctttggttttctcaggctttctcaggcttcaagcacctacccatgcagaacatgaatcctctttttagagagctttagaaagtctggtagccctttccccacagaaccagacaagacactgagcagcctacagggtgctctctgccagtgtaccctaggacccaggtggtctaaggcctgcagaagagagagcagaggagctgggtgagggagctgtggcagtggtagaagaggaggtggttgtgattctgtactttgcaggcccaaatgtggactgcagactcagtctgtaatagggtggaggtgagccaatgaagtgtctgtttttgcagcgtgtgtggtaataagagccaaaccttgtaggcttagcctcactgcctctgttattcaggctggacaagcacaagccccatggcagtgacaggtgaggttgttaaagaggacatctagacatgcacagaatctccccagaccagtgacagaatctcaggtttggaagggaccttgacagtcattaagccccaattctgaccaaagcttcagtcctcttaacaatgtccctattcatgcctttgttgaatggccacagttacaagacaggaagctccactgccattgcaaccattgcaacgtgctttctgcctgtgtgggtcctctcatctactggcacctgctgggtatccccatgggtaaggtcctgaatgctacatctttttaaacctcttctccatcaaaacctacttgacctgcgtctcatcagggtaccatttcctgtggtagctcttctccaaaagtagctccaacaagccatgccttttgacactcatggcttcgtgtagtttcctcccacaat

SEQ ID NO: 213776 - DNA, 607 bp, Homo sapiens
ttaagtgtaaatttgataaaatatatgcaagacctgtacactgaattctacgaaacagtgctgagaaagtaaacttgagagataccatgttcacggattagaaggctcaatattgttcagcatcagtttcccccacattgatctgtagattcggcaaaatcccaataagaattttagtaggtttttttggtagaacttgttaagctgctactaaaatttggaaatatataaaggacctagaataaccaaagcaactttgggaaaataaaacagcatagtagaggtctagaaattacagcactgtaatttctagacttgttacaaagctattaagataatgcaaaagtgcataaacgtcacatagatcagtgtagcacaataaagttcagaaatacacccacacatttatagtcaactgattttgacaaacgtgtaaagctaattcaaaacctaaaacgtgaaaggtaatcctttccagaaaaaggatgaactttccaaaacactgtgctggaacacacatgcaaaaacaaaaaccctgatgcatacttcacaccatctacaaaaataaactcaaagtggatcatagatagacctaaatgtaaaactt

SEQ ID NO: 213777 - DNA, 451 bp, Homo sapiens
ctggagctgcgggtcacgcacggtgccagaggtttaggttgacaacaatgatggaggctttcctgcgataaacggctcaatcttccctggaatctgcactctctcagctttatggctgcccatgctggagctttgcagactgaaccatgtcagaggtcactctgggcagagctgtggacggatccctccctatcagatgtccccagtggccccagcaggacggagtcagtgggaccatctctgacctcacatgcagacacggaggtccagccggctgcctgggcttggtagggctgttggcagattacttcctgggcctccatctcttcatccataaaagggacaatcatttctgccgggggggttggggtggggcagccacgatgtgagaaagcaagttaaagtattaggtaaaaacataatgtgccaaatacaaacagttgagagctta

SEQ ID NO: 213778 - DNA, 942 bp, Homo sapiens
ttttttcattttatttttttctgccctcaatccttgttgatactgtaggtgtagttcatttatttacacagctgtatagtgttccagtgaatgaatatatacaatttatcatttcttctattgatgagcatttaaattgttttcattttttatctattataaacattgcctcatgaatattcttgtagctcctgaagcaacatgccatagtttctccaggtcatatacctgactgtcaaattgctgggtcctaggatataaatatttttccctttataagatatttataggatattgcaaacaatttctgttttttcatatccttgccagcagttagggttatcaaattctttgatttcttactgatttgtaagtttttttgtttgtttttaggtattttcaggatagttacaaatgttaggaaaacttatttttatttggcttttgaagtttccagatttcttgaacagtgaccaatatggacccaagttactgtaattttgtcctatagtatatattgttgatagtgagctttccaatgtactttctccaagtatgtttagttatgctccttttctgagaccatgaggaagtgtttcagtgtttcagaattcaatgtgataactattatatacgtagttattttttattaaatatatatctgaagcaaaaatgaaaaatgttaatgctttatatatgagtatgtgagtgtatactacatttttcggtaattttatttttaaaacttttcaaaaataaaaatgtctcgtacaaaacaatataacaacaaaaagaatttaataattttttttttttttttttttagagacaggatgttgctctgtcacccaggttggagcgcggtgatgtgatcatggctcactgcaacctcaaccccttgggctcaaatgatcctcctaccacagcctcccgagtagctgg

SEQ ID NO: 213779 - DNA, 433 bp, Homo sapiens
ttgtggtccttgagtaagggaatcgagatgtcagctcaatagctggggtatctgggtccttttggaaaagaagagatcagggcaggaggcagctttgtgaaatgccggcacagggtaactcatgtgcaagtcataagaggatacgggcttgcctgagggagagtgataagggcctgagatacagccccaaggaggtagagcggacatactggtagggaccaaaggaggacaggcccctctgaaccaaggacagagaaatttgaggagagggatgtggttgataatgccagatgctgctgtgagcgtttgtaggagtgggcctgaaaatgcaggatgtttggaatataaaaacatagaggccaccctggcaaaaacagtatttagtggggcaggggacagattctggattggaaagaaaaaaaaaatacttaag

SEQ ID NO: 213780 - DNA, 2041 bp, Homo sapiens
  misc_feature (2)..(4): n is a, c, g, or t
  misc_feature (2039)..(2039): n is a, c, g, or t
  misc_feature (2041)..(2041): n is a, c, g, or t
gnnntccgggcggagcgggcagcggccaagtcagggccgtccgggggcgcggccggcgatgcccgcagcccccgccgcgccccgccgggcctgctgagccgcccccgggccggggtcgcgccgggccgggccgcgcccggggcggggcggcgctgcctgcatgaccctccggcggcgcggggagaaggcgaccatcagcatccaggagcatatggccatcgacgtgtgccccggccccatccgtcccatcaagcagatctccgactacttcccccgcttcccgcggggcctgcccccggacgccgggccccgagccgctgcacccccggacgcccccgcgcgcccggctgtggccggtgccggccgccgcagcccctccgacggcgcccgcgaggacgacgaggatgtggaccagctcttcggagcctacggctccagcccgggccccagcccgggtcccagccccgcgcggccgccagccaagccgccggaggacgagccggacgccgacggctacgagtcggacgactgcactgccctgggcacgctggacttcagcctgctgtatgaccaggagaacaacgccctccactgcaccatcaccaaggccaagggcctgaagccaatggaccacaatgggctggcagacccctacgtcaagctgcacctgctgccaggagccagtaaggcaaataagctcagaacaaaaactctccgtaacactctgaaccccacatggaacgagaccctcacttactacgggatcacagatgaagacatgatccgcaagaccctgcggatctctgtgtgtgacgaggacaaattccggcacaatgagttcatcggggagacacgtgtgcccctgaagaagctgaaacccaaccacaccaagaccttcaacatctgcctggagaagcagctgccggtggacaagactgaagacaagtccctggaggagcggggccgcatcctcatctccctcaagtacagctcacagaagcaaggcctgctggtaggcatcgtgcggtgcgcccacctggccgccatggacgccaacggctactcggacccctacgtgaaaacatacctgaggccagatgtggacaagaaatccaaacataagacagcggtgaagaaaaaaaccctgaacccggagtttaatgaggagttctgttacgagatcaagcatggggacctggccaagaagtccctggaggtcaccgtttgggattacgacattggaaaatccaacgatttcattggtggtgtggttctgggcatccacgccaagggggagcgcctgaagcactggtttgactgcctgaagaacaaggacaagcgcatcgagcgctggcacacgctcaccagcgagctcccaggggctgtgctcagcgactgacgcccacccgccactgctacccctgccgccacctgcgcccagcacggccggccccgggcttccccagcagccaccaaggcctgtggcccccacactgggggagatccagaacccctgcttggacacagagccactgcagtccccgctcggaggatgtggagggctcagccactctgggacggggagggcaaggagctggggtggggggctctcagctctctggggcccaagaggccggtggtggaaagagacctcagcacctgcccaggggaaggggacacgcccatctgggagcaaagacccttctagagggccagccccggctgagaggacaggagtgtgggggcgccttggcggacagtgggaacagaggagggaggtggtgagcagacagacaggtggaggatgggaccttgaagactggctgctccagcccaagaaagcctaactgcatccctcatctccttcgctgctggacagatggaagaagcgggcctgccggccgaaagtctgccagagttcccggaggctcctgatgatgggtaaattggcacatgcttcactcaatgattccacaagccctgggggtgaatgagacacagggcctgccctcagggagttcccatctagtcagccgaancn

SEQ ID NO: 213781 - DNA, 464 bp, Homo sapiens
tgggactgggaggatgggtgaggggctggcatagagcaggtgcttggttggtggcagccgccatggaacggtggcacctgcccaggccaggctcatctggtctcacaggggcaggcgaagcctctccaagatgcggccagggtgggacctgtgccctcctctgtccgcagctgccctgggcacgctggacttcagcctgctgtatgaccaggagaacaacgccctccactgcaccatcaccaaggccaaggtaggccccgccagcctgcccccaaattccctgccccggggtcctcaagagggcctaggtcagggaggccagaccacaccactccccaggttcctgtccaggcttttggatgtctgtgctgtgtggggtgcggggccaggaaggaattcttctttaaaccttcttgaatacccaaccccaagaaatgccttggacagtcaggcattgcggggag

SEQ ID NO: 213782 - DNA, 886 bp, Homo sapiens
  misc_feature (2)..(4): n is a, c, g, or t
gnnntccgggcggagcgggcagcggccaagtcagggccgtccgggggcgcggccggcgatgcccgcagcccccgccgcgccccgccgggcctgctgagccgcccccgggccggggtcgcgccgggccgggccgcgcccggggcggggcggcgctgcctgcatgaccctccggcggcgcggggagaaggcgaccatcagcatccaggagcatatggccatcgacgtgtgccccggccccatccgtcccatcaagcagatctccgactacttcccccgcttcccgcggggcctgcccccggacgccgggccccgagccgctgcacccccggacgcccccgcgcgcccggctgtggccggtgccggccgccgcagcccctccgacggcgcccgcgaggacgacgaggatgtggaccagctcttcggagcctacggctccagcccgggccccagcccgggtcccagccccgcgcggccgccagccaagccgccggaggacgagccggacgccgacggctacgagtcggacgactgcactgccctgggcacgctggacttcagcctgctgtatgaccaggagaacaacgccctccactgcaccatcaccaaggccaagggcctgaagccaatggaccacaatgggctggcagacccctacgtcaagctgcacctgctgccaggagccagtaaggacttctcagagcatctaacgtgttgatgggctgttccctgactctccgcaagggggatgaagtgggcagaatctgcccctcattcctacgccggatgacccaagcgtccgaccacacatgtgctcagggcaccagcacaacaggtgcatctcggacaggagagagaaaaattgctgttaaataaaagcatcaaggtg

SEQ ID NO: 213783 - DNA, 569 bp, Homo sapiens
tctctctccagggacagaaagctctttgaatacctgctggcttgatctataccccatagcatgtccccatcctctgcctgtccgttggatgtaattccagatacctgaggccagatgtggacaagaaatccaaacataagacagcggtgaagaaaaaaaccctgaacccggagtttaatgaggtatgaggggctggtgaagcttcatgaaggccattcctctgccccacagcagtgggggtgtggctgggttttcaaaaggtcatggcgggatggggagggtggtcagagacggtggggaggggccgcaccaagccacagacacaggggagctgggggacccctggaaagctcttggcaggacttgtcggatgtagggctggggggagggaagtgttgaggggagtcctgggttcctcatggaggcaacagggcaaagagggggtgaggaagatggggagaaactctgtgtggggcaaggggactcgagacaccctggggccccaggaagtcttccgcccaaggcggcaagtacagctggaaatgcggattccccccaaggaacaagaa

SEQ ID NO: 213784 - DNA, 741 bp, Homo sapiens
gaggcaggtgccagcggacagtgggtgggggtgccggcgccaggccaggctcggggaggccccgcgctacctctgcctctaggagtccaggcgcacagacaagctccccggagccgctcctgcttcgccaactccccactcgcgccgcccgtgccagccgccggactggcgtctccgccgcccgcaggaggagtcgcgggagcactagcagccgccgccgagcgacagcatcctcaggagagacgccccgggctttgcagccggcggcctccgtccgccctccgcggtcgccccccgccccgtcgcccgtccgcccgcggtggcagccggcgccggcgccccggggcccttcacctgccgcgagcgtccgggcgggcgggcgcacgggagaaaaggcgcaagaagcgggcaccccgggaaccccattccctcggctcactcggcgcggagaagcgacgcccgctgactccgagagccccggtgctccgtgcacctggtccccaagttgaggagcgacacccctccacaggggactagcccgcgcggggagcattccggtctcactgaccccggcccacccgcgggactccaggcacctcttctgcccgcaccccgcgacccctcccgggaccccggagacagccggcctgcccccggcgtcccccttggccagcacgccatgccggggctgcgccgggaccgcctactgactctgctactgctgggcgcgctgctctccgc

SEQ ID NO: 213785 - DNA, 419 bp, Homo sapiens
aatacattaagtattgatagacaagacctaaactaaagctctttgggtgcgggttcttattgattttaagatataaagacatcctaaaggccaggcctggtggctcatgcctgtaatttcagcactttgggaggtgggcggatcacccaaggtcaggagttcaagaccagcctggccaacatggtgaaaccctgtctctactaaagatacaaaaaaaaaaaaaaaaaaaaaaaaaaaaaaaaaaaaaaaaaaaaaaaaaaaaaaaaaaaaaaaaaaaaaaaaaaaaaaacttttgggccgctttggccaatctaattttaaattcgaccaattttttgaatgcggccgaaattcgggttaattgggccaattccccctatagggagtcgtttaattttggccgtgttttacgtcgggtt

SEQ ID NO: 213786 - DNA, 862 bp, Homo sapiens
tagattccaaatgaatccaagattaaaatataaaacacctaatccataaatataactgatgaaaacataatcattttagctcactgagcttgcttgaaagataaaaaacataaaaatgaagataatgattttgatcacctaagattgtaaagcttttaacaatgttaaaaaacaaggaaaaatactcataacctataacaatttattttcctaatatacaaaaagttcatttgttgagtgtttgttatgtgttaagcactacatacaatatcccatttaattctcacaacaatcctgacaggaaagtactaattaacatcgtaattttacagatgaaataactcagagcttaagtaaggccttcccagttttgccacagcatactagtatggtagaaagggttataagtgtgccaagatgttgatcctttttaaccctttagcctcaagtagtctcttgtataaatagttaacagtttgtgtgccaccatgtgaaagaagtttagcaagctgatagatacgtaataaaatatccttgtttttagaaaatattcaccaaagtattaaaagatataaactataaaaggcatcaggtatgtaacccactctcaaatggttcagaaaaaaatgtgtgtgtgcgcctgtgtgaatatacacagaaagagaaatgcagatgtggcaaaatgctaaaaactggtggttctgagtaaagtatacagaagttctctaatattcttgctacatttctggaagtgaaattattttaaagtaatattattttttaaaagtcagtaaaccagctaaagtatctcactgaagtctctcatctaattggtgtgaagctagaattcaaacctagattg

SEQ ID NO: 213787 - DNA, 281 bp, Homo sapiens
cagctcccatcagcagatccgaaagctaatcaaagatgggctgatcatcggcaagcctgtgatggtccattcccaggctccatgccagaaaaacaccttggcctcccggaagggcaggcacacgggcataggtaagcggaagggtacagccaacgtccgaatgccagaggtcacgtggataaggagaatgaggattctgtgctggctactcagaagataccgtgaatctaagaagattgatcgccacatgtatcacagcctgtacctgatgggtgaagggg

SEQ ID NO: 213788 - DNA, 705 bp, Homo sapiens
caagttctcgccatcaattggtgaccccctttttgagaaatatgaaaatgtttttactctagaaggccaataaagcctgtctcacctataatggaaaatagagtaccttgcaaaggtatgacaggaagaaaaacttgcggagttgttgctttggttacagagtttctgattcagatctttgtatttgcattaatgtctgagtttggaataggttgtgaaccaataaattatttcatttttaaagagtaaaagttttggaaaaaagcaataggttaatcacagattaggctaggaaaaaaaagccatcacacatagttctttgaaagtaaggtattatgagcatgtaaaatggtacagctactctggaaaagagtttggcagttttttacataactaaacatgtacttaccatgatacccagcagtcacactcttgagcatttatcctagataaatgaaaacttacatgcccacaaaaacctgtatatggaagttcctagcatccttattatacatactatttatatatactattattatgtatatactgtttatactattagtgtttatgtatgtacacacacactatacatatgcagtttataatagtaagatactggaaacaaccaaaatgtccttcagcaggtgaacagttaaacaaactggtatatctgtacaatggaatgccaccagcagtaaaaaaaaa

SEQ ID NO: 213789 - DNA, 263 bp, Homo sapiens
gcagccggtggaaaggaattgaaatcctttgggaaaggatctcagcatgttcctgtgttcattgcagcattattcacagtagccacaagatggaaaccacttactgacatgttcgtcaacagatgaatggttaaaatttggtatattatgcagcctttgaaaagaaggaactcctggcacatactaacaacacagataaaccaccttgagggacattgtgttcagtgcaattagccagtcatagaaggacagatactgcacga

SEQ ID NO: 213790 - DNA, 613 bp, Homo sapiens
gcaaactgttttccataaggactgtaccatttcacattcccaccagcaatgaagggagggttccaatttctccatatccctgccaatatttgtggttgttttgttttttacacagccatcctaatgggtatgaagtggtatctcattgtagtttttatttgcattccatactttttctaatttagtcactaaagataggtatggcttttcctctgaaattccagtagtttctcttgttcaaccaaacaatgtgtgtatgaagcctatttcttcacagatttcagagctgctcagcagggatttcaccttgtcactgtcataccacacagcacagactgattggaattgaaggaaggcaaacagctgaatcaagaaaggcactttgcactctctctggggcaggatgaagggtttctttctttttctttcttcctttctttttttttaatacaacagcatcagagaactgccatttagtgcaaagcaggcaattcacccatcaagcctgtgaaggtagttgaagtagctgctctaatggctgaatggctggacaaaagcggccattgtggggctcactgcttttgaggacaacgatgattgctctgatctgata

SEQ ID NO: 213791 - DNA, 445 bp, Homo sapiens
catggcaagcctagaaatccccattttcttttcaatgttttccttctgttctctctcaccacaaccccttaagcaatcacgtggagatggtggcagcagagagtgatacgcgcccacaggtgcagggcagtcatcctctccgacctgcagacctggtgttccaggaggcgaggctgcacctcacacatcctcccctgggtgcttctgagctgcatgaccatggacgaagggatgactgcagaagtgctccacagaacagggtaactcacatcccaaatttccagccagaggaacttgggaaaggctgtttgcagactcccgggctcacggttcccctgtacacacaaagctgtgcacacatgggtgttgcctcatggagcatttcaaacgtcatgaaggttaaactgacggagcactcacagaccgagtcctaggttggcctctg

SEQ ID NO: 213792 - DNA, 506 bp, Homo sapiens
caggcataaatagggttattgctgatcaaagaaacacattcagggcacatgctcttctctcagaggatctgcttgctgggctctgacctcatagcagctagaggagaatgccatacatggaagcacatctctctcccttgactcctcacctaattctagctttcctgggtgaattgatttttttgtctttttcccgaacaaaatggggtgaatccagggatctgaaacggcatctctcaagtctgaagcaagaaaaaaaaggcaaaaaattctagccctccttgcagccacactaaaatgtaaataatttctgcctcttacctggctgcagaatagtagatgtgtatgtatctcactgactctccattactgagacagccactccatttaccagagcaaagagtaatacacatgtatctcattaactccattactaaaacatgtagatgaggaagacagaatgcttgatcatcattccaaaattctagagtagaatgttatcaaaa

SEQ ID NO: 213793 - DNA, 225 bp, Homo sapiens
cagttcctcagtttccccagcctaaggtgtagttacatcagatgaccatcaggccctttctgttctaagttgtgaatgttccagaagccattttgataggacgataatggaacctagcacatttaccccatggctattaactgtaacgctgctgtaagtatacaacacataattgtttcttacaattatttatttttaaaaatcacttgaaatctattatgagta

SEQ ID NO: 213794 - DNA, 370 bp, Homo sapiens
aaatttttgcaaaaaggtttcactttggttgcccaggctgggccacagtctttgtaatctaaccttggaagtgacatctcatcatttctgccacattttattagaattaaattagtaagtctggcctgcattcaaggaagctgatataagggtatgaataccaggaggtaggggtcattcagggctaccttagaggctgctaccataggctattatgagcaaagctgctgtgaatgtttatatataaatctttgtgtagacaaatgttttcattttatttcaatgaataaatacctaaaagtaggatctctgacttttacgatgtgtttaaataaataataaactgagaaattgttttccaaaatggctg

SEQ ID NO: 213795 - DNA, 419 bp, Homo sapiens
ccttgactcataaggtaaaggtcaggcttatataactcatctaaatttgaagaagaaaaattcacagccacagactttatctgtaattctggtttataatcgctcacctgggctactcttcacaggaggagtcaactgagcaactaagatgcagtcaggcagtgcctcccactagtgaggtgtgttccactcagggcttgtgaatagaacagaataaccttaagtttgtgtgataagaaagtagagtattttatttttaaaaagagactataccctcatgtcccaaaataaactatacatggatttaaataatcaaatattcaacaaagaagaagctagcagattaaaaggaattttatcaatgttagaaataagtgaagctttctcagatttgaagtaacaggatatattagaaagga

SEQ ID NO: 213796 - DNA, 638 bp, Homo sapiens
tcacgcaaattgggagataggggtactacatttcttgatgactgtagttcaaagaaatagttcctgagtcctggaaaaacacatccctactttgtaaagctcacaagatgcttacttagctttttaaaatatttacaggtgtctcagatgggtagaggaagaatatatacaattactgattttctaaaacaagcactctaagaaatgaggggagagtctctttcactcttttttaatctgagaatattaaaatatatttttcttgttcaatatatatttgtccttacatgagggttaagttatcgtaagtgcatgtctttcatataatattttacataatactttgttgaattataccttcttgattctaaactaaaagatacttgacttacatttgtaaatatatttgctataaattcagtaatgctttaatctacttccaatgcatcatttgttgtctaaatgtagctttataattagccctcttttagaaatgtgtttgtgtgtctctgtgtataaaggaaaaaagtaatctgcatctctttccccctaacacagtcatggcccatctagtggctgggtacctgacacaggaaatccttccacttttagggtggtcttgattgatggatattata

SEQ ID NO: 213797 - DNA, 517 bp, Homo sapiens
gattttttttctttcttcttcgtttttctcaatatcttaaaatcatcttactagaaagcctattttgcagtcacttttggaaacattcccactgtaccaataacctagaattgctatcttcagctttttaatacaaaataaataaataaaagacaggcaagagaagagtctaggcacacacacaaataacttctgctgtatctccattattgttgtattgttatgagataggcactgtggaccagccttactgggttaaatcttggctctgcaattcgtaggcaagttatttatcagtcctcctatgccccacttcagttttctgagctataaatgggtctaatagtattacctaccttaaatgggggctgtatagattaaatgcatactctgtgttaactgcttagaatggtgcctgcctggtgcacagtccatgctcaatcaaagatagctatttttttctgtctttactatatatgattttacatatatgattttatgctgcataaaatttttc

SEQ ID NO: 213798 - DNA, 551 bp, Homo sapiens
agtcataatgtcttttataatctggtcacacatagtcacttcctccatattctgttccttagaaacgtgttgctaagtgtaacccataattaagaggggattaattagactctacctttgaaaagaggagcatcataaaattcgtggatatatttataaccaacacagaatgggacagtaatttattattctcccttggacctgaccaaaataggttattttctctctctgcaaaatacttttgtccaaatggaaataaattcagccctccatatctacaggttccacatccatggatgcaaccaaccatggacagaaaatatttgggaaaagatgttgcaaaaaataataataaagaattttatatttgaaaatacagtataacaaaaatttacataggatttacattgtgttgggtattataagtaatctagaaatgatttgcaggtgtgtccaatctttgggcttccctgggccacactgggagaagaagaattgtcttgggccacatatacaatataccagcactaacgatggctgatgagctaaaa

SEQ ID NO: 213799 - DNA, 377 bp, Homo sapiens
taaatacaggagcataatacaacatgaggatccagcaatacctacactttaatttggtagaaagttgttttttataaaaaagaaaaataggtagaacaagttatagaataaaactagttccagaggtgacaacctgtgatatacaacatcagtaatactgttgttcagacacattaccctgaaagttcagcaaatgagctgatgcgcaaatctatgagatgaaccaagggctaatattgactgggcagtacagagttgctgcacagttgaaggcaatttaaaaaacaaaaacaaaaataacccacgtctgactaagctcacaatttagtccagtgcaacgatgcctttaatgtgattctcatgacaaccagatacac

SEQ ID NO: 213800 - DNA, 421 bp, Homo sapiens
tgatatgagcagctatatgcaaataagttcaacattggacaaatggacaaatttcttgaaagataaattatgaaatttcattctgaaagaactacatgaccttaattgtcttacatctattaaataagtggaaattgtagtttagaaactttcccacaaagaaaactctaggcccagatggcatcaaaataatattcagatgaatgaaatggagaaaggatagccttttcaacaaatggtggtggaacaattggatttccatatgcaaaaaaatagagatggacgcagaggtgtgtgcttaggaggctgaggtgagacgattgtttgaggccagcctgggcaacatagcaagaccccatttcaaaaacaaaaataaagaacttgtagccttaccttgtgccatattatgaaaatgtatcat

SEQ ID NO: 213801 - DNA, 336 bp, Homo sapiens
tggaaagaaacacattttgcatcacaacccagtacataacatacctcttcacttgatcttagccaaatggccgggaagcagaatatacctctttacatgtcatgtatgtatgcatgtataaaataaaaagtttcacaaaacaatatatgcccctactatttgcaacgtattgttttaattttctattctgttcctttcttttctaacacttataatccactaaattgtttttacaaattattaataaatcacaacctgcagtttggaaaagattcaatctgcagtaaggaagagattcaggaaatgaatatttggggtatatccttcctgaatttt

SEQ ID NO: 213802 - DNA, 466 bp, Homo sapiens
caagggacgaaaagcaaatgtccagatggcgattagtggaggccttgggggtggaagatctcagggctcacccctgtggttatcatcttagtgagggggctagtgtggacttcaggcccaaggaagaataatattttattctttacaaaatagtgcatgaaagattagctctgagtctttataatcttatcattggcttcaaatttcaatcccatattatactttccaagtatattttgttaaaatttccttaattcataatattctaatcagcaatgagtttctatccacatgtctatgagcacatatattaatttaaaaatctgcattgctcttgtatgaatgaaatataaaggaactgaacttctaacgaatgaaagacgctggatgaaaagataatattttatctgagtttcagttcagtcatatgtctgagaatgagtttatctagcccataagccttctg

SEQ ID NO: 213803 - DNA, 792 bp, Homo sapiens
cccttacccaacatatattttgctttcttcccgtttgcactgtacagctctgatccatattgctctgagactgacagcaatcaggactttaaaaaaaatcatcctctcaagctgttttttgtctcctctaggatcttatttctagatagattcgaactaagtcaactgtactttactgaaagcaaaaagataaagtcattttggggcatgcaaagttaagattatgaaaaatcttcaacaaaagccctcaaaatagaacttatgattaagatctgaactttaattccagacataaaaacaaactcgatattctcactagagtactcgtctcccttttaaagaattactgtcctctttttgtgcactagagtaatttagtgtattatgtagaggtcagctgacttctaccttgtaacatttaaatgccactgtcccaaatatttatgagaaatcaaggttatacttttaatacttatgttacttggctctaagtttcaagtcacctataatttcttaactcctttaaaaaaatcatattggtcagggttgttgctgctgcttgttacataagctatcattccaggggtcccttccttaggtaattcagcatggtttggttaagagtgttttaattcaagcagaagtgttaaaaaacaacaacaacaacaacaaaaaaaaaacctcatccaaaaatgttgtccctttcaaccatgaaacaacgaacttttttcttttttaatcaaaaacatacacggccagtcacataatgcactccttttcttgaatgttaac

SEQ ID NO: 213804 - DNA, 386 bp, Homo sapiens
tggtagaacatgccctattatatggcagtataaattaatctgcttttatattgtctggaaaaaaatcctagagagatttgatttgtatcttatcactgaagattccatagaatatattgatttaggttcatttttaaattttagaaatgtaatacatagattgccttttgtatatgaataattgatctatcgtctaacttttaattctgtgttattcagtgttttgttatttaataataactttccttcttcaaggagacaaaacaactagagattaaaagtggggtatggaaaaataatacattggtatattataattcataattaggagatagcttgaaaacctaatgtttctgcattatagagatttgatatatggaggctat

SEQ ID NO: 213805 - DNA, 495 bp, Homo sapiens
ctccagcctgggtcatagagtaagatccagtctttaaaaaaaaaaaaaaaggatatggcatttcagtcagaggttggaaggacctaattagagattaagaaaattaaagaacttgttttttagtctggttcctactttattcacaaaaagagctattgagggtatactgtcgttttgtttcaagcgggttagggctcaggtggcccagctcacagtggggctgtcttgtggaggctcagatgagggcttgttcacagtaatgagtcacatttcctttgggatcttttcctcagtatagggacctccaaaagaagtagtaaaccagagatgccttgctgaagcgtggaagagcccattggctttagtatatcgatccatattcccagagaccatttagctgaaactgcaaggaccatgccaatgagttcccctgaaaggagtatgcaaaataaggccaaaaggcacaaaggctgttttgagaaaacactgtagatt

SEQ ID NO: 213806 - DNA, 731 bp, Homo sapiens
gctgcctttaggtccttaatgaaggccatggtttccctttgtcctcctaggattctgcaaatttttttattgagccatctggaaggggacatggagacagatgagcccagccctaacagctattcaaggtgtcagacatgtaagtgagtgatcatgagtgttccagcctaatcaagctcctagataagtccatctaacatccaacgtcaagtggagcagaagaactgcccaacaagcaagtcaaccccacagtatcttgagagataataaaacatcttttttaatccactaggttttggagtggtttgttatacagcaataaataacttacttatcaagtgaaagttgaatattttggaagtcagactgaatgtaatacatacattaaaaggtaaactacaaactatgtgcccatacaagtggttaatatcttgaaaataaaaagagctcattataaaacctaaacaaaatccccaagtcttcaaacaaaaaaatggacaaaggacatgatctgtctactcatagcagggaaaaccaaaatgactaatgagcaaaaaaaagtgttaatcattatttaaaagaccattaatactcaaatactgttggtaagaatgtaaagtggtacagtctttctggagagcaatttgttagcatgccatttctgtaaatacattaggagataatcacagatccacagatctaaataaataagcaaaagtgttaatttcaaa

SEQ ID NO: 213807 - DNA, 469 bp, Homo sapiens
agtggcaagaattcccattttttaatttgttggaaggaatgaaggaagatcccaatatagtttacattactaaatatggtaaatgtcaaatattttcatatgggattcccactgatatttatcgaaaccagcatgccatgtacccactcagtccgaataaaaatatcagagtgggaagggaccttagagacaatctggcctaatactcttattttgcccatgaggaaactgagcttcataggggtcaagtaacttgcgaaaagtcacacagctaggtagtggcagatctgcaactaaaattcaggcctttgattttagtccattcaatgtacaatattcataggttatgtcctctatacagagcactggactagcactagaaataatgagattatttagatagggttcttgctttgagaaggctcacggttttgtaagaaagacacatgactaaacaatacaaaaaaat

SEQ ID NO: 213808 - DNA, 354 bp, Homo sapiens
aacacagtctcttctcagatcgttcttcttgcattcaacatccagcaacaggaacagaagcccacccagaagtgacagcagaactcaacagacgatgataaagtttacaccaactataccataaactgttggcaccaccaatttgatcacagataaaggtcccacacagaaagaagagaaaaactattaaaactccatgaacatataagcacaacactgtatactttatacatttaatttatttgtatgtttatttattcacttatttgtattttgtcttgctccatatggcatttgaagtaaattcagttttcagaatgcattactcatatggtgggtgtgaaacagtttaag

SEQ ID NO: 213809 - DNA, 488 bp, Homo sapiens
gagggcatcagtcaatttatttagggcctgagtggcataaaaagacaggggcaggtcaaatttgctctctggctgactgagctggcacattgattttctcctgccctcagcactcctggttctcagatcttcagacttggagtatagcttataacagatgtatattttaactctttcctaacatctcttgaaatgacaaaaatgacaaaaaatattatatctataaagaaataatttgtgtcgggaagacataaaatagttggaattatattcaaggacaaaccagagaacaagtacgtgtagactagacatatacaagaaaaaggcttcagaagaagtctgagtttctgagaggatctctttcatactcatccaacatgaagtatgacttaacctgctacacacgttgccacatgctcaaagcttgatgtccaccttttcattgaagaaaaaggccaatcagggaagtagacctttaaaatggcaaa

SEQ ID NO: 213810 - DNA, 436 bp, Homo sapiens
ttgaccaggctagtctcgaactcgtgacctcagtgatctgcctgactcagcctctcaaagttctcggattataggcgtgagccaccatgcccggccctacctcttggttattgtgaataatgctgttatgaagatgggtttgcaaatatcgttttgatttcctgcattcatatcttttggttatataccccaaagtggaactgctggatcatggtaattctatgtgtcatattttgaggaactgccatactgttttccacagtgaatgcatcattttacattcccgccagcaatggacaagggttccaatttctccacatcctgtcaacacttgttgttttccaacttttttgataatagccatcctaatggatatgcatttttatgcttttatgtattttcagaatctccttcgggaagcatgtggtatgtttat

SEQ ID NO: 213811 - DNA, 457 bp, Homo sapiens
gcggcacgctggggagctttggaagtctgccatgccagcctcccacttggagctgcaggtaatgctggggagttggaaaggctgtgcgcgcctgtctgtcgagtcacccacacagagagcaatgcaggaggcggaaagaagtctgggagaggagcgtgggctggccacccccaacggaaccataaggggagtaaacagtctgtttgcaaacacaactaggacccctcttcccatcaaggcagagctggatccaaatcctgattctatccatgtgaggactgtgatattcagcaggtcagggcttcagcttcagtcagcttgtctatacaggtgatccaggggtgatccaggaagtcaaaagagcttgtgtttgttgtagagcttgacacattgcaggtatcagttgtaggctagtgaccacctctttggctttctctctccctccatcctctcactc

SEQ ID NO: 213812 - DNA, 151 bp, Homo sapiens
aagcatcttaaacattaaccctgtggcattttctcatcaatagtaagttgatcaaatgagtgacccagtctcagcaatttaacatatcatccctttcagctttaaatgtatatttaatcaccttagcccatttttcaatccacaaaagtaa

SEQ ID NO: 213813 - DNA, 560 bp, Homo sapiens
gactccaagtttctggcaatgtgggaacattatagactacaattttaatgcaaacacaatgagcttcatgtgatgcctctggatcaaactgaaaatgagtacttgaaaatatgggtctggaactcaggtgaaggcagcctattgaacagtagcttttggctactagtaatgatacaacagagaacattgttttcacaataaagagaattattattatagaacacaatgtcctaaggtggagtacctaccttaattcagtaccatatctttctataactccactttgcaatttgactttattagtgggaaatcttcttgagtgtcctcaaagagtcagtgtcatctcattggaatgcctaggatacatacccctacctaaacccatttatagaaggagaatgaaacaactatgaccagtctgctttatgctgcatcagtgaggttggaatgaagtccacttttctcaccatttagcttcttgggtgagtgccaacaccctaatcaatctttgctttgatagcaaagaggaagtgtgggagggtggggggatagtcaggaat

SEQ ID NO: 213814 - DNA, 288 bp, Homo sapiens
gtgtttccaaaaacggagccaaaacagcagaagaaggaggaggaggagaaaggggagctaagtccagacaaggaggttctgacaaaagagaaagaggaactgaagggcgaggagaaattttggcagtctttttccgttcagaaattattttagacaattttttgtttttctcttgcaaagaaatgactttatcagagccttttttagaagcttctaagtaccattgaaaatagctctccctttggcctgaagtacaaaaataaataaataaataagaaaaaaaacaca

SEQ ID NO: 213815 - DNA, 496 bp, Homo sapiens
tgcaccccacctttaccccactccactcgagtcacagattgaagaataagatgtttgtttgtttgtttgtgagatagagtctcgctctgtcgcccaggctggagtgcagtggtgcgacctgggctcaccgcaacctccgcctcccaggttcaagtgattcttctgcttcagcctctccagtagctgggattacaggcgcgcaccaccatgccctgctaatttttgtatttttagtagagtcggggttttaccatgttggccaggctggtctcaaactcctgacctcaggtgatctgcccaaagtgctgagattacaggcatgagccaccgggcctggtcaagaataaggtcatttattgttgtataggcaataagtgtgaatcaaggatacttttaaaaactcataggtgagcccgggcatggtggctgagatcagcctgcacaacccgtagtgagacaccatctctacaaattaaaattaaaactttagccacac

SEQ ID NO: 213816 - DNA, 859 bp, Homo sapiens
ccctcacacagacaccctgaagacacaaattctttctcgtaagtccagctcaattttccctacagcattgataatttgctgggttttttttagcctaaccatcaaatgaactagttaatttgaatatgaaatcttgctgtaccaaaatacctatctttgatctctagaatatgctctcagcttggtgaaatgctcacatctgaaaccaataccagactcattctcctgttcaactcagtggaataatgggccgagttgcccattacttattttatctctttcccaggtccaagttgttgcatccacctaaattaattacaactccttgtcaggctgatgagctgttacaactatcacttagtaaggagatgtcaaggaccatggcgtgactagcctgactacactctctgctaagcagtaaagttagacaggtaggtttggtgcagcatggacttttttttttcttaaaagagtctttaaaaaaaaaaggccttttgaccaggctggagtgcagtggtgcaatcatgtcgaacttctgggctcaagcaatcctcccacctcagtctcttgaatagctggtactacaggcatgcaccaccatacctggctaatttttaaaaaatttttttgtagagacagggtctcactatgttgctcaaggtagtctcgagcttgtggtcttcagtgatcctcccacctcagccttccaaactgctggaagtttgcaagcgctaccatacccagccgggctcaatttctaataaggaagaaaccttaatattccttaagtgaactgaacacgtaaaacctagagatgattaagtcagtaaggacagcattacagtaaaacaattgagat

SEQ ID NO: 213817 - DNA, 401 bp, Homo sapiens
ccttcagttcttcatatttgtttacctggagtctgctacatttctgaaacttctacatatacttttcgctgtgatttcttctcctattttttccaacaatttggtctcactgtttcctatctttcagaaatccattaaagtctcatcagctgaaagccacctttcttgatttaatacctttaaaaaaatatctaacatacttactaacatatccactcagaatcctttgtattcagagccctgctaaagcagacacaaatatccagcagacctacactcagctaacctctcttaaggctccctttagtgtgatcctaagagagtctttcagctctcataacttaggcaacagcacaaatcacatttctgtaaccagaaaaactgcaaccacctacacctcc

SEQ ID NO: 213818 - DNA, 449 bp, Homo sapiens
cagtcacaggtaaacttctaccacacctgcccaggtggaggcagccacacccccagctgagcccaaggctgggaggcactgccatgcccgcagagactggccagagcgctctatccagatgctgctgcccccacagactgcccatacttggtggcgggttgacaggtgtgtcagcagtgctccaacagcacctgcccctccatgccggagacattccagccagatacgaagctgaggggcacagctgcctctgaagatccagggactgtctgtcttgagctgggctgcacagctggagtgtggagcccctccctgctctcccagggtgggcactgagggcatctacaggagtgggagccctaagctggcctctcactgaccatgggtggtggcccattcctccagcctcttgtatgtgtctcataaacgggtctcccaaggtctccagc

SEQ ID NO: 213819 - DNA, 970 bp, Homo sapiens
ggccgggcgcagtggctgacacctgtaatcccagcactttgggaggccgaggcaggtggatcacctgaggttgggagtttgagaccagcctgaccaacatggagaaaccccatctctactaaaaatacaaaattagccgagtgtggtggcgcatgcctgtaatcccagctactcgggaagctgaggcaggagaatcgtttgtacctgggaggtggaggttgcagtgagtcaagatagtaccattgcactccagtctgggcaacaagagtgaaacttcatctcaaagaaaaaaaaaacaaaaaaagttaagaacatggaacaagttttgaaagatgttaatctctcctgttgcataccccacctcatcatttgctttggtcatgagaatgagtgaatgattaaggttttactgtacatgattatttgtcatcataattacttgacacaaaggtattctctttttttcctgtctgtttggcagccattctttattctgtgtatgttcaaatagcctgagagccttttagcttagtgctccagcatgtcagtgggcctaattgcctataagactgatttgccatttctgctttagagtttgtacagagctacaatgtcaccaacctctgcccccacactgcctccgtgttcttttaaagattcttgtctgatcctttgcgagtttgccttccaaaaacgttagactaatttatatttccagcattagctacctatgtggcaaatctattaatttggtttaaactacctgattttcagagtgccttttatatttgctgactataccaatttagggagagaaactgtagtgtgtatgtgtgcttgcattatttgggattcctttgactcagaaggtattttctttccaactttcttaacctaggcttatttaccttataggtgatttatctgagtatttaactttttgtgacccacgtgattgatgtctggtttt

SEQ ID NO: 213820 - DNA, 709 bp, Homo sapiens
  misc_feature (34)..(34): n is a, c, g, or t
  misc_feature (36)..(37): n is a, c, g, or t
  misc_feature (139)..(139): n is a, c, g, or t
  misc_feature (162)..(162): n is a, c, g, or t
tctgagcgttctagaggtatccccagttgcctgnanngtccatgaagattgaggagaaccagccagtgaagaaggaaggaggaaaagcaagagggaatttgccagtaaaggaggaggggatcaggtgaattcaatgggnagaattgctgttctcaaacgttngtgcacatcagtcaccaggaaggcttgttaaaacacagactgccaggccaggtgcagtggcttgcctgtaatcccaggactttgggattacaggcatgaaccaccacactcagtctgggaaggtaattctaaaatttacttggagaacaaagatctacaatagtcaaaacgattttggaaaaaaaatagcacagttggagaactcatacaatctgattttaaggtttactgtaataccttagtaatcaaagcagggaggtattggtgtaaaaaaaatagacatgttaactaatgatactgagtagagcccagaaacatattgtggacaactaattgtcaacgaagataccaaggcagcttaataagagaaggatagtcttattaacaaatagtgctagaacaactgaatatctaaatagaaaaaaatttaattttgatccttgcctcataccttatacagaaatttatgtgaaatagatatctaaacagaaaaagcaaaaactttaaaacacaggagaaaaatctttgcaatcttggccaggcgcgg

SEQ ID NO: 213821 - DNA, 424 bp, Homo sapiens
aataaaccaaggaaagcaaaatgtggaaaacttattaaagtggaaatcaactaattagaaagaacaaaattacagaatagagacatccaagcggtttggggaaaataaaaaaatacacaattaaaaaagtaggtaaactgttagctacctttatcaagaaaataagggagaaactttgggaggccgaggcaggcggatcacgaggttaggagatcgagaccatcctggctaatacggtgaaaccccgtctctactaaaaatacaaaaaaattagccgggcctggtggcgggcgcctgtagtcccagctacttacgacgttgatgcaggagaatggcatgaatctggaaggcagagcttgcagtgagcagagatcgtgccactgtactccagcctgggcgacagagcgacactccgtctcaaaaa

SEQ ID NO: 213822 - DNA, 390 bp, Homo sapiens
cacatgataaatgtgtgtgctttttttctgctaatctgtctattatcagtttgctttatagactcaaattatcaatgcttcagaaggaaggaaaggaaattatcttcccccttacagttagaaagttggagttacacaggatgaaaagggctaatgtgcagaatgattactattattaatgatactgtaatatatactgaaaatttgctaagacagtagattttaggttcttttgccatgagcatacaaaatggtaaccgtataaggaatgaaaatgttagttgctttactgcaataatcattacattaagtatatgtatattaaaacatcgtattttacactttaaatatgtacaataaaaaagatttttaaaatgccacctttggcca

SEQ ID NO: 213823 - DNA, 403 bp, Homo sapiens
tcctcctcaccctggctcacccccacctgccctgcctggccattcctcctgcctgggaggggccggccccagcttgctgcagcctctccctcactgtgccctggcatctgcgcagccacccggattgctgtgtgaaacatgttcccaatctccctgtcctgctctgccttccttacacccctgtgatagctgcatttgtctgtgtgtttgcattcttatttgcatgttggcattaaccctgacataaagttcctgaaggcagcgatgcggttccctgcctccagtgctcggaaggtgcaggccctatagctgtctgctggttacataaagaggtagatggtgatgcacccagatgcggctctgcctgggactccagtggctgtgcagtgttccaccgtggggc

SEQ ID NO: 213824 - DNA, 551 bp, Homo sapiens
cgcgcccggtcgttttatttaaactctggctttgcgtgtggaagttgttacctgcctggaatgggctgcgaacgggggcggcattactagaggaggctgactacagacatttatggaatgatgacctgacttgtagaccagtggaaccctcaggcgaatgatgccacttgggggaaaggtgtggaagaggttgggtggttgattccaggggacatagaaacccattgtctagaagaagagatgggtaataggctgtctggaatgacttagaaaaggacttggagggaatctgttgatgctgacctgactccacctgttgggggatggaggcggagcttggcgtgtttgattaaggttgggtgcactgggttttcttggaagtcggtctattgcctgagcgttctgtgctgttccaccgcgccctctgctgtcctaggagtgcctagcacccttctttttctctggattgtgcttggtgctaacagcacagaagtaaaaaattaccaaagcacttctttctgggaactaattgataaccatgtattgtgtat

SEQ ID NO: 213825 - DNA, 532 bp, Homo sapiens
ccgtttcgatttcgagctcggtacccccaatcaacatccatcctattcagggatttctagtaacagaatgggaaatataattatggcataaagttattatttgcagaggattttattatctaccaaaaccccaagagaaataatgaaaaactattagagcccaataaaagagtctaataaggtgactagttagggaataaatatacaaaaatgaaaaattttctaaataccaatcaccagttaggaaacataatataaaaggattcattctgtaaaagcaacaaatataagagcctgaggaattggcttaagagacaatttgcaggaactgtagaaggaatctataaagcaaaactgggaaaacaaataagtaaacggaggtatttcatttctggatgggaaggcttggtattttaaagctgtcaatttaaaatattgaatgcatattgcaatagaaatgtataagcaatgttataaaatgattttaaggtttatctggaaaaataaatgggcacagatcatcaagcaaatg

SEQ ID NO: 213826 - DNA, 846 bp, Homo sapiens
  misc_feature (507)..(507): n is a, c, g, or t
  misc_feature (806)..(806): n is a, c, g, or t
cacctcagcccagagctggcggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaantcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcggganaacccctggagctgcgtctgtcgggctctggacccgcgga

SEQ ID NO: 213827 - DNA, 2248 bp, Homo sapiens
ccgctgcgcccgccgcccccgacggcgcagatcccggagaggccccgacgcccccaagcagcgcccagcggagcccagggccacgcccctctgcgcactcgcacgccggctctctgcgccccggcctgagcgcgtcgtggggcgagcccggggggctgcgcgcggcgggcggcggcggcagcaccagcagcttcctgagttccccctccgagtcctcgggctacgccacgctgcactcggactcgctgggctccgcgtcctaggaccgccggcgcctccccacggacgccaggcaggccaggccgctctccggggccgcagcaccaaagacgcccgcctccgccccgcgcgcagacatgcgccacccctcccaggggtgagggggcgttggcctcagcgtttgtcttccggctcctcccagctggccttgtcccaggggcgacggctgccccggacgactgcgctgggcaccgcatgtcccgggccgagtgaggtcgggcctggggagctgagtgacatcccaagcttgggcttgggtagtgagtgacatgtgcacacgtccagctgcgccatcaccagccctgcgcaacaggacgtcgggagcagggaacctgagacagggccactgcgggatcggacaaagccccgctttggagaggctgagctggagccattggcctccccaggggctttccacccacactgcaccataaccgccacacccttcggggggggggagggtacagagggtctctaagcacaggggtgttcagagcccgaacaagctttgatcaggtttccctgcttccgacctgtcctgcctcagtttccccatctgtgatgagcaggtgaccacgttaactctcagggctgtttgaagtctcttggttgtaggccctcgccactgagtggcccaggtgtgagaggtagtctagagccctctgcggcctttgtggaggtccgttctcagcatgtggcctggtgtggctccctaggcctgaggcctcccactctcagtgccccctgcccccttgggaacccacactccaccccagctaagcacaacactgtggaccaccaccaatggcacctgagccaccttgaccaccattagtgtccccaccctcattactctgccgtcgttgcctgtccccaccacatcatctccctccatggctcccaccatgacgctggcaggtgcaagcggagagcacgagggcagcagggcctggccttccgtgtccctgcgtcatccccagcctcactccccacccgtgcaggcctggccaggaagggatcctggcaggggcttccaggttctcagctcaaggcctggtcccgggcaggcgtccaacccctgggagcaatgtatttctttgccttccatcctgggcagaccccttacaggcctgggcattgccatgggccctgggtcttcccaggctaaggagaaccaggaacagctataaccttgagctagtgaaatagggtagatgagaaggctgtctcctccagacccctacccctacacagtggccccacaatatgaagacctggggtaattccaaggtgagcatagagcctgcctgtgcccagttccttctggccctcaggtggccaagcccatctcttcatccttcagatagggtcccactcccagaagaagctgctggggtgggggtgggaggctgcctaagcctgtctgtgcttcagaggcccctccagtccctggctgtggggtaactgggggtatgagctgtggccacaggtgagcaaggcagggaactgcaatccagccctggccgcgggaggggccatctctggccaatgctgctgtgccttcaaggactgacaagttacgtaggggcagaggtcgccagctagccagtgtctcctccatctggggggcgtctgtccacttgtcaccttaggttttcactcatttgtcaccttggggttttgctctgtgtgtttcatatccaacggcaatacttgcagggggacagagtcctctaaatactccaatcctgcggtttttacaaacataaagggggagaccccaagtggaggaccctgggcctggagctccctcccaaactttgtccagcatccagcctgttccctgggctcactggggagggagttgtcttcatagcacacccagagccagggatccctttgtagttttttgacaacggagcatttctcttctgtacaggacccaataaaaacttccttatgatttgca

SEQ ID NO: 213828 - DNA, 2423 bp, Homo sapiens
ccgctgcgcccgccgcccccgacggcgcagatcccggagaggccccgacgcccccaagcagcgcccagcggagcccagggccacgcccctctgcgcactcgcacgccggctctctgcgccccggcctgagcgcgtcgtggggcgagcccggggggctgcgcgcggcgggcggcggcggcagcaccagcagcttcctgagttccccctccgagtcctcgggctacgccacgctgcactcggactcgctgggctccgcgtcctaggaccgccggcgcctccccacggacgccaggcaggccaggccgctctccggggccgcagcaccaaagacgcccgcctccgccccgcgcgcagacatgcgccacccctcccaggggtgagggggcgttggcctcagcgtttgtcttccggctcctcccagctggccttgtcccaggggcgacggctgccccggacgactgcgctgggcaccgcatgtcccgggccgagtgaggtcgggcctggggagctgagtgacatcccaagcttgggcttgggtagtgagtgacatgtgcacacgtccagctgcgccatcaccagccctgcgcaacaggacgtcgggagcagggaacctgagacagggccactgcgggatcggacaaagccccgctttggagaggctgagctggagccattggcctccccaggggctttccacccacactgcaccataaccgccacacccttcggggggggggagggtacagagggtctctaagcacaggggtgttcagagcccgaacaagctttgatcaggtttccctgcttccgacctgtcctgcctcagtttccccatctgtgatgagcaggtgaccacgttaactctcagggctgtttgaagtctcttggttgtaggccctcgccactgagtggcccaggtgtgagaggtagtctagagccctctgcggcctttgtggaggtccgttctcagcatgtggcctggtgtggctccctaggcctgaggcctcccactctcagtgccccctgcccccttgggaacccacactccaccccagctaagcacaacactgtggaccaccaccaatggcacctgagccaccttgaccaccattagtgtccccaccctcattactctgccgtcgttgcctgtccccaccacatcatctccctccatggctcccaccatgacgctggcaggtgcaagcggagagcacgagggcagcagggcctggccttccgtgtccctgcgtcatccccagcctcactccccacccgtgcaggcctggccaggaagggatcctggcaggggcttccaggttctcagctcaaggcctggtcccgggcaggcgtccaacccctgggagcaatgtatttctttgccttccatcctgggcagaccccttacaggcctgggcattgccatgggccctgggtcttcccaggctaaggagaaccaggaacagctataaccttgagctagtgaaatagggtagatgagaaggctgtctcctccagacccctacccctacacagtggccccacaatatgaagacctggggtaattccaaggtgagcatagagcctgcctgtgcccagttccttctggccctcaggtggccaagcccatctcttcatccttcagatagggtcccactcccagaagaagctgctggggtgggggtgggaggctgcctaagcctgtctgtgcttcagaggcccctccagtccctggctgtggggtaactgggggtatgagctgtggccacaggtgagcaaggcagggaactgcaatccagccctggccgcgggaggggccatctctggccaatgctgctgtgccttcaaggactgacaagttacgtaggggcagaggtcgccagctagccagtgtctcctccatctggggggcgtctgtccacttgtcaccttaggttttcactcatttgtcaccttggggttttgctctgtgtgtttcatatccaacggcaatacttgcagggggacagagtcctctaaatactccaatcctgcggtttttacaaacataaagggggagaccccaagtggaggaccctgggcctggagctccctcccaaactttgtccagcatccagcctgttccctgggctcactggggagggagttgtcttcatagcacacccagagccagggatccctttgtagttttttgacaacggagcatttctcttctgtacaggacccaataaaaacttccttatgatttgcaaaaaaaaaaaaaaacccacgctcttctcggtcccgaaaaagggtattgatgccctgcctccctttccgccccttcttccagggaaatccggtcccaaaggccaaatcgaccgcgccccccacaacaccccccccccccaccacccccccccccccccccccccccccccccccca

SEQ ID NO: 213829 - DNA, 2225 bp, Homo sapiens
ccgctgcgcccgccgcccccgacggcgcagatcccggagaggccccgacgcccccaagcagcgcccagcggagcccagggccacgcccctctgcgcactcgcacgccggctctctgcgccccggcctgagcgcgtcgtggggcgagcccggggggctgcgcgcggcgggcggcggcggcagcaccagcagcttcctgagttccccctccgagtcctcgggctacgccacgctgcactcggactcgctgggctccgcgtcctaggaccgccggcgcctccccacggacgccaggcaggccaggccgctctccggggccgcagcaccaaagacgcccgcctccgccccgcgcgcagacatgcgccacccctcccaggggtgagggggcgttggcctcagcgtttgtcttccggctcctcccagctggccttgtcccaggggcgacggctgccccggacgactgcgctgggcaccgcatgtcccgggccgagtgaggtcgggcctggggagctgagtgacatcccaagcttgggcttgggtagtgagtgacatgtgcacacgtccagctgcgccatcaccagccctgcgcaacaggacgtcgggagcagggaacctgagacagggccactgcgggatcggacaaagccccgctttggagaggctgagctggagccattggcctccccaggggctttccacccacactgcaccataaccgccacacccttcggggggggggagggtacagagggtctctaagcacaggggtgttcagagcccgaacaagctttgatcaggtttccctgcttccgacctgtcctgcctcagtttccccatctgtgatgagcaggtgaccacgttaactctcagggctgtttgaagtctcttggttgtaggccctcgccactgagtggcccaggtgtgagaggtagtctagagccctctgcggcctttgtggaggtccgttctcagcatgtggcctggtgtggctccctaggcctgaggcctcccactctcagtgccccctgcccccttgggaacccacactccaccccagctaagcacaacactgtggaccaccaccaatggcacctgagccaccttgaccaccattagtgtccccaccctcattactctgccgtcgttgcctgtccccaccacatcatctccctccatggctcccaccatgacgctggcaggtgcaagcggagagcacgagggcagcagggcctggccttccgtgtccctgcgtcatccccagcctcactccccacccgtgcaggcctggccaggaagggatcctggcaggggcttccaggttctcagctcaaggcctggtcccgggcaggcgtccaacccctgggagcaatgtatttctttgccttccatcctgggcagaccccttacaggcctgggcattgccatgggccctgggtcttcccaggctaaggagaaccaggaacagctataaccttgagctagtgaaatagggtagatgagaaggctgtctcctccagacccctacccctacacagtggccccacaatatgaagacctggggtaattccaaggtgagcatagagcctgcctgtgcccagttccttctggccctcaggtggccaagcccatctcttcatccttcagatagggtcccactcccagaagaagctgctggggtgggggtgggaggctgcctaagcctgtctgtgcttcagaggcccctccagtccctggctgtggggtaactgggggtatgagctgtggccacaggtgagcaaggcagggaactgcaatccagccctggccgcgggaggggccatctctggccaatgctgctgtgccttcaaggactgacaagttacgtaggggcagaggtcgccagctagccagtgtctcctccatcaccttaggttttcactcatttgtcaccttggggttttgctctgtgtgtttcatatccaacggcaatacttgcagggggacagagtcctctaaatactccaatcctgcggtttttacaaacataaagggggagaccccaagtggaggaccctgggcctggagctccctcccaaactttgtccagcatccagcctgttccctgggctcactggggagggagttgtcttcatagcacacccagagccagggatccctttgtagttttttgacaacggagcatttctcttctgtacaggacccaataaaaacttccttatgatttgca

SEQ ID NO: 213830 - DNA, 444 bp, Homo sapiens
actcacattttagaggttggttctcatggtttggaggctttaaaaccttgataattggttttgtaactatagtaggaagatgtctaatactgccttgtcttttacctctcctcaacagaagcatccagtctactatggaagcaatagtggaccgaaaaactaccaccaaaataatggcattacaaaaataccaacctgtcccccaggaagaatatgagcctacacaggaagagataaatgattgtggtgctctttattaatctacatttatggtgagcaccaaaggtgggggatgaagaaggaattcatgaattttacaagtataatcaaagaccaagaaattttcactttttccctcaaaagctaagtgtagtgtagcccccactccccgtcccgtagtccaagttagagaagaatactaactgcctgtttttccttctgcgc

SEQ ID NO: 213831 - DNA, 386 bp, Homo sapiens
tgcatctgactgacgggacccaggtgtgcatgggtgtttgtttgctcgctcccacacaaccttctgagtgtctgagctgcccatctcccatggggaggagggaggggtccccattctgcattcatttatttaggaaaagctgtcttgtctgctcagctgctaccatagccttaacttgggactcaggtgagttacactgcatgtccccttttgaagttactagcagaaaacaaagacccatggggctgggcatggtgacacatgcctgtagtcccagctactactaagaaggctgaggcaggaggatctgttgagcacaggacactgaggcaaaccttgattccgccactgcactccagcctgggtgacaagaaagccctatctca

SEQ ID NO: 213832 - DNA, 420 bp, Homo sapiens
cacctgtggtcccaggccctcaggaggctgagatgggaagaccacttgagcctggacataaaggctgcagtggcccgtgattgcaccactgcactccagcccaagtgacagagcaagaccccaagagcctgtttcaaaaaagaaaagaaaagaaaaaaagttgtgtcatggttagaagaatggctttggagccaggccacttgagtttgaatctcagctctgctaaattgtgtgaccttgagcaaatttctaaactgctccatgcctgtttcagataatgatacattccactgcattacattccaccttcccatcagataacaattcagtggaatagatagaacacattttaaagtaggattcatttgaatttgaaactgctgtaaatatatgagcactgctgcttatatttcaatctaa

SEQ ID NO: 213833 - DNA, 507 bp, Homo sapiens
agaatcagaaaggaagctaagagaaacaggcgcgtcctcagccgggcctcgcgtgtcctgacactgcagcaggcacgggatgtgggctgtcccctccagcacagtgcgggaaggtgctggggcatccaaacagcaaaagcaaacctgagaccccaaaacaactgcgtctggcccaggggagtgggcaaaaattccaacagggagagaccgtctctggcttatttacagacaggaagaaagctattagtgctccatgtaaacaagcacgcccaattcaagttggaactctttaaattctggaagacagcacatcacatccagccacgagggggcgcagccgagcagcaaggagcgcaaaagtctcattcttcactgcaatttctacctacagctctctcaaagtatacacattttcaagattgtttccaaattcaggtatccacaggacactgctaagcaagctgggagctttgccaaggccaaaataaattaaattatggtacggtt

SEQ ID NO: 213834 - DNA, 471 bp, Homo sapiens
tctctggcttatttacagacagggtaagtaaggatgcccaaagacaaggcggagtattagtaacagaactcatgaagttctatggatcgggatgctttaaaaaaaaaaaaaaaacaccaaagctcatccagaatgtctgaggtccctgcagtaacatccatgctaattggtaagtaagacaaagcctcccctaacaaatcagcaatgtaattataaagccagtcactagatcaagccagtctcctgtgctccagcgatattctgaacctgtaacccgataccactgtttgctgccggcgcctcctccgggctctcccgctgcgcaccggccgcgcgggggcccgcagggcaacgcagcctaggctgtttgtgcaagatgagaccctgcatttgacgaagacctgcaggagcaatcctcccggctttcttgacagtgaagaagaagaagaagaaaaaaaaagcctgacgata

SEQ ID NO: 213835 - DNA, 202 bp, Homo sapiens
gtctgtattggaaagcattgtaaaatacagttggggcacatagattcccattggtggcttgaaaactaaataacagaactcaaacctgctattagtggtgagaaaagcattttctttaaaaggcattcacaaacattttttaaaaaaacattgtaacacttgtatgatcatcataaggtttttttttttctggaaagtgtaa

SEQ ID NO: 213836 - DNA, 603 bp, Homo sapiens
tgaaaaagaataaagtcaacaggatggtttaatgtagtgatgggggaagtgggtgtcactggtcaagacaggcaaagagaaggaacttggtaatggaactgggattacaggtgcgcaccaccatgcctggctaattttttaatttttaatagagatgggttttcaccatgttggccaggctggtctggaactcttgacctcaggtgatctgcccgactgggcctcccaaagtgctgggattacaggcatcagccactgtgtccaagtaataaatcttttatgtgtgggagaaattaacatggagaggtttaaacaaccatattagcaaactcccaagcactattcatatgaatgtgtgtctgcatatgtgtaaaatgtgctctcttttaaaaaatcactatatatgttcctttaacttttctgaaagctaaggaaacaaacttcaagttccatgccacaataatgttactattgagaaatgagatgcacaactacagacaatcctactgttttcacatctgcagcttgaccacattacagtaaaggcataaaacttaacactcaagtatcttaaccgaaacagtacatttgccccagggaatg

SEQ ID NO: 213837 - DNA, 469 bp, Homo sapiens
cgagattaacatttgaactggtgaactcagtaaagtacatggccctttccaatgtgggtggttatcagccagtagatggagggcccacaaagagggagagaaagaaatttatttttcttgcattactgcgtgagctgagacatccatctcaccttctccagctcagaccgggatttacattattggctcccttgattctcagacccttggcctgggactggatttcatgaccagctttcctgggtctccagcttgcagagagtagctgcagggacttcccaaactccataatcatgggagccaattcccataataattttttttttttttttttttttgagacagagtcttgctcggtcgcccaggctggagtgcagtggtgtgatcttggctcactgcaacctctgcctcccaggttcaagtgattctcctgcctcagccccccaagtagctgggattacaggtgccc

SEQ ID NO: 213838 - DNA, 495 bp, Homo sapiens
cgtttgaatcatgctaacaggataggatacaagaagcagcaatactaaaagtaggagtctccagggggagtgaggctcttgtggttagaagaggctatatcggccgggcgcggtggctcatgtgtgtaatcccagcattttgggaggccaaggtgtgcggatcacaaggtcaggagatcgagaccatcctggctaacatggtgaaaccctgtctctactaaaaatacaaaaaaagtagctgggtgtggtggcaggtgcctgtagtcccagctgcttgggaggctgaggcaggagaatggggtgaactcgggaggcagagcttgcagtgagccaagatcgcgctactgcactccagcctgggtgacagagcgagactctgtctcaaaaaaaaaaaaaaaaagaataactagtgtcggtggaactagtgtggcccttcaggaagggcaggactcaggtctgtgtttcgcaaacattcagagccattagaccagtcag

SEQ ID NO: 213839 - DNA, 811 bp, Homo sapiens
ttgctgctgaatgtttgagatactagaaaagctcagcctttggtagcaaggagatcggcagttgcctggagttagaggcaggagagggttagctgcaaaggggtcagagaaactatggagggtgataaaaatattctatatctttatggtggtggtggtggttacatggagtatatatttgtcacaattcatcaaactgtatggttaatgaggctacattttatagaatgcaaattacactcagtaaagttgatttttgaaattgatcctgaccattaatagacatacaatcactcgtaaacattattaaagaatctaagtcacaatgtgggccacgttgatgtgggaccagccatgtctaagagcgaatgtgaggccctcgaagaggcttcagatggagacttaagaatcccgggttctgcatcagaagaaacagcagtgaggttatgattcaccataattaaagcttcatgtgacctgggagaagtcacatcacttgtccagttctcagtctcctcaccttaaaacctgagggtcatgccagatgttgcctgaggttttgaccagctcttatatgaacagttattctttattttcctaacgttccacaacttctaatataactaacactattgtcagagaaaaacaatcaccctcatatgtatgctagccaacttaaatgtatatgaagtagatctctaatatttaaagacctcaattgaacctgtcaccacggatttccttctgctctgtttctataatatgacataaaattaatagctgtgatgtgatccacttaataagtcaaaca

SEQ ID NO: 213840 - DNA, 2049 bp, Homo sapiens
cggccacaacgagggagccgatttagatcctctgggcctgttccttccttttctttaaacgtcccagtctagcttagaggaggacctgttttgttagataaatggcaagcaaaaaacgagaagtccagttacagacagtcatcaataatcaaagcctgtgggatgagatgttgcagaacaaaggcttaacagtgattgatgtttaccaagcctggtgtggaccttgcagagcaatgcaacctttattcagaaaattgaaaaatgaactgaacgaagacgaaattctgcattttgctgtcgcagaagctgacaacattgtgactttgcagccatttagagataaatgtgaacctgtttttctctttagtgttaatggcaaaattatcgaaaagattcagggtgcaaatgcaccgcttgttaataaaaaagttattaatttgatcgatgaggagagaaaaattgcagcaggtgaaatggctcgacctcagtatcctgaaattccattagtagactcagattcagaagttagtgaagaatcaccatgtgaaagtgttcaggaattatacagtattgctattatcaaaccggatgctgtgattagtaaaaaagttctagaaattaaaagaaaaattaccaaagctggatttattatagaagcagagcataagacagtgctcactgaagaacaagttgtcaacttctatagtcgaatagcagaccagtgtgacttcgaagagtttgtctcttttatgacaagtggcttaagctatattctagttgtatctcaaggaagtaaacacaatcctccctctgaagaaaccgaaccacagactgacaccgaacctaacgaacgatctgaggatcaacctgaggtcgaagcccaggttacacctggaatgatgaagaacaaacaagacagtttacaagaatatctggaaagacaacatttagctcagctctgtgacattgaagaggatgcagctaatgttgctaagttcatggatgctttcttccccgattttaaaaaaatgaaaagcatgaaattagaaaagacattggcattacttcgaccaaatctctttcatgaaaggaaagatgatgttttgcgtattattaaagatgaagacttcaaaatactggagcaaagacaagtagtattatcggaaaaagaagcacaagcactgtgcaaggaatatgaaaatgaagactattttaataaacttatagaaaacatgaccagtggtccatctctagcccttgttttattgagagacaatggcttgcaatactggaaacaattactgggaccaagaactgttgaagaagccattgaatattttccagagagtttatgtgcacagtttgcgatggacagtttgccggtcaaccagttgtatggcagcgattcattagaaaccgctgaaagggaaatacagcatttctttcctcttcaaagcactttaggcttgattaaacctcatgcaacaagtgaacaaagagagcagatcctgaagatagttaaggaggctggatttgatctgacacaggtgaagaaaatgttcctaactcctgagcaaatagagaaaatttatccaaaagtaacaggaaaagacttttataaagatttattggaaatgttatctgtgggtccatctatggtcatgattctgaccaagtggaatgctgttgcagaatggagacgattgatgggcccaacagacccagaagaagcaaaattactttcccctgactccatccgagcccagtttggaataagtaaattgaaaaacattgtccatggagcatctaacgcctatgaagcaaaagaggttgttaatagactctttgaggatcctgaggaaaactaaagtatatactgtgaaaactttgagaagataatacatatgttcacgtcaatatacaaccatttggcacagcttcctgggaggaataataagaaaaacatgctttggaggaaaactcaagatacaaaaatgaatggctatgcataataacaataaaaatgtattccccaaacaaatcttaatg

SEQ ID NO: 213841 - DNA, 457 bp, Homo sapiens
agtgtcaacagttttcagtaggctgggtcttctgaaagcaccgttctttgcaggggtccatctatggtcatgattctgaccaagtggaatgctgttgcagaatggagacgattgatgggcccaacagacccagaagaagcaaaattactttcccctgactccatccgagcccagtttggaataagtaaattgaaaaacattgtccatggagcatctaacgcctatgaagcaaaagaggttgttaatagactctttgaggatcctgaggaaaactaaagtatatactgtgaaaactttgagaagataatacatatgttcacgtcaatatacaaccatttggcacagcttcctgggaggaataataagaaaaacatgctttggaggaaaactcaagatacaaaaatgaatggctatgcataataacaataaaaatgtattccccaaacaaatcttaatg

SEQ ID NO: 213842 - DNA, 466 bp, Homo sapiens
agtgtatagcactgtcatttattttattaagtgcattctttcttttcctagaactttgagaagataatacatatgttcacgtcaatatacaaccatttggcacagcttcctgggaggaataataagaaaaacatgctttggaggaaaactcaagatacaaaaatgaatggctatgcataataacaataaaaatgtattccccaaacaaatcttaatgtttatttttaactgatcttccggaaaagatttaaggtatataaatgcacacaatctacaacaagataattgagggaggaacacggaatgtggggaagaagagagtaggagagatcaaataaagccaggagtggagttaaatacaaatgcatactgcctaatgtatattgaaaattggtcaaagttttgactctaaattttcttgcagaaaatgaggaaaaggatgacatgtagatttatatagtttgca

SEQ ID NO: 213843 - DNA, 167 bp, Homo sapiens
cctcccaaagtctcctttattcttaaagttttgctggaggtagatttcttgtcttacactttttatctttcatcatttcaaatatgtcatttcactgcctattgtcttccatggtttctggtgagaaattagcaattaattttaccgaggatcccttctgtgctcgc

SEQ ID NO: 213844 - DNA, 331 bp, Homo sapiens
tctatgaaaatggaatttctttccatttattaatatattctttaatttctttcagctgcattttataattttcagcttacaattttttcacctccttggttaagtatattcctaagaactttattctttttgatgataatgtgaatcaatttttttcttaatttcttttcagattgttcattgtaagtgcataggaatacaactgttttttggctggatgcaacggcttacacatgtaatcccagcactttgggaggctgaggtggtcagatcatttggggtcacaagttcgagaccagcctgaccaatatggtgaaaccctgtctctact

SEQ ID NO: 213845 - DNA, 318 bp, Homo sapiens
ctcacccagaggggtaatcaacacccctttccgtgtggctgtgttaccaaagctacttcttgaaattaagacaaaagagcacaaaactgcagtggtagggccctaggtacacccttcaggaaggcacatttacaatggcaattgcccaatgtatttgaaagttatgaaaaatatattttatgatagtctctaaaaagctaagcaaaaatgtaaaaaagaaagctatgaaaaatagcccaggtgtgctggctcacaccttgtaatcccggcactttgggaggccaaggcagaattgcttgagcccaggagttcaagacc

SEQ ID NO: 213846 - DNA, 436 bp, Homo sapiens
gaagggaagggtctcaggtttaccaagggaaaaagaagcatttagctcaaattgtggctgatgaaagaagggcagtcatgagcagctcggtgctctgagctgggtgagtctgagctgaagggcagatttggtgggcatgtatctgctcacatgggagggggagcagttgaggagctctggtagcagcgagcatggaaaaagtatgtgttttaatattgggtcatttataatggaagggctgatgtattaaggctgcttaaaatatagatattaaccattttacaggcaggaactgcagaatggctaaccagattaaaaaacagtgtttccatctggtactattccatggaatcctcatcttacaaagtgataatcatctcaatgtttgttatttttctctgaacttaaaatataaagaaaaaaataaattgaatga

SEQ ID NO: 213847 - DNA, 407 bp, Homo sapiens
caggtaaggactgaaggcaagcaaatatggataataaaccctttatattagtcggaatgaggattatctggattttagcactggcacggtcacaagcttgctccacaacaacatatcatatgacagcacatgatgccaaaggttttctcctacgctagaatgtattgactcaaatattcttgccaactctctaaaatatttgtaacagttaaaaataatctcatgcaagtaacagaatactcaactcaaactagcttaaacaatagggttttggcatttcctataacagaaaattcagtattagggtgggtgatgattggttgagtcagtaaatcaatgaaatcatcaggggctcaggttctttctaattataaagtctcatcccctcttagttacaagatggctgc

SEQ ID NO: 213848 - DNA, 556 bp, Homo sapiens
aagagataatttagggtttgccttaagagaccattagggagataaaaaaaggaaagcaaaacttctgtgtttagataatttccagaatacaagaaaaggtgatctagagtagtttaatgtgactctccctttagtatactattttccaataatttattctaatagttctctgtacgaatttctaggctggttggatcttctatgtcttaaggttttttctctaaatttatctatttttcaaataattgtgccttaatttacagatttttcttaatatttatcttacagtgctcaataaattgcattctcgaatatttaagaaatcagatttctttaaacaaagaagttttaagaattctttttgttttctggttgatttttttcttttatataattatattattggtttatccaggtaccatttatgctggttttactctagaaattacctagatcttctattttttattttttacttttttctgccttgaattaactatatatccctaagcattatctttaaaatttatcttggttttttacttagcttattttg

SEQ ID NO: 213849 - DNA, 420 bp, Homo sapiens
tagtgaggggtgagggggttaaaataaaggatttctctaataaaggacatgaaaagcaagaggagcaatatgcatgtcttttctggaaattggtggtgaacttccaccagtttcacaattgatggtgaatcgcagtgctgctttcctttttgtctttttatggcctcttccggtcattgtcatggtgattttcagctgtcatggtgctggtgggagtgccatatagtatgaaaatgagattataatgaagcccgaggtctttttgatgtcatttggttgcatatcttggttctaaccagtcttaactggtctggttgtaaagggaaccttttattgcagaagtcctgtttcttaaagataagcaaagttaggacagggtagaaattcagctgtcatgtaggcattacaccaggcaacaaa

SEQ ID NO: 213850 - DNA, 468 bp, Homo sapiens
gaaccctggtttgggtgtggagccaaggtggtgaggctcaaattttattgttgttgtttccaaaatctgttggatctaaaaaccaaacatactggagggagaaagccctgcctttagctagcaagtcatcttaaattccagatgctgtagaccgttggtccatttgccaggggttcttaatctcttttggaaagtggaactcaaatctgatgaggctgcattccttctctccagaaaaatatacctaaatataattttgtgaattaatagatctcaatgaaatccatttatggacccctcaggggttagttaatccaaagttaagaaccctcactgtagtcaaaatcacagagctcagtaaagaaaagtaaagaatgctagtgtttaagattttcagtgaaggtgtaagataatttctggatacacacttgttttataaactaatacattctgatttttttaaaaaaa

SEQ ID NO: 213851 - DNA, 485 bp, Homo sapiens
cataactgaagccaaaacatggctacagagagcaggtggatagcaaaacgttccagacacaggaacactatactttaccacagttaactgcagcagtgtgccactgtaatttttcccaggttaatagacaatagtcctgacctcgcttcgtgaataaccaattaatcactcaaatatgtttgggcacataccagacctaaaaaaatctcacaattgtggtcaaatataattttgaatttgaaatttcagcactggaaaccgctgaattaaacaaagttaaagtgatccttcctatgtactacaggaattctcagagcctttgagatgccaagtatgaattaggtacagttaaactgtgtgtggaatacacagaagtttttgtgctttttatcattgaggactttctcacgtatctatttttttcaaaagaatacagtttggtaaaatgttccatatattaaattattataaacacctgcattttt

SEQ ID NO: 213852 - DNA, 584 bp, Homo sapiens
atttatccagaaaatagaatccaaaaccgtggggctgaaatcttctctaattgcaccatgtgatcatgcttttctgaggattgtatttttggtgtgtgtaggtggtaggggagtcttattttgtggctggtgtttactgagagatccatcttttgctcagcacctcaagtggaacaaaatgaagtcagtggcaatcaacctgctttgtaaaaaagtttaaaagccaggtacaatcagaatatctgtctaaacagtgaggtttgtattcattcaatagctttggggacctgctacatgtaggacatcattgaaggtaaactaatgtgtgggaaagggcccctgtgtacaagaaggtggtaatggtggtttgcacttcacgggaacaaagggagtcaaaccttgacaagctttgtggaatttgctgggcaaaagcttgtttggggtgagatcctgtcgatatagctaagaatggagtttgggttctgggtataggtcagctttttgatgggtgaccaaacacactgaggtcttcattgtggctaactgctgatgccgtttcatctttcttttctggtcccgttcag

SEQ ID NO: 213853 - DNA, 409 bp, Homo sapiens
attacagctacctacagctcagatcttcaatcaagtaattgttaaagcctcactagaaggaggaataaatatgttctctggtgaactcacttaataattttaaccttattgtcaaaagaaaggagtcgtaattaagatagcacaatacatgaagcagggagcagcataattgaaccttcctggtgattaatgtgtatccctgaggtggtctcttcagtcgtggagcaaccaaaatgatgtcgccttctttccctgcataagaagttggggcctaatgacaaattatcaaccattgtcattcctgggtgatgctgagctgatagtagttgtgaaaggttatgttggttaatgtaagtgattcttagtaggcagaatacagcctacaaccacatgtgcaccatcgtgctga

SEQ ID NO: 213854 - DNA, 1059 bp, Homo sapiens
tcgaagtcaaagaatccacgcaccactgcaatcaaattattctatttcaaatacaaaagagccaacatgagatgaggaactctggcgtcaggaggaatgggcctcttcccaaccacagtcctcattgctcagggaagaaaccaccagaacagcagcaggctccaggctcttttctgagccctactcgcagatggccgattcatctttcctccaccatcacaccttccacctcactgtccccctacactatcatactgcctataaatactggtattccctaaacctgtcaaagcccaacacagtatcaggtctgcctgcagcctcaagtttaaatcactcttcctacatcttgcacctacagtcccagaacatctccccctgggagcactaaggatacggcaactatctcaatctctggagttgtccacaagttgaccagggaccaaaatcccactggaaacagatgatgcgaaaacccaaactgacaaaggactcaggcaacgtcttgctcaggtgactgtcatgccaacaatgtgaaccaaacactatacaaagacctgttagggggaccaacaccacaaaatacaagggaggaaacaccacagaaacactgcccacaaactcttacagcatggctcaagccttttagaggggtagccagagcctcagttctcacagcacagaaaattctcaaaatgaccgtttccaggaaccatttcctctccctatttaagggaggacgtcagaggaaacaaaggtcctgaaacgaccaagtatgtactgaaaaacagcacaaaagaatcgcagatcactaacatggcacccatcctcactagccaggataattttcagtagaaatgaacggcctggcacggtggctcatgcctgtaatcccagcactctgggtggccgaggtgggtggatcgcctgagctcaggagttcgagaccaacctgaccaacatgaagaaaccctgtctctcataaaaatacaaaattagccgggcgcgttctattttgttgttttcgaactgaggccatgaagagggagcagcagaaga

SEQ ID NO: 213855 - DNA, 496 bp, Homo sapiens
acagaaacactgcccacaaactcttacagcatggctcaagccttttagaggggtagccagagcctcagttctcacagcacagaaaattctcaaaatgaccgtttccaggaaccatttcctctccctatttaagggaggacgtcagaggaaacaaaggtcctgaaacgaccaagtatgtactgaaaaacagcacaaaagaatcgcagatcactaacatggcacccatcctcactagccaggataattttcagtagaaatgaacggcctggcacggtggctcatgcctgtaatcccagcactctgggtggccgaggtgggtggatcgcctgagctcaggagttcgagaccaacctgaccaacatgaagaaaccctgtctctcataaaaatacaaaattagccgggcgcggtggcacatgtctgtaatccccgctacttgggaggctaaggcaggagaatcacttgaacccgggaggtacaggttgcagtgagccgaga

SEQ ID NO: 213856 - DNA, 163 bp, Homo sapiens
ggtctcaaactcctgacaggtaatcctcctgccttggcttctgaaagtgctgggattccaggcgtgagccaccgcacctggccgattcatttattttaagtagtgaaattatatgattgtatttatctcagagcattcattctggagggtagtatatgtattg

SEQ ID NO: 213857 - DNA, 397 bp, Homo sapiens
ttgcagtgagccaaaattgtgccactgcactgcagcctgggtggcagagtgagtctccatctcaaaaaagcaaacaaacaaaaaataaaaaacaaaaggaatatcaaaagcgctttttttctcattgtgtaatagatttcctcttttttctttctggttcttctccatttctctcttttttcattttcagatgaagttgcgctcttgttgcccaggctggagtgcagtggcgtgatctcagctcactgcaacctttgcctcccgggttcaagcgattctcctgccttagccccctgagtagctgggattacaggtgcctgccaccatacccggctaatttttgtatatttagtagagatggggtttcaccatgttggccaggctggtcttgaaccca

SEQ ID NO: 213858 - DNA, 157 bp, Homo sapiens
taggagtccgttgtttccaaagatccagtggtaataaatttatatcctccctcttcagcatttaactgcaaatattttgtactgaccgaatgggttaaattatgaagcttgataagtacatatgcacactacccatccctagctttagaagaagggg

SEQ ID NO: 213859 - DNA, 422 bp, Homo sapiens
cggcaacggaggccaagaagccaccacaatcaatcaggtgacgagctccgcacgtgtggctttaggggacacgggaggagaacacaggccatggggaccaataagcaaagaaaagatggagatgaggtatgaaggaaggatgtgtggggtgaagaaaggttatctatgtgttaatttttcatagaggcaactcaagcctctcgctaacatgagcagaaccagcatgcagagtgaagactctggggagataaattaggtcccagaagactagagagagccaggtccccggaacaaatgtatccctgctgagaggccttctcctacagaggcaagatcctccagataaggaggagagaatggcaggtggtgtcgggcccagccagttttctctgtaaagatggaatgaggtgggtgctgggagg

SEQ ID NO: 213860 - DNA, 434 bp, Homo sapiens
taagtcgtgtaagaattgctaagtgacagatcagagtccagaagacaggaaaggagttaggaaattctgagatatttaaattctgaccatgtaataaatgattcccttgtggaagataaggggtaagtaccaaaaggaaggagtgtcacaatgtggcagttttctaatgaacttaggtcttaaaaggaagcacacacaagatagaaggctcacaatcaggagggactggcagtgatcttagctcatgttaatatactgtgtgtcaggcagtgttctaagcactcacatccttgtttgatctcatgataaccttatgaagtagatggtattattattgcccttttacagaggcgtaaacgggaggctttgggcgtttaggtatttgctgtcatttacatagctagttaagtaactgcgctgggatttaagttgag

SEQ ID NO: 213861 - DNA, 392 bp, Homo sapiens
cgcgtctataaatccccagccagagaccagcgcaggcagccctgggtgggacacctggctgcagctgccttccgttgctgtgtgattctaaggctcactggcggcctctgggcttccccttgtcctgtctatggaatgacgggaggtcggtttcgattcctccacgattctgtgaagggctgagctttcctggggaggtgaaaaggggcttccctgaggacccagcattactgtacctcctcacttaggaagcaggggtgaatctgggattttgggtggtcactgtgggaggacagggctggggtacagagcaagaggctgcctgggttcagatcagcctctttgcatctttttgttgttgttgttgtttgtttttgagacagtctcgctct

SEQ ID NO: 213862 - DNA, 108 bp, Homo sapiens
gttgtaagtgccacttcattaatctccctcatttattttttcgtgcttctcattgtacacatagctgcaagagtggtaagacatagataagatcatgacactccttta

SEQ ID NO: 213863 - DNA, 617 bp, Homo sapiens
cctctctccccatctttgagggtgactcacccctccagacttaggtcccttctccctcctgggagtgggtttccctgagcccacttctgtgacaccctgtagacctgatgcgggatcattacctatgggacccagaaagagtgagaaaccatggaaagaaggcctcgacctctctcatgcccatttgtcaggcaaactgaggtccagaagtgccaattatgaacatctttccttcccccctcccccctccccgcccagacggagtctcgctctgttgcccaggctggagtgcagtggcacgatctcgactcactgcaacctctgcctcccaggttccagtgattctcctgcctcagcctcccgagtagctgagattacaggcgcccgccaccatgcctagctaatttttatatttttagtagagacggagttttgccatgctggccaggctggtcttgaactccttacctcaggtgatccatctgtctggcctcccaaagtgctggattacaggcgtgagccaccatgcctggctgaaaatccttactttttattccgactaaaaaattttacatccagtcccacaagggacttcagcttcacacaccctttctgtc

SEQ ID NO: 213864 - DNA, 514 bp, Homo sapiens
cctccaactctacctctaacggctgcgtgggacaagtcactttgctctcagttcctctgtttcctcattttgcaaatgaggataattgaagtcctgtccttcaattgttgtgggtggggactttgggtggagcccctgaaataggacctggcccttcccgtgatcactgactggctgttgcattagatgatcactgggcgtttggctgttgcattagatgatcgctgggtgtttggctgttgcattagatgatcgctgggtgtttggctgttgcattagatgatcgctgggtgtttggctgttgcattagatgatcactgggtgtttggctgttgcattagatgatcgctgggtgtttggctgttgcattagatgatcgctgggtgtttggctgttgccttagataatcacttgtctgtttggctgttgcattagatgatcactgggtgtttggctgttgcattagatgatcactgggtgtttggctgttgcattagatgatcacttgtctgtt

SEQ ID NO: 213865 - DNA, 462 bp, Homo sapiens
cgccttgtgatttcttactctgaagtgggcttttccacttctggttagtttgggtgagcttgctctttcattctgctacgtttagctcctgagaaagtttggctttttttccccttctttccctcccttctccttcttctccttttttcatcattctgtcttgccctttgggtacagcctggtacaaacattcattcctacagccatgagctcactcagcagcagcctgtccgcccctgctctggtccaggcaccgtggggtagagatgagagcacagtggcgagaggagggacaggggcccttctcctaggggcttcagactggagcatccttggaggctggcagccagaagcagggtgaccggagcaacagaaatggtcacaaatctctgcccacatttcccagccaaattctaccagcctctgcatgctaactgtgatgttttggtgttagctttaaga

SEQ ID NO: 213866 - DNA, 418 bp, Homo sapiens
taattgctgaacaatcgatacaccttatgtcatttagtccccagaagaactcaactattgccatttccctttttacaaaggggaaaagacgttaaaatggttaatttatgtaagattgcacaactaatggcagaggagccttaaggccctcatacagaagtaggccaaagttgaagaattccaggcctaaagcatatcttaccttatttagtactcttgttgctggtgaggtttaccatgaaagtatagtgagaatttggaggagagcactattgtattaggtccctggaatgtaaactccatgcaagcagcaacatttttcttttggcttgggttgtgtgtgtgtgcccagctcctggaatgtaacacaagcttaatatgtattgaatgaattgctgattaaatagattaatgatca

SEQ ID NO: 213867 - DNA, 631 bp, Homo sapiens
ctcattttaatttttactgacctgcactttatacaaagcaacaagcctccaggacattaaaattcatgcaaagttatgctcatgttatattattttcttacttaaagaaggatttattagtggctgggcatggtggcgtgcacctgtaatcccaggtactcaggaggctgagacgggagaattgcttgaccccaggcggaggaggttacagtgagtcgagatcgtacctgagcgacagagcgagactccgtctcaaaaaaaaaaaaaaggagggtttattaatgagaagtttgtattaatatgtagcaaaggcttttccaatgggtgaataaaaacacattccattaagtcaagctgggagcagtggcatatacctatagtcccagctgcacaggaggctgagacaggaggattgcttgaagccaggaattggagatcagcctgggcaacacagcaagatcctatctcttaaaaaaagaaaaaaaaacctattaataataaaacagtataaacaaaagctaaataggtaaaatattttttctgaaataaaattattttttgagtctgatggaaatgtttaagtgcagtaggccagtgccagtgagaaaataaataacatcatacatgtttg

SEQ ID NO: 213868 - DNA, 529 bp, Homo sapiens
aggctacggacccagcccctgccgcagcttccgcaggcggccccctgagcccgctctggcacctcctgggcttcgggaggatttaatgcgtttctcacccccacggcttccgaccctcaattatggacccgggagaattcctcctgggcttgaaagggattacccagatcgcagaaacatggctaagtggaagtgggagaaacccgacaagtaacaagaacggaaactttcctcaaggcaaatttcccggattttacgggaaagcgcacttatcttcccagggacagcctctgttcacgtgtccgcgaggcaggttcgaagcgcgctacgggaggcagagcaatgccgtgtttgaagactggaagatacgtgggtgtgagatacctccaggcccaacgcctgcccagcagctgcccaagcagacgttgtgtactcggctcccccaagcacatcctttcgccgtacacgcgcgcgcgcgcacacacacacacacatccacacacacacgcagctgtggctctggggtccc

SEQ ID NO: 213869 - DNA, 513 bp, Homo sapiens
aacagtgtattccttcatacaattcacacatattatactatgctaagatactaagagtagacacatgcgaataaggtatagtcaccatctccaaggatcctccaggctacagaagtagagaagaatgagtagacagttactatacagaaggaagtaccatgtgccacataagcaaaaaggcacgtatttacctctactagtgaaaactatactatgaataaagaggcggctgggtgcaggtggctcacacctgtaatcccagcactttgggaggctgaggcaggcggatcacctgaggtcaggagttcgagaccagcctggccaacatggcgaaaccccatctctactaaaaatacgaaaattagctgggtgtggtggtgggcacctgtaatcccagctactcaggaggctgaggcaggagaattgcttgaacccaggaggcagaggttgcagtgagctgagatcgcaccactgcactccagcctgggtgacaggagtgagactccatctcaa

SEQ ID NO: 213870 - DNA, 458 bp, Homo sapiens
tgctgccacccgtccccccacaaggcatgggatgaaaacagtagcagaaaggactcagattggtggacaggaggaacttcccccttggcaaaattttaggaaaaggcaaaaccccatctgcctgaactattccagagatgcgagttcggtatcctgtggtggctgcagtcttggccccatacctggctttaagccaagatccaatggtcaagtcttctgcttctggacagggtgcctctgggagctacaaccacgtccgtgaagagatgctcatcaaggctggcggtggtgggggcggggggtgcaggcagtgtggcattgaggctcctcccaaaaacattccaacgtccagaaagctttcagtctgttaggctccacaatcccctcagcctgggtctctgtggagaattcaggccccaaatcctagccacttacattaaacagcattttacacagca

SEQ ID NO: 213871 - DNA, 778 bp, Homo sapiens
agtgctttgataaaagttatgaccttcttttccagaaaagacatatatgcatctacacatgttttcatataatttcaagaaattttttgttaagtcttctgaaactcttcaaagggggttctttgaccacatattcaggacctctgttctaaaagatgcacatgaacccaatctaaaactcggatcagaacaccgtgtttctgatttctgtattggtgtccctaaaggaattctctcccttgtgttcagattaatgccctcagttctccagtttcaccattcttacccaacatctgacctaactttatcttacctaatttctttgattatattaaaatgccgaggagaggattttttttaaagaaatagaaaaaaggacatacaaatttcaacccgtaattcacaaaataatttgcaattagttgattaaatggtatccactttttccagtagatggcactaggtttacattctttcatagcatgaatgattattgatattagcacataggtgcattgtgaaaacttaaacaaaagtatataaggaatagccagttaagaacatatggatttataatccacaaatttttctgcttatattatgttcaaacaatatttgtagagcacaaaacctttttccattttcaataagattctgactcccttatgcttggccatctcattgaaattgtctttcatgtgtagactttctataaactgaaacaagttttcataaattatcttgtatccaaatagctgatttaacagtcatttatagt

SEQ ID NO: 213872 - DNA, 936 bp, Homo sapiens
  misc_feature (3)..(4): n is a, c, g, or t
  misc_feature (12)..(13): n is a, c, g, or t
  misc_feature (96)..(96): n is a, c, g, or t
  misc_feature (98)..(98): n is a, c, g, or t
  misc_feature (515)..(515): n is a, c, g, or t
  misc_feature (538)..(538): n is a, c, g, or t
  misc_feature (643)..(643): n is a, c, g, or t
  misc_feature (651)..(651): n is a, c, g, or t
  misc_feature (681)..(681): n is a, c, g, or t
  misc_feature (687)..(687): n is a, c, g, or t
  misc_feature (697)..(697): n is a, c, g, or t
  misc_feature (703)..(703): n is a, c, g, or t
tcnnccgcctcnncccgaccccgcccgggcctcccggcctctccccgccggcccgcgggctcgtcgtccggcgcagggcaggactgtctacgagananaagctccccacgtggttccgtgtaaatacctaggagtgggcttttctagatcacatggtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggntcaacatctcagagggaaactgnccagagaggattgtgaccatcacaggccccacagacgccatcttcaaggcctttgccatgatcgcatacaagtttgaggaggatatcatcaactccatgagcaanagccctgncaccagcaagcccccagtgacgctgaggcnggtggngcctgccagncagtgngggtccctgatcggcaaaggaggctccaagatcaaggagatcagggagtccacaggtgcccaggtgcaggtggctggggacatgctgcccaactccacggagcgagcggaagaccagtctcggagaaccccagaaagaccaatcatccagtgcgataaaagcagatcatggagggaacaatgcagggagagccaacacaaaaccagggacagggatgccagacaagtaaaccg

SEQ ID NO: 213873 - DNA, 751 bp, Homo sapiens
actagtcatttcctatggccaaataacattggatctgctttcatacatactatcttatttaagctttaggatgtcctggaaggtaagtagaaggggtaactccatttttcataaccccatttttataggtaaagaataagagagtcaatgagattaattagcttgcttaatatcgctcagctgataagtgatggaacaaagattggaactcaggtcttgtgccaaaacctatgtttttattttgcattgtatctctgggaagaaaacattatttagggagaaaactggataaaagtaagatgacacaagggttgtttggataataagacccatttttgaagattgttgtttggatggtcaaactgagtaaaatgtgtgagagtggttgtcttagtccctagcccatagcaagtgttcagtctcggctgattgaatctgggctgcaagggagtattgatgccgaaggggaaaggaagcctccgaattactgccctgggaaaccactgttagcaaccatgatctagaacactctggaatgttgttaaaacccttttattcatttagtccattcatttagcatatatttattgatcatcccttatgtgcactctatttggtattggggatctaacagttaactggacaggtcaactgcactggtcctttcctatcataagggtagtgaagataagatagggatgtgctcatgggatgttgtgacttggagttggctggggctttggctagagca

SEQ ID NO: 213874 - DNA, 498 bp, Homo sapiens
gtgagatggcaaaataatatctttatgtaaatcctgcagtttgtatcagtagtatgaggaggaaaatatcttgttaggttggattgaaatgaaggaatgctatgcattcttgtaatactttgccatttatgaaatgcttttgtttaatcttactgaaagtttgtttctactggattcagtcagtacataaaaatactgtatgatattttgaatcagctaaggcctccatttaatgaaaaaaaatcttgatttctgagctttgtagtcattgtaatcagtatgaggattttcttctacttgcatttggctaaatctttatacttgtgacactgtgaaataggtagtatggtttaggtttaatgcctttagcatgtttgcacatccagttcaccaattgagtagcactggtgaattagaagtgggaaaagtgagaattgaagactgagagaccctgattccagctttgacgctttggcaatctcttaactggcttctttc

SEQ ID NO: 213875 - DNA, 409 bp, Homo sapiens
acttagcccaaagtgagcatcaacacatggtaacactccatgtacaataacaaccactgtatatcatagaattcatttatgtaataatgatacaccgatactattaatttcaagacttataaccacttctccccatctcttgaataggctccaaggctttctaaagtgcaactagtccagggaagttgtcagcgatgtcaacctcagagaaaatgaagggtttcaaccaggcttaactgaagggaagcgagggaagatcacagaggcagggtgttagagcagggagggcctttgggagcacagagtcttttttccctatcacctgatggatgaagaaactgggatgcagagagagctggtgagctgatctttcttctttaacgtttgtcccattctccaccaggagtga

SEQ ID NO: 213876 - DNA, 522 bp, Homo sapiens
cctttttcctacacaaccctaggactattttgcccaacctcatcttgatggttttttttacttttttgttatttatttatttattgcccttaaatagtctcctatccaatcgtcttgtatttcaacacaccactggaaacttctagctatctcaaggtacagtaattccatcagatttactgcagaatcaaacccagtatacctctcaatcccaacataatttactgaaggactttttccccaagctgctatgaaagcctcttcagttccataaaacactggtgcaaattcagaaagccatctaaacagctgggaaagatttctcttctgggacaacagagtagagagtaagttctcagcaatacttagctcgaagatggcacaaagcaaagacggcaaagtctaccgagaacatcagacctctcacacttaaggccttcaatttgcacagatccattcccaccagtcaaatgcaagtccgtcttttttttcctctctttttctcgctctgtcacccaggct

SEQ ID NO: 213877 - DNA, 248 bp, Homo sapiens
cagagctaactaaaagtctccttggagagaggccctttgactacctttcactgaagtgggagaaactgttttaaaagtcagacaagcagcacaatacctaattggctatttctccattccatatcttctcaattagcaaaaagctcaattcgcatgtgttttaaatgccaaagcccattaaaagtgaaatcattggagacgtgtctgagggatgagacacatgccagctgatatattcaaacaccgag

SEQ ID NO: 213878 - DNA, 549 bp, Homo sapiens
tttcatatttctatgtctttgtcactctatggtgctctagctaatttgtttcagctctttcaattcttcaactctctccttagctgtatacaatctgctgtttaacccattcacagagttttacatttcaacaattaaattctttaaagttctatcatcctgttctttttaaaattcatctggtcatttttgacacctcttgttgcttgctcattcttgtgagtctaccttttatttctatgtatataaaatgtactttaatatttatattccactagtgtatatattccatccatcagatgttacagtcaacatctgataatttcagtatcttatgtccttgaacatctaaattttgctagtctctaactgaagtggcgacaagtgcacttgcctctagtggagttccttctgttgaattttcttgctgctcactgctctagctctaggttcaactcatcagcttttgggggtgggacaggtggtgctgaaggagttactatgtttaaagatttctctggccaggagcggtggctcgctggctcacgt

SEQ ID NO: 213879 - DNA, 588 bp, Homo sapiens
gcattatatggatctttaagctttctccggtggacttagaaagtttgaaatgttgagtagttgtgaaacacgaatacacttagtatatatttacttccaagagtctgaacttgaacattatttttaggtgtctagtaaaataaaactaaaacgtcaagtcctattttttcattgacacctataatgaaatataaattctgaaactagctactccttttctgtaactatagcagggagaaaacttttctttctctagaaatttttaaacagattttatttgttacttagagtattgtgttcttactgtgtctgctactctaaattgtaaaatgatggcattcattgccatccatccttagaaagttcaggtgtgacactcctagaggctgaataattcttccacagtcaactccactccaggatgaattattaatagggttgaacattcctacttgggccaacagcatttttaatttaattatatctgtgccagactctggacactgaaaattttataattgcaagtctggaaaattcttttttagactttgatatttgcattaaatatattttaccttctataagagt

SEQ ID NO: 213880 - DNA, 695 bp, Homo sapiens
gacttttaaaaatcatttgtgtgggacttctgttctctgaaatgtgccagactggagaatctgaggcaggtcccaatccaaccacgtggaaatgctagagacaggacaccagcatgccaggcagccttgtatgttcatagctgagctcccacgtagccaagagaatcctcagggaccagcaatgaagagggagggacagatatgcccaggaagtatgcagcagccctgggggctttggtctcagagtctagggcttgatttttccatccagatgtggacaggaggtgaagccttgggtctgggaagcagggagttgggatgaagagaaatgaacagaaaacaaaatctgcctgtggcccaaaagggtgacaaggaagctggtgtgacccagcctggattctggaaataaaaatcttcctgggagttgtagccctgggcctgttcctcacatgaatatgggcttcaaattcagcctatctgctagtctagatgcccctacactaaaattgtcattaaaacaaaattggctctaggaaagagctctggtccaaagcaaatgtaaaactactctggtgggacatgacccccatccaagctgacaagaggcccagcatggtggctcacgcctgtaatctcagtactttgggaggccaaggtgggtgtattgcttgagcccaagagttcaagatcagtct

SEQ ID NO: 213881 - DNA, 435 bp, Homo sapiens
ccacctgggtggtgtggaggtgcaggtgggctgttaggttggtggctgtggttgtgaagccgatgtcactgtctttacccagcagcttattccagaaagggggcgtcagcctgcccttccagtgccgatagaagcactagcgggtgatttttccctgttttgctgtgtttgctctggagtcaccaggtgacttccaggcagtgtgcagaaggaaccgtcccattatttggcacgtgggccgtttcctccacccgaggtccagggctccgtcttcacagtctgtcctcagcacacagtaggcacctgtagatggcacacgtggcgtttcctccgcccgagggccagggctctgtcttcagcacacagtaggcacctgtaaatgtttgctcagttgcggcgaagacaagcagtcaggttcttttcattttaaggaac

SEQ ID NO: 213882 - DNA, 246 bp, Homo sapiens
cctcttccctccttccatttctttcgttcttccttctttcctgtctctcttccgccttcttttctttcttctttctttcatttccttctctcatttctttcccccaccttcccttaatttctccctcactcttttccttcctcccttcctctctccattttctttctcttctttcttcagcttccctcctttctcctctttctcctttccttacctctctggctttcctgtttgttcgttccattt

SEQ ID NO: 213883 - DNA, 317 bp, Homo sapiens
cctcttccctccttccatttctttcgttcttccttctttcctgtctctcttccgccttcttttctttcttctttctttcatttccttctctcatttctttcccccaccttcccttaatttctccctcactcttttccttcctcccttcctctctccattttctttctcttctttcttcagcttccctccttccattactttcgttcttccttctttcctgtctctcttcctgcctatcttttctttcttctttctttcatttccttctctcatttctttcccccaccttcccttaatttctttcttctttcgttcat

SEQ ID NO: 213884 - DNA, 401 bp, Homo sapiens
agatgctttttcatttgctaatactttactagaattctaattatctacatttgatattaagttaattgtgtttttcatatctgactcctctgtggttctgtttagagttccaaatatggataaaattcacctgatgagaattgctgaatcttgtattcttagtattaggttacatcattttgacatgggaatttgtcaaataggatttttaaaaccgaatcaatttaattctaagtaactcaatatctagatttaccttggctggatatgatggataaactggatcatgaaaaagaaaacaaatacaatctaggaaagagagtaaaggcagaaaagtcatgtgtacaatggagaaacctaattttgaaaattaaatgcaaagacctagaaatggctattca

SEQ ID NO: 213885 - DNA, 565 bp, Homo sapiens
ttaaaggcaaggtcttgctctgtctcccaggctggagtgcagtggtgtaattatggctcagttcaccctcaacctcctgaggtcaagtgattcttcctcctcagcctcctgagtagctgggactacaggtgcgtgccatcatgcctggataattttttttttttaatttattttctgtagagacagggtctcactatgtttccaggctagaggtagatgtttttaacttccattttacaaaagaggagtcttgagatttaggtaaaataatttgcccaaggttccaaagctaagctgtgattgtcatgtgtgtcaccgctgagatgtaaacataggcaagctgattctcatgcccccactttaaacaatatgttatagctccagatgaatgaatatgctcttacctctagttatattgtgactccagaagtgactgcgggtaacattttgcttcattttctactgtttcttatagcttgtgagcatctccatattttggagggagtgactgaaagacacaagaattagcaactttcttcatatttcttccccttctgaatgtgcc

SEQ ID NO: 213886 - DNA, 561 bp, Homo sapiens
aggaaacgataggcagtgcgaacaggtgtatgcacactcactgaggaagtgcagcctgtctgacccactctctctcacccagcctagggtcaggccatggcaggacactgtttccttaactatcagcagccatcttggggatttccccacagggccagggcaacagaatctgcttctcactgtgaccatggtctggaaggaccatgaggaattctccagtgctgtcggggtttccgatactgacacagacaatttagtaacagctttgacaccttttggtaataggacaaagttaacactcctgccactatcctgtgaaggccaaccttcctaggccccataggaaacttttggaatgtctttgttgggttgagaaactggggcaaagtagtacccaattttttcatgtcaatatcaaaatgtaatcatttcaggtacacagagttccgcactttcagattagtcttaaagaaaagaaaatcgccgggaacggtggctcgtgcctgaaatcccggcactttgggaggccgaggcggacggatcacctgaggtcaggagttc

SEQ ID NO: 213887 - DNA, 363 bp, Homo sapiens
attttttcatatcctcaagatttacatttgttggttccatgtacatttgcacatttgcaatcagactttctactttgtatgtagattctaaaggttgaatttgtggctcatttctgtaatcccagcactttgggaagctgaggtgagaggattgcttgagcccaggagtttgagaccagcctgggcaacacagtgagatcctgtctctacaaaaactacaaaaattatctgggtgtggtagcacatgcgtgtggtcccacctacttgagaggctgaggtgaggggattgcttgagtgtgggagttcgagtctgcagtaagctatgatcatgccactgcccttcaccctgggcaatggagtgag

SEQ ID NO: 213888 - DNA, 386 bp, Homo sapiens
gacgtggagcggaggcagagggggtgtcccgtgggtccctgccacaaaggggtagggggaagggaaaccccaccccgggaggggctgctggctggcggcggcccgggcgggctgcggcggtggccaggtgggcggtgccgtggggggcccgggaaggtccgggactggaacctggaggaaaagacgtcccgcggcctaggaagcggagccgccccccatggctgaagggggaggcccagggaggcagaggagaccccgcatcccggggtcacggcagcagggcagcggggcaccgggaagtgggcgcagggccgggaagaccggccggcgtggggaaggctgctgtgggttctacagtgcattgtcccgggtgaggtggcggccgc

SEQ ID NO: 213889 - DNA, 826 bp, Homo sapiens
ctctctctccttccctccctctctctctccttccctccctctccctctctctctccttccctctctccatggaaggatgttatgtatcttagcaacaaaggctttggattttcccctccagttactgacaagaaaccagaatgatttctggtgtcagaaaccttcctcgaacaaggagctttctctggagaacaggctccgagcagccacacgtcattcgacctctgttccccgttggggtgtcctcaggccaggacatcctggcaagtgggccgtcagcgggcagtggcatcgcagcctcagccgggagacccaagtcactcctctcagaagcgcggcacccgaaccacctctgttcatcacattttgtcccgtggagcagtgacaagacccagcaagatttcatggcgacagaacttgaaggtttcagggcgacggaacctgagagtgatacagacattttgattcctggtgcaacagggtatgaagaaaacacatacctaattttatcggaaaagatatactgagtgtctatgcatgctgtgatttgaaagaaaatcactcagtagagaagggcctcaggtcacaagccttttgtctaagtgagggggataaaaaggcttcacagtagagtgacaattactaatcctgcgacagtaatatatgcaacttttaaatttttttctaaacatttattttgtgactactctgtttcaatgctccctgggagtgaaaaacaagattctagccaggtgcggtggctcacgcctgtaatctcagcactgtgggaggctgaggcgggaggatggcttgaggccaaggagtt

SEQ ID NO: 213890 - DNA, 397 bp, Homo sapiens
tcttagttcactgtttcacacccgcactgacagtctgctgtccccccaaggccctgggacatctgccaggcagtgaaatcaaatgtgctctttaaatacagctcagctccacgtcatattctccttctccctcttctctccccacctcctctccttccttcccaggaatgcaacattgcccaggcaggggacgggccaggctgaactggacatttccaaaaagtgtttcttctggaaatttcacccaaaaggaaagggtctggtataatggactcccatgtatctgtcacttagctttagcaattctcaacattttgctgatcttgttgatatatatatatagatatatagttatttatataaagtttatataatatttataaaaaattataagata

SEQ ID NO: 213891 - DNA, 451 bp, Homo sapiens
tagattctgtggctgagaattaaactaatgtaagacagactaacagggcaaaaaagcatacaaattttattaaatatttttccatacacacaggagtcttcataaagaaaataaaaatccaaataagctgttaggccccaaagcttaaatagcttttttaaaaatgtgttaaacattgtgaggatgtgacaagacaggggaagtaaattgtggggcagtgactaggaaatatatgggggaaattaatggaggatgagttgttttagtagattggtttgtccagattcatctcagcttcaactcccagtcttcagtgataagaatgttcttttctttctgatatggggaaagcacctgtctcatgggaaattttatgatttgcatttagaagagggtcagggaaactttcctgcacctgctgtttctcaaataccttcagctataaataatc

SEQ ID NO: 213892 - DNA, 183 bp, Homo sapiens
ccattctggcaggtatgtaatggtgttgcattgtttaatttgcttttcccaaataactaattaagttgagcatcatttaacatactccttggacatatatggatttttttgtggcatgcttattcatgtattttgctttttttttttttttttgagatggagtctccctctgtcatcgggctg

SEQ ID NO: 213893 - DNA, 466 bp, Homo sapiens
gctgtgccctgtgtctgaggcagctctaccctggtcaaccccttacttggctttaggagagaaatttaggttcctgcctccctcaagggactcccttacccacccctatttttttggcagagggagctgctgggagttgttttagccaacagtgctagtggaaacagcttattcctcctcttcctgactccctccagctaacctgcttgttgatagttactccatggaatcatgggaggagagtgaggactgggaggaagagagaagccctggggttccctagggtgacttgtggagccagctatttagagattatggtgggctcacagtttgtgccagacacgaaatcaaatgcctgtgttggctctcgggagagggcctcaggtataggcatgttaagtgtcccattatatcctcaccagaggcctcaagatgaggggctgtattcaatatactaagattttcc

SEQ ID NO: 213894 - DNA, 382 bp, Homo sapiens
aaaatggcccatcaacattctcacagtaagttaacctgaactgggacaggaaccaaagggcagaggcttcccatctagtgcatgtttgttccaaatatgtctgcctaaggctacaatattgtaatatctcacttgcctatgtttcttaatacattttacttttaatagtgatttctatatgaatacttgacatcatttagaaacaatctaccatctatggtattggtgaagattaaatcatgcatttaatgtaattcttggccaacagaagaacacaataagaaattattattgggtttaagactagaactttagtaaatgtacacatttgattataataaattttcagacttgagtctgtgaagtcatccatattttcttt

SEQ ID NO: 213895 - DNA, 366 bp, Homo sapiens
gtctctacatgaaagaatgaagagtcctaaaaatcataagcatgtgactaatattaagtctttcctcattttaaaatttctttagtatataattatttaaagcaaaagtaataacaatacattgtgataattatgtctacaagaaatgaataacagcaacatcagaggagggggtaaatggaattatattattgtaagatttgtgccttttaactgaagtggtgcagtatgaattctaggtagactgtgataagttaaaattgcatattatggtgccaagaggattttaaaaaaaatgtaaataggtatgttgctttaaaaagtcaaaagaggaaattttaaaatacttttaaaatattcaatcca

SEQ ID NO: 213896 - DNA, 407 bp, Homo sapiens
catagtaggtagcttcaagagggtcatttagttcacgggagagtgaggtgtgactgctgtcacacacttacatttcagtgcctctctgggcctgataattaaaatgggtttgcactcctcacattaaaagtttttatttctcactatgaaataaggagggaagttcattttaaaaggagtggcagaataaggagaattggagaaccagtacagaagattcaaaacccagatagtagaagtcccagaaaggaatacaaaaggaaagaaattgccccaaaaaattttcaagaaaatttccaagaactgaaggaggaatttccagattgaaagggcccaccaaacacctattgctatgatatagtccatggccaagtatggtcctgaaatttcagaatcctagggacaaa

SEQ ID NO: 213897 - DNA, 514 bp, Homo sapiens
atgcattgtattcttgaaaattggtaaataagtagatcttgaatgttctcacagcaaaaaaagataaatatgtaaggttatggttatgtcccttagcttgatttaaatttgatttaatctttcatatgtatacatataccaaagcaccaccaaaaatatatggatttttagatttattaattgtcttaataaaagaaaaaaacatggatgtataaaaaataaagaatactaagagagtttaattcccaataagtactaggagctgttattaggaaaagcttgatacttgaacttataaaatcagagataaaataacagaaagtaaagattgaaattcatcattgctctctgagttcttagtatatcaagacttctcatttacagcagcatatttctcaaatttcaatctgttaaattttgtcaccctccatgaaacattttacattaaagtaatactagaccattttaagcagaagagaaattccttttatgttgcacctgaattgtgcctatg

SEQ ID NO: 213898 - DNA, 255 bp, Homo sapiens
ccaaagtgctaggttacacgcgtgagccaccatgccggccatttctgacattgtccactctacttatttgttgttgaaatgactttaatgaaataatagtgattaaaattaggttgttggtattttaatgttcttatttggtgaaattaaaagttagcattctgatactgatccctaacatttttgacagttgcaggtataatccaattctggggaaactgtcacattagaacaagtgagcctatctcatagttg

SEQ ID NO: 213899 - DNA, 485 bp, Homo sapiens
caactccctctatttgttcattgcacttttgttacattcattgggcccttcatttgtgctgcagagattcatatgtactgtattgttgggttttttttttttctgtttccccaacaggagtgtaaattattcaggcacaggttcttacttgtatctcaagaacctaagacacaatgggtgcttagttaaaaataattagtgatggtaaaatgtatcttgtaaggttagtacctgttcctgaaattgcaaaaggtagcgtaagtcctgactgccgtgatgaatgagttactgttttggcagagttacagataggagctatcccctttccttttactgtgcaccataaataaatttttagaggctctgtctcgagtagaaatgtttaatccctgtctatgcttgactttccccctaggtgccaggaaaagcaaacaaatgttaagctgtccttcctagtagttcagtctgtacattgctgattaaaa

SEQ ID NO: 213900 - DNA, 419 bp, Homo sapiens
aagattttattttagagtttagatacacaggtgtaatttgtaaagtacagaatttggagactctcagaaatgtacatttgattgaagctttaagggaataataggcttggatagaagggaattttttcttgaaatctatccagaagattttctcatttctgctgttaaaatgcttttctgaattgatagaaccacctgaaagcgatgctgtggcaatagagactgaggtcagggttacagagagagagagagatcttttaatataacaccatgtagtgaggaagtaaacagatctaaggatgtattgatgttctttaatattggagtcaagaaggccacttagcagtttcacagtaggttagttaagagatagtaaaagctcagttgggaccagacacttggctcttagaatggaaaga

SEQ ID NO: 213901 - DNA, 353 bp, Homo sapiens
ttgagtttgtgtttgtatatgataagggtccagcttcactttttttgcatgtggatatccagttttaccagcaccatttgtagaagagactccctttccccatttgactgttccttgtcacgcttgttgaaaaccgtttgaccatatatgcaggggtttatttccgaggtctctgttctattccattggtctgtatgtctgcctttttgtcattaccattgttttgattattatagttttggaatcagaaagtgtgagccttctcaactttgctctttgtttctaggattgttttggctatttgtggtcccttgagatttcatatgtattttggaatggatttttctatttca

SEQ ID NO: 213902 - DNA, 253 bp, Homo sapiens
tgtatggataaactgacccttcataaatatgtgtttattccttacaaatacttagccttatttgtttctttatttccatgtgactgtatatactttttactgattatcattggttttgagcatttttcctgtgtggtaattttctatgaaataggtttcaatcattttctgtgaaatagttttcaaatagttctcatttatttgtttgtttattgcttttacccctcccccctttaaacatactctgcacgct

SEQ ID NO: 213903 - DNA, 441 bp, Homo sapiens
ttctgatcttaggaggatgctctccatggtgcctgttccttctgttttgtccttgtttttcctcttccatatccacacggggtgcagggactgtggctcatggtaaatgattcacaaattttagctgaaaagcgaatgaatgaagattggctctttataacttgaatagaatgatgataagggggtgaaatgatgaaaaggttacagaagtaacataaaatgttgtttaactggacaccagtagaggtatacaattcctaggcaaaaggacactgagaagaacaggagtcaggcactcagggataccacctggccggttaccactgcccagtgagcctctctgtaaagctaccccaagaggctgcagaggtaatttctcaattcagtgacaggcaatgctacatggcaaggaaaaggacaaagcctggtgataagaagcca

SEQ ID NO: 213904 - DNA, 111 bp, Homo sapiens
aaaaaaaaaagatattgttttgtaacctgctttttttgcatcatgacgtattggccaacatttcatgaaactcttgacatctataacaacatgctatattcttttatcttc

SEQ ID NO: 213905 - DNA, 396 bp, Homo sapiens
tacagccttctttggagagtgtgtatgcccatcttctgctgggttaatttttaattgatgagttgtaagagtgtctaattgtattaattagtgcctgaatataaacattaacttagaccatgtcatatattgacagtaatgtcttattcctgattttaaagcaaatgtatccagtaattccactgtgcccttggaattatataataagcctatagttttttccagttttctatttctattatgtttcatcttcaatttttatatttatttctatgatgttttaatcttaatttattgttacatgtatattgttgctatttggcacattcctaactactcgatattcactatggattgcattctttattgttacaaagtatatatttcatttcttgt

SEQ ID NO: 213906 - DNA, 431 bp, Homo sapiens
agtgtctgttgtgatgcattatcagggctcaccacggcatggattaagcagtcctcagaagggttagccatccttagcactgattccaacacccctgaaccacattctgaatgctaagtcaacttcctgggtaccattagctcagaaaggtatattctggacaatggacatggtcactggaaagaaatggcatttttttgtagattccggggtgcccagcagcctcttgtgaatttttactcagacattctgagtctgatccctctggctcccagataaaagggagatgtggggacctctatgataacgctctgtgcttgatgtagtgttctacccctccccaagaatgccactcttaggggtcttttcagggtaaacagcagcctctcctaagtgtcaggcttactttgttgttgctcctcttcaaaatg

SEQ ID NO: 213907 - DNA, 871 bp, Homo sapiens
ccttttggattcccattagcttgaaacactttaataatatatggatcctttatttccatatatggaaaggtggggaaagtccagataggaggtatctgatgtctttttttttcttgcctatgccttcaatgagttaagtctgacaaggctgccttcagtgtgtctgcacagcacatatattttgtgcttagatatataattccttctagacctggagaactttgcatgtttggggtacactttggatgtttccccctatttgcacatgatttcaggtgagatagtagtttttcttgaaatcggctcatagcctgaaaagagtacagattcaccagaacataagagaatgggatttttctgccagaaggtgagctatggtatgtacagtttagttagtgatgatttgttgtcttctggcagctatacttaataccaaaaaattttaagagagatacacacaatagttgaacctgttatgggcaaagtgataattcagtggtaacttgccagttcaaaattaggaagtcattggcaagtgcatcctgagccctgcattctgtggcttgcgtgaggtatgagtacacatgaggatctgtggtttgagtccattagacctcgaaagggcggttcatgatatgtggttccaaaagcttgtttggaaacaagcttttgaactttttcgtgtggaatttacaaaggtaacttttgctctgcaactcactgaaatctctttccattattttttaaatgtttgtaaattgtggcttggtttactcagttgtacagttgacctttgaacaacatggtatgaaccgcatgggtccacttatacgtggatttttttcaataaaagttataccaactatgcctc

SEQ ID NO: 213908 - DNA, 360 bp, Homo sapiens
caaaatcttaggtccacacaaaagcctatatatgaatgcaactatatttgtaatagcttaaaattggggggaaaagctgggtgcagtggctcacacctgtaatcattttgggaggccaaggcaggcagatgacgagttcaggagttcaagaccagcctggccaacatggtgaaaccctgtctctactaaaaaaatacaaaaattagccgggcctggtggcatgcacctgtaatcccagctactcaggaggctgaggcaggagaattgcttgaaccccggaggcggaggttgcagtgagccgagatcgtgccactgtgctccagcctgggtgacagagcgagactgcgtctcaaaaaaaaa

SEQ ID NO: 213909 - DNA, 539 bp, Homo sapiens
tttgaagaaagtcagtttatgtcctattgagtttctcctagactggattttgccctttgcatcctgtgatgttgctggaaatagtcctccttctcttctttaaaggagcagctccatctagaagcttggtcagattctggttcaatttttatggcaagaaaactttctgggtagttggtgcgtatgtctgtgtgcataggctgcaaacatctgcttgcttctgtgctgttctgtggaccactggattcgggtgttgtgtattcagtagtcgttcttgtttgagtggtctctgtggctgtgggcctcgtgggttgtcctggctgtggggtggttgggcctgtggtgcttgctggggttggacgtgggcctgtcgtctgggtggccgttgttcctggcagttcctgattggtcgattttggcagcgtggggcttgtccctgatgtggctggggttggtagtgtcattgtggttcgtgttgtggactgagctgtgacgtcgtggctgggctgcggtgcgatccgtggccctagcgacagcaa

SEQ ID NO: 213910 - DNA, 303 bp, Homo sapiens
tttgaagaaagtcagtttatgtcctattgagtttctcctagactggattttgccctttgcatcctgtgatgttgctggaaatagtcctccttctcttctttaaaggagcagctccatctagaagcttggtcagattctggttcaatttttatggcaagaaaactttctgggtagttggtgcgtatgtctgtgtgcataggctgcaaacatctgcttgcttctgtgctgttctgtggaccactggattcgggtgttgttatgaagttctttgtcaggttttctcctgatggttttagcggatag

SEQ ID NO: 213911 - DNA, 417 bp, Homo sapiens
gggattacaggtgtgagccatcgcacacagccaaacctttttctttatgtgcatttgcttctaaaatgatctgggtttcgacttcatttgtaacattttgttttttttttttcttttagacagccttgctctgttgcccaggctgtagtgcagtggcgcagtcatggctcactgaagcctcaacctcctgggctcaggtgattctcccacctcagccaccagaatagctggactacaggtgcacaccaccagacttggctaattttttttttttttttttgagacagagtctccctgtgtcacccgggctagagtgcagtggtacaatctcagctcacagcaacctctgcctcccaggttcaagtgattctcatacctcagcctcccaagtagctgggattacaagtcacgccacac

SEQ ID NO: 213912 - DNA, 317 bp, Homo sapiens
gaagacagaaggatggaatgatctctgaagtctcttccagctttttcaagattccaggttgcatattctccaagattggaaaggttctggctcattaaatttgacaaatataaggcatagtcttggctttactcaactaattggtacttttttccctcaaactcttgctcctgagttgattaaacataattgaaactcatacaataaaaaatgtgggtgtggtaatgggaatgtattgaagctaaattatctagactttctgattgcactaattaaaaagcatgaaaggtttcttcaactggaagatcagttccttg

SEQ ID NO: 213913 - DNA, 303 bp, Homo sapiens
aaaaaaaaaaagaaaagaaaaaaagaaaaaaaaaaaactcaacccagaagaacagacctaatgcttgggccatgccgcctgcaattactactaggtccactctgtttgctgtcacagccccagtgcctatttgagcaagtgactccaggttggcactcgaaaaacccctcggttaatttttttgtatttccttcaaaaatatctaccatcgcgttatattaaaagtacattttgttctccttaaaattagtctgaacttcctgtaaaatattgcaggaaataatgcatggtaccgtcttctta

SEQ ID NO: 213914 - DNA, 117 bp, Homo sapiens
agaacggcggcaagaggcagcagggaagacaagaggccaccaacctcagggagaggcttatagggggcaggctgcagcatgaccttgagcaagataccctcatccgcttatccaatg

SEQ ID NO: 213915 - DNA, 252 bp, Homo sapiens
atcatgatcgttgggcattgatacgactttttttttttttttttttttgtgggtaatctgtcttttctctctgcaagcttaagatttttctctgtatcctggaccttttgaagtcttactgcaacatctctaagtttggacttttcttttttggtacttcttgtgactgtttctagtgctcatgtcttttattaattctggaaaacttagccatgatctgttcaaatattgtatcccttctgtcgtcttctc

SEQ ID NO: 213916 - DNA, 340 bp, Homo sapiens
aaaagctttgtgcacaaatacttttaacaacctcatttataacagaaaatgaataaatggaatatcaggagttaatattatgtttataaaaactatgggccaggtgcagtgagtggctcatgcctgtaatcccagcactttggccaaggtgggtgtatcacttgaggtcaggagttccagaccagctggccagcaaggtgaaaccccatctcttactaaaaatacaaaattagccgggtgtggtggcgggtgcctgtaatcccagctactcgggaggctgaggttgcagtgagccaagattgcgccattgcactccagcctggatgacagagtgagactc

SEQ ID NO: 213917 - DNA, 187 bp, Homo sapiens
ggagacaagaaattaaagtggagaaagggaagaattaaaagtcaaaaacagtgtgagggaggaaagcaatggatataacacctcggatctttatccttgagaggccttaaaaaatctacttaataataatcagatgctattctataagaactttgagactagacatgtgatgacttttaggaacctg

SEQ ID NO: 213918 - DNA, 400 bp, Homo sapiens
acagactttgctttgcagcatttttgtggtttcttctttgtgacaggcaagagtgtgggaaaaccggaaacagctcagcatcaaaaatgcacagaaggggggaaaaagcggagatttcttcagaatttaagtaatataatccaggtatcaaaaggcatgctgtgaggcgttgttccaggaaatagtttccaatttgcctctaaaactctaggacaagtctctgaagctaagttaatactaataaagacttgaacattctctcacttacatgtgaaatgtacagcgttttggggaccccagtgttttcagatattctcctgacttttaggaaaaagaatagcatggcttttcatctgaacagtgaaaagttccccctatgaagtatcctgataaagttaaa

SEQ ID NO: 213919 - DNA, 443 bp, Homo sapiens
agagacacagatgaggtccgtgtgaaggcagaggtagagaatggagttatgatgccccaagccaaggagtgccagaggtagacagccactaccaggagctcggggagaggcatgggacggatcctcccttagagcctccagatggaacctgcccagctgaaaccttggttttggatttctggccttgagaaccacaagaaaataaatttctgctgctttaagctgcaaagttagtggtaacctgctactgcagccctaggaaccgaatatacctaccctacccctagtggtctcatgtaaaggtgaagacacagaggcacagagaggttaaataattcaccaaaggtcacatgccaataagtggcagaactgggattcaaaccctggcaatctggctccagagtctacgcttctaaccactctactcttccagctcttgaaag

SEQ ID NO: 213920 - DNA, 648 bp, Homo sapiens
tcccctaaaacctatcctctcgctgcccccccaaatttctcccatcagtaattgtcacctcctaaatgtcagcatctgaggactttgtttccctccccgcttccattctaatgcactagaaagttctctacatcttcaccacttctgtacttcactttagtccagggacttcgctcacctggtctccgtgactgcactgctgcccacctatgaaccatcctgcatgaaacagcagaagggatgctctgaatagaaacctgaccatgccactctcatgcttgaaactggccgatgttttcccatgagagctagaataaacctaacctcctccctgcccctgaccacctccccgcacatccatgccacactctccctcacagccgctccttccacaagccccagggtctttgcacaggctctgccctcagcacggaagccctttccaccatgtgcacagtgaactccttcgggatttttaggactctttgtaaatgtcagctcctcagggctggcccctaacatttgcgtcctttcttgcttcttatcacaatttgcaattgttccacttgtctgtttacttgctaattatacagaaattccttgctggcaagggccccctctggtcttcttattccataacccaacaac

SEQ ID NO: 213921 - DNA, 493 bp, Homo sapiens
aagcaccaggaattttggagaagttcccagcagctcaggagagtggctggtgccttgtcccaggggagagggaaataagcacaggcctatttctttctcaagacggaaaaaccgagccccagaaaatggcgataagatggggatgcaggaaaaagctagctaatgaacagttcagcagtgggcaccgtgtgggaacctctcctaagccgccctccctctgatggatgcatgctcaagtgatttcgttggcccttaaaggaaagtgttattccatcctgtaatcctagcactttaaaaggaggccgaggtgggaggatcacctgaggtcaggctgaactcacccgacctcaggtgatctgcctgccttggcttctcaaagtgctgggattacaggcatgagccaccgcgcccggccggtttttaagatcttattgctgaaaaacttaaaataaaaaataaattcagtatcagcagggcagcaggaattgccatt

SEQ ID NO: 213922 - DNA, 539 bp, Homo sapiens
aagcaccaggaattttggagaagttcccagcagctcaggagagtggctggtgccttgtcccaggggagagggaaataagcacaggcctatttctttctcaagacggaaaaaccgagccccagaaaatggcgataagatggggatgcaggaaaaagctagctaatgaacagttcagcagtgggcaccgtgtgggaacctctcctaagccgccctccctctgatggatgcatgctcaagtgatttcgttggcccttaaaggaaagtgttattccatcctgtaatcctagcactttaaaaggaggccgaggtgggaggatcacctgaggtcaggagttcacgaccagcctggccaacatggtgaaaccccgtctctactaaaaaatacaaaaattggccgggtgtggtggcatatgcctatagtcccagctacttgggaggctgaggcaggagaatcacttgaacccgggaggtggaggttgcagtgaggtgagatcgtgccattgcactccagcctggccacagagcgagactccatctca

SEQ ID NO: 213923 - DNA, 1201 bp, Homo sapiens
cccggagcgccagcgatgccctctgcccgcggggacccgagcctcgcgcgccctccgccctccctaccctggcccctgtacccatcacacctggggcactgccgtccgccgagcttgggcgcgcggcggcgagaaggcactggaggaggagaagcagccggggcgtaggcgccctcgcccccagcaggccggggagggcgcgcatggcgccagagggtccgcctcagttctcgtggagactgctccctcagctcgccgccgcgggtgtccggaatccctccgcacactcgcaggtggcccggcacccgcagccagtgccgcgggcaggacgctgaagaaaaggcggaatgggaggggcccggccgccttgccctactccccgagacgctcttaccgcgcccggccttccatcagttatgcagccctcagcccgctgctggcgttcccggatgtgcggtgctactcccggctgcagcctctccggcctccgccctctaggctctagcaggtcgggagagagcttgggcaggtgatgtgtagcccatcgcgtggggagaggttgaaactatccctgcagactggcctttgcacttcatctgaggcagatttcactaattttcgttgatgggacagatgagagacactttcctcctcccgaccccggacatctttgggctttcttatgagggaggcttatttttgcgcaggtgtacggttttatccagctgccagacaacttgtactgatctttctttgctttgcctactaatcacacacaccctctcttctagcctgtgaagacttaactgattttctacggatgaaggtttcagtgtcccaaggccccataccgtatctgattttactttatttttttttgttaagcctaacagcttctgaggagccacgtagagctcaagaagcaaaagctactgagagtagatgctatgtaaactgcacaagacgttgacctttgttaaatccgaacactgtttaagataatgctatctcttacccacgaggctgtagcttggaatattcagtgctctgaaccaaattaaataaattagtgctttatccgggaggggaggagaaatctatgttgtaacattgaaacacattgatttgatttctctccaggatgttataacgcattaaaagatattttaaatatttttcacgagctttgtttcctctccct

SEQ ID NO: 213924 - DNA, 365 bp, Homo sapiens
tggagcctggggtttgaggtttatatgggtacagaatagggggttgtgctgtgccaaaaggcaacatttgggctcaaaaacaggaatacctattcccatttagggccacaggtttctaggcttggggatgggggctttgctggggaactgccctcttctacctagtatttccctgtccatatcacctccactccagccacactggccttgctgcttctctaaaaggtcacgttcactgccatcttgggtcctttgcacttgctttcttgtttggaaagttcttcttttagatcttcactcagatgtcttttaagacattacccctcagacaggtcttcccttatgatgtgggttcacatagaacc

SEQ ID NO: 213925 - DNA, 439 bp, Homo sapiens
agcatattatcaagttttagatctttgctgagtgaaacctattgtcttattattgtatatttatcaatctatcactgaagttacactttttttatgtttaaaagtcattgacatttattcttggctgggtgtgtggtggctcatgcctgtaatcccagcagtttggaaggccgaggcagacagatcgcttgagcccaggagttgcagacagatcgcttgagcccaggagttccagacaagcctgggcaacatggggaaaccccatccctacaaaaaatgcaatattagctgggtgtggttgtgcacacctgtagtcccaactttacttgggagactgaggtgggagaattgcttgagcccaggagacagagattgcagtgagcaagatcgtgccattgcactatagcctgggcaacagacaaaatgagaccttgcctca

SEQ ID NO: 213926 - DNA, 751 bp, Homo sapiens
cgcttccgccctgcgcgctaacccaagacgggagctcgagagcttgatcctgcgcgagtttacagactgccctcttccctttttgcatcgaagaccacgactcccaagaggtaatgcgtcggcccgggactacatctcccggcatgcatcgccggcgggtccgcgagttctcaccatcgcagctggactattagcgggggccctagcgctcttgtggtttgtttcggcagtatctgaatgtcagcttttggcacttctggtcgctctgagcctcctactcgcattcctggagcaaggtgctttccaggcctcatggaggtggaggagctgaggaagctcgagaagatggatagaagtgggaaatggagctagcgtacgggagagggaaatggctggaatattcgtcaatctgtggtgctttactggagatttgcaggagttcagaggaagggggcattgaatttcataacctaaaccgtatcgtggtttaccagaaagttttgacccgtgattccggttttaaaggctgagtagggccgggcgcggtggttcacgccagtaatcccagcagtttaggaggccaaggcagggcggatcacctgaggtcaggggttggagataaacctggccaacgtggtgaaacctcgtctttagttaaaaatacaaaattagccaggttttgtggcacatgcctgtaatcctagtactcgaaaggtgaggatgagatcggttgactcaggagggggtggca

SEQ ID NO: 213927 - DNA, 447 bp, Homo sapiens
gtaaggactaattcaaactttatgccgggggcggtggctcacgcgtgtagtcccagctgctcgggaggccgaggcgagagtatcgtctgagcctaggagttcgaggctaaccacggcaacgcccctactcctaccccagtccctcgcgggtggggcgagggatttcagggggcggtgggggaagacttaaccgagttgccgtcttctgtttaccagatcgaagaccacgactcccaagaggtaatgcgtcggcccgggactacatctcccggcatgcatcgccggcgggtccgcgagttctcaccatcgcagctggactattagcgggggccctagcgctcttgtggtttgtttcggcagtatctgaatgtcagcttttggcacttctggtcgctctgagcctcctactcgcattcctggagcaaggtgctttccaggcctcatgga

SEQ ID NO: 213928 - DNA, 602 bp, Homo sapiens
aaaaaaaaaaaaaaagaaagaaatcttcctttgctatttctacatagaaagataaaaatcatgcaatttcctatgatttttcatctctcattggaattagatatctaaatggccagtttgctgatctgttgataattttacatactagaagtcaggtttcaagatatagtttttcgagtcagattaggttagatgtttttaagatgatgtctttgtcaacttttccaaaatttggatacataaaatgcaaaaggaatatgagagactattcttaaattataaaagaatgttcggttacctgcagcagtttctatgagattgtttttgtcccagagcagccaggagagaagacagcaattgtgtggtaaaataagacataattggaattgagagtccagattgctaaattagactttttttttagctttgtcactaatttgtaatttgacgtctttgatgtcattctatcttccttggtttcattccttgttctctaaataaaatattaggtttacatagaacacgaagcatccttagaaatttttatatgttcaactaccacttttaatttaaataaaatgttagctgttcaaaaagcaaaa

SEQ ID NO: 213929 - DNA, 450 bp, Homo sapiens
tccattattatttgtggtggctccatcctctggaaagttcttccttatttcttattccctggctgtcacctctgaagtggctgttaagaagtgtgctcttcttgcgatctttggcttcataactcattctgcaagagtaaagacggaaactaatgggtgttttaggtttaaggtctgtcatttgcggactctggggctgtgggagaaaaaataaatcgtttggttcatgcacacaatgtgacagcttggcataagtaaaagacatgaacaaaaggattaatgaagaagtgaaagaaagaaggtgtatacattaggcacaacatcacctaaaaaaaaaaaaaaactggaatgcattaaacttgttcattcaataagtgttggctgagtgcctactaagtgtcaagcactgaaccagatgtggaggattcagtggcaacacacggaaaagtt

SEQ ID NO: 213930 - DNA, 313 bp, Homo sapiens
gaaagcggggagaagactagtttaagaaacagtaaaagaaaaaacagcaggccaggtgtggtgggtatgcattattttatcaagacaagatagggaagcattttgtttattatgcaatgactctacggtcatcccttggtatctgtggatcaaccgtggataccaaaatctatgcacactcaagtcccacagtggcccagaggatacaaaaatttcactgttctgtatctgggggtttcctcaaataacgtatttttgatccacgtttggttgtatatgtataaactgctgattgtatttattgaaaaaaaat

SEQ ID NO: 213931 - DNA, 182 bp, Homo sapiens
gtacaacaccccaagggtactggcgagctttaaccatcttgtttccgacttttatctcatccatacttcccacaacagcaaacggcaactgtccattcattgcagcgttgaccttagcaatagtgtcatcatccgttggaaactggtatatctggacgccattgctgaccaattcactcatg

SEQ ID NO: 213932 - DNA, 389 bp, Homo sapiens
gcacagttagctgaaccttgtcctcttcatttgaattctgctctttatctgttggatatttctcaacgccagactttgctggagttttcatatcttccccatctgtaaaggtaagtaatggcaactcatcaaagtcttcttggttctcctcatcttcctttccaactgcataatactcagtatccaattcctcatcaaaatcatcttctaatgaagtaacgagtctggttgtctcatcatcagatacaagtgcatcagctgttgagccaaatttggttttcaagtctagagtcatttcttttttcaaaagtttataggcatcaatcttatcctgttcatttgagacctgagaactattgctggttttgttgttttcactttctggcact

SEQ ID NO: 213933 - DNA, 503 bp, Homo sapiens
actccctgctgtccctcttcctttgcatacccctcagcacacacacaaagcacatgcctgccacacagacacagctctacacagagaggggcattgtactttgaaacagtggaagccagagctggccacagaggctctttctccaacaaatgcagatgctagagatgcagccacttggccgcctgcctaggaagctccccatcctctccataccctgcccacttgggtcctccaggaagcaatagcctgaaaaaaagacaatagccacaggcaccccacatccccctccccagcccagaaaatcccattcgaagcagacaaggctttttaacaaacaattagcttaaatttttcattagctgctgcttcctctgcagttcctgcctccacccctttcaaatctccaagctacgtatttagctggggaggcccagccaaaggagagtctagcggatgtatgttcgggttgaggctcccataaacccacctctgaagtggaccta

SEQ ID NO: 213934 - DNA, 158 bp, Homo sapiens
tggtcccagctgcttgaagtgggaggagagcttcagctcaggatttccaggctatagggagctgtggtcccaccattgcaccccagcctgggtgacagagtgagaccccatctcaaaaagaaaagaaaagaggctaggcgcagtggctcaggcctgta

SEQ ID NO: 213935 - DNA, 480 bp, Homo sapiens
tatactaaaatgttgaatatcttatgtaacttattgatttctgtactaaaagtgaaaaacagaatggttgtatgggcactcgaagtacggtttctactgaatgtgcattgcattcccatcaccgaaaagtcatttaagtagtaccattgtaagttgggagctgtttgtaatcatttctgttgagacataagtaatacaacttagagtcattcaacttttacatgattaaacaacatcttaaataaatctagaagaaaatagctgtttttaatatattgaaaatactcctgtctatggatgttgtatatataatcctttttagaatctgtcctatgattccagattaaaggagactgaagagactgggtgtagtggctaacacctatagttcaagcactttgggaggccaaggtgggaagactgcatgaggctgggattttggaaccaccctgggcaacataatgagaccctgtttctaca

SEQ ID NO: 213936 - DNA, 466 bp, Homo sapiens
ctgggcttcttggatttaggggtttatagtttttgtcaaatttgtaaaaattttgaacagacttctttgaatatccttgtcttcccctttttctctgggactccaattacacatatcttagaccttgtgaaactacaccatggcacactgatgggataatgcacatcaatgttcactttattttccgtatttttttgttttattttaaatgttttctactgcttttttttcaagttcactaatcttgtcctctgcagcctctaattagctattaatggcatctcatgtattttacatctcaggtattttttatctctagaagtctgatttggatctttgtcatatcttttacatgtccatttaacatgctcatgttttctctatcttcttaaatatacagaatgtatttataatagcttttttaatttccacatgtactaattatattatctgtgttatttaatta

SEQ ID NO: 213937 - DNA, 1005 bp, Homo sapiens
aaaccctgccaccttgctccccgtatcagagagcccagttaaacataactgtgtagaagtactggactcagtttattctagtaggcccaaccactgagaccacgcttaaacatcagtagactaggagctgtacgtggataggagaagcttcgccaacccctgcaaagtgactctgaagaagatgacaagccctgctccagtcacacccggaagctgacttgtacacacatggccgaagcatgaggaaactcattgcgggactcattttcctcaaaatttggacttgtacaataaggacttcaactgaccttcctcagactgaaaactgttcccagtatatacatcaggtcactgaggtaggacaaaagattgctacagtcatattattttatagttattatgaatgcctaagaactccaaaaggaacctgtttgtataataacactcagtataaagtaggtaatccaggcagtgaccagcccaatgtgtgctatgacccctctgaacctcccaagatcacagtctttgaagtaagactaaggactggtccttttctaggtgacacaagtaaagtaatagctagaacagaagaaaaaggggtccccaaaaatgtaatcttaaaatttgatgcctgtgctgctattaatagtaaacagcatgggataagatgcagttctctagattggaaaaaaagttacacagcagaaaataagtacatctgtcaaaaatcatatttatgcgagatgtgtcaatactggtcttgtgtcatttgagctacttaaaaagaaaataaaaaaagatcctgtttggctccaaaaatgaaaagtcagcccctcctgcacaagtgggagctgcatccttttaaaattgataatcacaaacccctcagacccaagtaaaataaaaaaaaatgtaacattaggcattgatggaaaagggctggatcttagtgtaagcatcctaataaaaggagaggttcaaaaacgctctccagaaccagtattt

SEQ ID NO: 213938 - DNA, 414 bp, Homo sapiens
tctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacgggggtgggggtgtggagaaggggttgggggagagaaagcaagcaaaagaccaggctcacttttagagcctgggaaccctgtctgcaaaaatgacagctagagctttctggctcctctgtttgatcgtcggatcatcccccgaagcaccggtggcggagagaaaaacctcgccgccgcacagcagaaagccggactcccgcggctgcccgagcgcggaggagacaccggggcaccgcgcgcagccactccttgaggccccgcagcggccgc

SEQ ID NO: 213939 - DNA, 510 bp, Homo sapiens
ctcagataatctcatgaattgtctcatgtttctcataccagtgagcctcaaatctgccattgccctatagctgctatgctcatatacatgctgatcacctcccactttgactattatactttcctaccaactggtctcctgttctcctgcccctaccttctccaaacaatccagcccaagaatcttctgaaagccttgttttcattttatcattttttgtaattatcaaaaaagaaattcaaaggctctccattaccttccagataaagtttctactgattagctgaatttcagggatctgtttccagatctcactgtgttaccagactctttccataatatcataaacctttataagggatggatggcaaggatgtggagaaaagggaacccttgtacattgatggatggccagaatgtaaattggtacagccattgcagaaaggagtatggaagttccccccacccaaagaaaaagaataaaaatggaactaccatatgatccagcaa

SEQ ID NO: 213940 - DNA, 332 bp, Homo sapiens
ctgccagtgggctgaggaggaaggcataggaaatatccaaggtcaaccccaggtgtttattccttactagaagttggcctaatagacatcagggcttggcaggagagagtgtaggttaatgaaagggggttgacttacagcagagtcaggacaggaaagtaaacagcagagatggggggttttctccaagtaaaaagactgttctgcagactagagcaacacccttagttcatgtgttcacatcttcagatagaggtgactgctgtgagctgatttagcaaatacgatcatcccttcgctcagaattcacccctctatccagcgttctcgtg

SEQ ID NO: 213941 - DNA, 336 bp, Homo sapiens
gggacatggtttcctacctactcatgtgccattaaagatgcagtattaaccaattggcttttataaagtgtcaatatttgtgtttatttcgaaaaccttaaggcagctttgcaaataagtactaaagttgtactagcccataaaaatcagctctactcaactggcatagatggctaaatgtttggtgtgctcaccaggtcatttgctcataactaatagttctttgtaaagggctttcttttcttccacattactgaaaattattgcagaatgctgttatgcccagattcagacttgttgtgtaggcagcagtgtggtgcagagttgtccatctat

SEQ ID NO: 213942 - DNA, 565 bp, Homo sapiens
taaagctagcactgttttgatccccatcactgaagtttgcaacgtttaccttatttgtttaatatagtacattttaacagaacatgttagaaaagatagattactgccacggacgaaaactgggtggttttcttttgtttgttaaaaaccttattaccttgacagcttgagattctggagacatcacctttgtatgtacttattattattattttaaataatcaacagttgttaaaataaacagttaaacagttattaaacaatcaaaatgctttaatcagaacttgtatgaggagtggatttgatgcacaatgtaagaggaagctttggagcctgatgtgaaggactgaaggggatttttttgagtctttgagaggatgtctctgcccatgcccagcctgaagaagggaacttgtaagaatcaccattaattaatatgcattcctaccctacttacatatggctctgtcaataccagtggttgagtctgattgttttaaccaactgttttgagcttgtcttagagctcaccccaattaaaatttgtactcttcaaaagcattga

SEQ ID NO: 213943 - DNA, 176 bp, Homo sapiens
tgtcccatgtggaagggttctaaaaaggcatgatttttaatttacacttcagaaagaacctgtgggggctgtccattcttccgcaatccctctttcacatttctaagcaattctgtaaagtgttgcttttttgtagaaagtcaccaggctgcttgttcctttttgccaatagtcct

SEQ ID NO: 213944 - DNA, 288 bp, Homo sapiens
  misc_feature (10)..(11): n is a, c, g, or t
ttttggatcnncccccccaacatctcatttccttgtcttccaattgctcatcccttgctaagtcctggaggctgtgccttcccaacagctctagcacacagctctcacatgcacggtttaattttcattgcagctaacattactattgcccaagagtgaattcacacccatcactgacctccctcgaatacacatctctgctggtgaaactttccagaaagcttccaaaaacactgctttcaccagcagaaatgagatgttggaaggccttccaacatctcattacta

SEQ ID NO: 213945 - DNA, 482 bp, Homo sapiens
cgtgttgcttccttcaaagaataggatctcattctttttctgtggctgcatagaattctatggtgtatatggacaacattttcttgatccaatctaccgttgatgagcatttaggttgattccatgtctttgctattgtaaacagtgctgtaatggacataatgtgtctttttggtagaataatttgtatccttttgagtatatacccaggatactctaaattctgtctgcaaatctccataaatatgcaaaatctgtaccatttgatcaagcatgatattaaactggaaaccaactagtgaaagaatttaaaatcaaagcatatcaatgaagtgctccctgcagcttcagatttaacagtctctaattaagccgtcataatacctgctaatatacgttcatctaaagcccatagaaagaagctggaatagagatgcttgtactgtgtaggaaattgtagaatcattgcagtagccaaaaaa

SEQ ID NO: 213946 - DNA, 603 bp, Homo sapiens
tacattactcacttttcccctcaaatgacaagctttctccgacaacatgggacccattgcgtctggaaaacacacacttcacccaaacacttccattaactcctgtaaattgttttgtgtaaaagtttcctgtggtttttcatgcagcattcaatttcatcttcttttgaaattgaaaaggtcagttttgtggttgtttttagcattcactagtagaaaattaaaaagatttctaaggactaccttttccagtcacacattttaccaacatttgagctactgccttgggttggccaggaaatgtctgccgccacattagcgatgtgataatgggcttcacatatcacctggacattaatagaatgaaatcacttactgctcctgaaagcagctttgttctcagcgggtgtcctgaaggcactgcatgagcacaatggaccttctatcacagaggtgaaagtcagaaataacctaaacccatctttatctcgggtgtgtgtgtgtgtgtgtgtgtgtgtgtgtgtgtgtatgtgtgtgtgtgtgtttcatctttatttaatgagtccacagatatttgaggggaaaagaccaaaattcagctag

SEQ ID NO: 213947 - DNA, 360 bp, Homo sapiens
ctggatcaatcgtgtggtatttttcagttttgcttacatattatcaaattagtctttagattctggaatatgtttagagtctggaaagttttcaccaatttgtgcttatttcatgaaaataagaaagcttcagtatcttcaaactctattcaacattggaattttccaatacaatagtttcagtgagagcattttgatattcacttctttattagtgaggttaaacttttttatactttattaaatatttatattgatgtttatgttaattgtatatacctagcccttatccactcttttgttaatgttttctattttaatattttttcaatttctaacattaaacttttttttaatctg

SEQ ID NO: 213948 - DNA, 281 bp, Homo sapiens
gtatccagcagagaaggactctaacttggaaaacagagaggaaattagagatggagacaagcctgaaattagtattatttaaagagtgccgttggcacctacagcatgaataaaagtaattagtttaacattgtgtctcgtcctgacgttttctttttcttttttgatgcaatcaagcccctttccttcactgtcctcaatcatcgcaggcttcattagagccacaaagcacaaactgctggggacgtcttctctgctggatacttgagatccttattcag

SEQ ID NO: 213949 - DNA, 594 bp, Homo sapiens
ctgcatccccagctaggtaccagctgtgctagacacaggaaatcccactacacttatctcctgactccaggtagcacagtgcagagaaacttgaggggaggaaagggaagagcgtgatggactttgcatgctaacccagagaactctccttgaacttacccatgtccttcaggcatgaagacctcagagtatgctatagagtctcagcaaacagggaattaggctaccctatagtgctgacatgactgtatgaccacaggcttaggggtcaacagtcagttccctttgcattcctagaaggccctctaaacaaggaagggtacaaacaaggccacactgtgaagactgcaataaataattcttccatacacagacatcaacatacatgtacaagcatcaagaacattcagggaaatataaatttactaaaaggactgaatagggcacccatgaccaacccgggaaaaatgacgtgtgatttctcagatggaattcaaaatagttgttttgagaaaacttagtaaattttgcacacacacacaaacacacacacacacagaaaagcaactcagaaatttatcagtgaaatttaat

SEQ ID NO: 213950 - DNA, 204 bp, Homo sapiens
ctgtctgcgtcgctaggttcatctcaaattcctgggctgtaattttaagaggccgatgaggctctgcactggaaggtctgacaggaatggaagtcagagattcctgagcccctggcaagcatatgtcaggttgcatgtgtgcggtgtgtgggtccacccagagaaaggtgcctttttcacagaagaatcctctgatcttcaaag

SEQ ID NO: 213951 - DNA, 461 bp, Homo sapiens
tttctccccaaaccatctttctctcttagcttttcttgtttttaaaagtagtactattgttttccttggcttgaaacttggcattaacttaattttttcagcttccatgtatctgatagccattcagtcatcaggcctacttgacttactctaacaaattttgatcctcccaaattgtattaatttttcatgtttaagcttatgtagtcttccttgcgtgacctggactcttcctatgaaaggcaatctcctttttttctaggttcccatattccattgtttatactatgttttacatcctgctttgtgatgctagttacctcttaatttgtgtgtgtcatcaacaaaactattagttcttggaagttagagttgtcaaaccgttatcacccaacccccagtgcctttatatgattatgtaccttaatgtgtatggaacaaataatttaaattcaaaatga

SEQ ID NO: 213952 - DNA, 360 bp, Homo sapiens
aataattctatagccagctaaactatccttcaaaaaatgaagctgaaataaagacattcccaaataaacactgaattggttgctagcaagcctgtcctacaagaaattctagccgggcgcggtggctcacgcctgtaatcccagcactttgagatatcagggaacctgctcccgatagtcatgtaggttcttttctattttccctaagcattggctgggttgagaaataaagggacagagtacaaaagagagaaattttaaagctgggcatccgggggagacatcacatgttcgtaggttctgtgatgccccccaaactgtaaaaccagcaagtttttattagggattttcaaaaggaga

SEQ ID NO: 213953 - DNA, 537 bp, Homo sapiens
atgggattaatcaataaatgatgtagaaaaaaattggctccccttttggctcccctacctcacactatataccaacctattctagatgtaataaagaccgaaaaatatttaaataccatcaaaatagtcaagagaatattttcataaccttaggggtgaaaaaggcttttctgaaccagacccacagttcagaagccttatgcaagagactggcagttgggactacacacaaatgtcaaatttctgtaaggtgacactctataagcaaagtgaaatgacaaagtaggaaaatattttcaaaatgtataagagacaagaagttaatgtgtctgtgtggtggtttaaaaatatgtccatgaattctgtgatactcttccttttaagaggtgagccttattcccctccacttgagtgtgggctggacttagtgactggcgtctaaagaatagcataaagtggaagtgatggtgtgtgactttggagactcagttaaaggcagagtggctttcatcttggtctctttctctcttggatcac

SEQ ID NO: 213954 - DNA, 413 bp, Homo sapiens
ctgatgaggagtggattcgaattaggaatcataggccaaagaaaagtaggagaaaaacagaatcacaattggcatggccattagggctgatgacttcattctgttcagaaaggaggaagggtactgaacacatctttggttagaggataagcacatcctgaaattttcttgagaactaaggatttgtgagttgaataactttttttttttttttgagacagagtctcactttgttgcccaggttggagtgcagtggcacaatctcagctcactgcaacctccgcctctgaggttcaagagattctcaagcttcagcctcccgagtagatgggactataggtatgcaccaccactcctggctaatttttggatctttagtagagactgggtttcaccatgttggccaggctggt

SEQ ID NO: 213955 - DNA, 406 bp, Homo sapiens
taaccccattgtttctttgaaagcagtatcttcactgtgaaatgaaacctgaaatattcaaggaaggagaattcattcttcctctatcatcaaataacaaaactatgtaaatattgttcatttcaaaaagaataaataagggagaaagggaaactacaaaatcagccaatatgtttacaggatagaatacagctttcaggttactgaaggaaattcttcttttccaaatagaaataaattgtagatgctttgtactatcaacaaattttagataagttagagttcatgaagcaggatagatgagatgggacaactgactgatatgaaaagtgacttctgagttaggtggcggtaaagcttttaaagattatataatataaacaataatctcagcattaatgtcagc

SEQ ID NO: 213956 - DNA, 394 bp, Homo sapiens
aaaatgccagggtggcgtggtaaagaaaaaacacacaaacaacaatcacatcaatggttgagcaatcttaagatttaacaaaatagaagggaaaaatcttgccagattactacaaatttttataagtcgttcctttactggctgtttggtgatattatcttttatatgctagcaaaagggaagagttaacaggagaatgaaaagcagagaaagaaactttcttttggtcaaacagaacatcctgttttgagttctaaacaaactcttagttgtggagttctcagtcctttgcctcaggcgaaacacagcctcttcttcctaaatgtttaaaaatatttagtgggagcaaacagtgcaatgaacttctcaaacatcaaaacaatctataaatgga

SEQ ID NO: 213957 - DNA, 428 bp, Homo sapiens
ttctacaatagaacctaaaaactgtttccaacccatcacgacatcaccctgaaaaatgagtgagcagtcactgaggcttcccaagtttgaaaattccacaagactgagagcaaatgttttgttgaaactgaagtcaagatgaagtcagctgactctcaaacctcaggtgaagtgactcagggcccacaccccggttctgaggcagggacacattttacttgcagcaccctgcagctttggatgaggctgcaacccgggtgaatcctggccctgctatcacgtgggcagccactgcatcctccggaggctgtggatgggagtcaccatgctgggaggtctggagtaagatctgtgccatctgccttgcccaatcctgtaccagtgcctgtgtttcaaaatctcaaaataaaagtgattattcttgcaaa

SEQ ID NO: 213958 - DNA, 473 bp, Homo sapiens
tggtaaccaccagcttgagggctctgtcaagagttgcctcctacaggaagcctgcttggcaaccgtccccctgccaaagctgccctctgccttgtgtggccaccacctcctgtgttccatgcggctcttgtcgcatccagcaccatctttatggcggcccactgcccggtcctgtctctccactcaggacagccgacaggcaggcctcatgcctcgcagacaccagccccagtgcctacgtgtctcccgcccgtgatcccctgtcccaccctattatctgcctttcaccaaagcatcctgccagccaggaaaggcaatctgaaccggagcccgtgcagctgagtggaaggggggctgccctattgcattgctctgcttgggtttcactaaaacgtgggattgggccatggtccctcatctcctggaagggacaggtcatgtttgacaaagttttctgggtctgcagcaaagtg

SEQ ID NO: 213959 - DNA, 554 bp, Homo sapiens
gtggtggtgtgctcttgtggtaccagctactggggaggatgaggtggaaggatcatttgagcctgggaggttgaggctgcagcaagctgtgattctgccactgcataccagcctgggtgacggaacaagacgctgtctccaaaatcaaaaaaatcatagacctaaatgtaaaaactatcaaacttctagaagaagcattggaaaaaaaatctttgcaacctggagttgggtgaagattctgaggtataaaatccaaagtacaatccataaaagaaaaaaataacatcttggacttcatcaaaattaaaaactgtactaagagccttgttaagggaatgaaaagacaggccacagactgggagaaaatatgtgcaaaggacccatatccagaatatgtttcactctcataactcaacaacaagaaacaatccaattaagaaagtgagcaaaagatctgaacactttaacaaagaaaatattcaaatggcaaagcacattaaagatgcttttaacatcattatccattagggaaatgtaaattaaaaattacaatg

SEQ ID NO: 213960 - DNA, 198 bp, Homo sapiens
cttacagaccgaggagccaggcaaacctggctgcccactgggctcctttacctgtttgctgtatgatcttgggcaagccccctcaccgctctgtgcccggcttttccactgcaagaaaatggcaacaattatggtacctacctcaaagggtgaaatgaagcagagtgatgtgtgtcgggtgccccagagagcacctac

SEQ ID NO: 213961 - DNA, 404 bp, Homo sapiens
cttgtatttttttaacttttattgtgcaacaatgtatcagaaatcagaaatttaacccatattgtcacaacgtataaagaaccaacaggttcctaatgatcgcatcagctgaaaaatcaaccttctcaaaattaaaaatgagcaaaaattacttaccatgcatttgccaagaatacatgttactttcaattatatattgaaaataaagttgctaaaaatataaattttgatgacttaaatgaatttgcaaaaagagggccagaaaatcttatgatcaatcaagatatcatattaaaaactattagtaattattgtatcatttaaagttattgcaacaaaactttttttgtgatttgtaaatttgttattatatattacgattatacctattacattttacaagt

SEQ ID NO: 213962 - DNA, 154 bp, Homo sapiens
gggcgacagagcaagactctgtctcaaaaaaaaaaaaaaaaaaaaaaaaggtcacttccgctaaattagaaggacaagtagtaggaaggaggtagacaaagagaatggaattagaatggtaaatttttaatgttatgtctattttaccaccaaa

SEQ ID NO: 213963 - DNA, 699 bp, Homo sapiens
gtcataccctgtacgaatataccttgtgcagcaaataacaggcatgcctaccgtgcctaaaattatatatcatggacatttctttttcctctttgcaacattaaagatctagaactctgtgcatttgattgaaaaagctttgaaaaatgtctttgataagaggctatatttgaaagaaaaattatatcatgcaacataaagcaaatatttcttaaaatctttggacacctcttgcccaaatcctgcttattgctgcttcacctggatatctctatttttgcctacattctgttgtcttctcccagaaataattgtctttctcatgtaaatcagtcgaccctttctttctaggcatcttcaagtctacatctccaccactttttctgaatagcacaaggtcacacctagtagctggctggataagcactattcctccttagaaggcagcagagacaaacaacaaagctgttctctgcctttgtcacacaccctttgctactaatgtgaagttaagaaactcgctgggatcctcttccctatggcccatgaaatcagagctccacccaggctttcattaattacttcaataaattactttctgagtgcctaagatatgctaggcactattctaaacaaacaaaaatctctgctctcaagggagcttacattttggagggaaaagcagaaaatgaacataac

SEQ ID NO: 213964 - DNA, 714 bp, Homo sapiens
tgggtcattagtttccattatcacctcgaaggtctcgtccattgtcctcctctggctttccttgtcgctagaaaacatcatctctcagtcactcccttgaaggtcattttccatgcatctccagctgcattcaggacgcttttgtctttggtgttctgaagtttcaatgtggtctatctaggtgtgggtttattttgtatttttttctgcatgaggttctcaattatataaatttatatgaatttctcaattatgtgactttcattagtttagaaatttcatagccattatctcttcaaatatttcctctgctccattccatctcttctccttctggcactctaattaggctcatgttggattttcctattctagcctttatgtctcttaaccctttttccaggttttccaaatctatgtctttccaggcagcattctgtatactgtattcatatttatcttttagctcatgaagtctcgctttggttatttataatcttctgttaaacatgcatactaagtttttaatttagttgaaattaaaattcaactaaaatttgaactaaattaaaactttccttttagaacttccatttggttcttttcaaactgcttgactattctttatagttttgtgggttttgcacacattttctttctttttcttttctttagagacagggtctcactgtgttgcacaggctggagtgcagc

SEQ ID NO: 213965 - DNA, 486 bp, Homo sapiens
cgtgattttggaatcagggctgctccaagcattggcacggtgtgtctgaggcaccaacatccccatgcccgtggccttacggtccaggacaagagtgacccacctgcttgagacccagtgagtactgctgcccatccccacccccttttcattttattctttccctttgaagctgagatgaaagcccccgagggtgtcatttggtcaccaagaccccctctccgcctcccactttcttgccccttctttgcggcccgacacttgcctggctttgcagggcagggctcttttcagcctgggcttcaggtgagaagttgacacattcccactaaagctgcctcataaaagctggaactatattgagcaaaggattccatctcctgtcctccgccagcggcagtgtgtacccggctttcattcctggccaagtactccagggaggtagcactgcaaaccatgtttctgaataaatgtttgcaccgtaaa

SEQ ID NO: 213966 - DNA, 811 bp, Homo sapiens
attttgaaggcaatgtttttctcatctctgcaacccagaattgagttcggaaaagctaacaagaaagtctatgacttgtcaataaaagcatttttaaaaaattgaaagctgcataaccaaagaaaaataagagcaaaaccccaggacacgccacaaaggtgaagacttacttctaaatgaatgaaaggacctcatttctactcaagatccttggcccctttccaaaaatattcaagtaatgggatttctacttgcaggcagacagtgcttccatcggggaatgttctctgaggcaaggcaacatggtcaactagggatggaattttgaaggcaatgcttttctcatctctgcaacccagaattgagttatctgtgctctgagactttttctttataaaccatttaatgcttcaatgatggcaaagctaattcagcttcccaacagtgttacctctggaatcccacctcagggattttgtatcctctagatcttggcagtaaatttttggaagtacttgtttctggttagaagtatttttaatgtgccctgatagatatggagacagtatctccaaaagttgaccttcggaacaataagacatcatcctcatcatcacagtagcttgttgtagtgggccaagatcatgccactgcacagcctgggtgacagagcaagacagagcaagagccttccttttaactagtctctcctcttaacatattttattgcttctaattaaacataaggcacaaaatacatacattccactacaaaacctcttatcaaataaattttacatatttaacattt

SEQ ID NO: 213967 - DNA, 567 bp, Homo sapiens
taagaaaagctgagtaagtttgggctttcatgatataactggttaacttagaaagctaaattaaccatcctacgttgtaggtgtcatgttggtgaagacctggcttgctgagccaagtttaacttgaattcagaggaaaaagaaaaactaaactaaattgactgtgttactaattatcacatagatatacacaacccgagagagtattttatgtgtgattcatgtcagtagtaagaagaataaagtagatgctggatacaacttttaaatctgttatgcgtaagaaataacgtgtgtcttaattgctgtcctcaatttgagcagttctctagcatgtgaactaatgccaggcatgtaaatgtgggttcagtagctaggcctttcgttcagatagccagacacctcattacagtgcccctctccttcacccagcgtgattgaagcccatggtaaatgtccctttggcacatacatttttgggcttctgtgaacagaaagaaagcgagtgaagcatctgtaaaatgtatatttcatatttaggtatataaaacatatatagctatgtct

SEQ ID NO: 213968 - DNA, 888 bp, Homo sapiens
gaggatgacaactgaaaacatatattcaattgattaagaaggaggctaccaatgaccttattgccacaaatctagcagagtcttgggctggaaagcctgattatgtggagtaaataaagaagaattttgttaatatgttagacgagaaaaacagatctcatgtgccttttccctttcctgatgagcctattgcaatgagtgacaaaatatggttaaggctatgttgagccaggaaaactataaacatatttggagtagggaagggaggaaagtacaaaactgaattaaatcaggaggaggaaaaatcttctggtatctttaatttaggagctgaaaagtgctgctttcaccccaaatcagccaccaatttgttgtaaatatgtttcatgtaaatataaatttactttcttggaataaattgtgaagctatagacaagatggctaaggacccactagatgcagggaaactgggtcaggtacataagcccaggaaaagaagtttattacctgtggtatacatttgaattggattgaatgggcaacaaaataatatcttaatacaagatattcataaaatgtggggaaacaaatgcaaaaatgaaaggtcagtgtaagatgtgggagcaagaatagccccttcaaaccaatgttctttccttattgtttagtatttatttggaggaaaagtgtgtggtgtgtgagggaaaggtaaagccctgccacaggggaagctatcatttctcctgcatgtggagctcagctaaagggatctcccaacactaggcttagcccaaacaaacaaacaagccctacagtgattgggctttgtcctgcacagagtgcacttagtgcacttagtggccatccatacctcctagagcaggtgcc

SEQ ID NO: 213969 - DNA, 665 bp, Homo sapiens
attacaggcatgagccactgtgcgcagcccaataccccactttcaataaattattaatagaacaactagacagaggatcaataaggaaatacaggacttgaacaacactgtagaccaactggacctaacagacatacacaaacactccacccaacagcagagtacacattcttctcaaatacacatggaacattcattctccagaatagactgtctccagagaggtcataaaacaagtctcaataaatttaagaagactgaagtcacacaaagtattttctctgaccacaacagaatgaagctaaaaatcagtaacagaaggaaactgggaaattcataaatatgtggaaatgaaacaagatgctttcaaacaaccagtgggtcaaagaataaatcacaagggaaattagaaaatatcttgagacaaatgaaaacacaacataccaaaacttatggaatgcagcgaaagcagtgctaagaaggattattcaccatgaccaaggaaacttatggctgtaaatctttatattaaaaagaaggttaaaaatgaacaacttacattatacctgaaggaattaggaaaaaaagaacaaactaaacccaaagctaacagaagaaaataaatactatagcagaggaaataaaagacaaatgacaaaaatcag

SEQ ID NO: 213970 - DNA, 359 bp, Homo sapiens
ttatatatatacatacatatatatttattttaatcttttaaaaacaattgtttttatagacaaggtcttgccatgttgcccaggctggtcttgaattctcgggttcaagcaatccacttcagtgtcccaaactattgggattacaggagtgagccaccatgcccagccaacattatattttaagattcattcatactgttgtatggtttagatcattcattttcactgctgtataatatcacaaaatgcaaatgtaccatagtttacagttgacacttctttgggtatttgggttgttttcagcttattgctactaaatggtgctgctaataaacattcttgttcacaaaaaaaaaaaa

SEQ ID NO: 213971 - DNA, 496 bp, Homo sapiens
tcttgatggcaggtatggagtacttaagtctttgcatttgtcaaagctagaaaagccataaacttgaaatctgtgcattacactgcatataaataatactttaaataattttaatgtttgtgcaacacttaccatgaaacatgttaaaagacaggctgggagaagatatttgccatctgcccatctaacaaggtattgtggagattatatacataaacataaaatgtatgctaacaacagtataaaagatggtagggataacctgttgtaaggttatcacaccatatgtgaagtggcataatttatgtagactgttagaaaattaaagatgtatattgtaaaactgaggacaaccatttaaaattatatgtaactagtaagagaatggtgaaaaatagaaattactaagaaatagaatactaatataaaaatagaattaaaaaaaaaaacctcaacctcaaagcaggcagttggggagagagagagagagagagag

SEQ ID NO: 213972 - DNA, 290 bp, Homo sapiens
atcctgtttctgcacttcatgagcagcatgaacttacccttcattcataagcgtgctctgtaccaataataaccacaatttcccctagccaggcattacagtaaatttaagtaattacctgtttcagattgtcatagtcctagtctttgggggtaagggttgggaatcactttcagaatctgatgaaagttaatgatctttcttttttttggtagagatggggttctcactatgttgccaggctggtcttgaactcctgggctcaagcaatcttcctgtttcaacctccc

SEQ ID NO: 213973 - DNA, 623 bp, Homo sapiens
ctcaacccttatagcacaatagatcatttctgcagtctatgggaatgtaatctgctggttttagtacagattagtttttcacattagctgtaagagcttatttttatttcattatccatacttgtcaataccagttatctgaactctatggtaaaaattaataaaattatccatagttgttttttataataagttattaatataaactagcaactttgttgaaatactgagtaaactttaaatgatgatgaataccatatttttcagttagtataaatcattagtaaattattgagtatacttaagtaccatatttgtgacatgaaagatattttccattttgtcaaattgggttttatatatatattatgtattagaattgaattttgaattaagttctctttgtaaaaaattagctgagaaagaaaggggagtttaagcctttgcatgttgacattgttccttccccgcgcctttaagattgtgtcttattgcagctgccttctttctttaacctgtgctactctaagactcttatgctcaaacccccatcaacttttatcttttttaattagtctgttaacactcatttatagaccaaaataaaagatattattaatagc

SEQ ID NO: 213974 - DNA, 414 bp, Homo sapiens
atccagtagtgtgttctctttatccatttgtatagttaagagttaaagtttggggataagataactaaattattttatataaagtgttcatcaaacacttcagagggcccacgggatctctggaaattcaggcttcaccgttttcatcactgtcttctccgaggttacccagggagcctaaaggagctgtggaaagcgaatgggtctcttgactctcagtccacgatgcatgtatccttgcctgtttcctgatatgctgctggatggtttgcatttctgtctcagagctgtctactgtgtacgtagagttacagaacttttaactgtttttttttaaatagggcaatgagaaaagttcaagtaatagcatctactcatttatcagggtgacctttttatttaaatggacatgtc

SEQ ID NO: 213975 - DNA, 382 bp, Homo sapiens
ggtaggggtgggagtgggggttagttctgacttccattaggtaatttggtatctgactctgggcagagtatctgacgttttggaactttaagtttcttatctataaaatagagataataaaataaaggttaccttgagaattgaacgagagaatgtatgtaaaatccctagacctcaaacattaacatgtttaatgtatacctactattgttgacagtataataggcatttattctacttttatcaaatcagtttaatttgtttttctttgttttttcagtttgttttagtcagtagatcttaaagttcttattttatgccagggctttactaggtaatttctctgagcatgtctttgtgttgaaataagaaagtgttggac

SEQ ID NO: 213976 - DNA, 476 bp, Homo sapiens
ttacattttggcatgattttgcagcggctggtactggttgttcctttccatgtttagcgcttccttcgggagctcttgtagggcaggcctgctggtgacaaaatctctcagcatttgcttgtctgtaaagtattttatttctccttcacttatgaagcttagtttgactggatatgaaattcggggttgaaaattcttttctttaagaatgttgaatattgaatgcctacttattctttagagctcagcaaagtggtcactgctctaaggatgcctttcctaatctctctgactaggtcaaaaacacctaatataatcttttgttacatcacctatctctttgtagtatttataaaatttggtaattatttatttttatttgtttttatgttcctctgtgaaacagtatttgtttgtatcccagtggctagcacaaagcctggaacaataggataatcatatttcttgaaggaccc

SEQ ID NO: 213977 - DNA, 174 bp, Homo sapiens
tgtgggtccaggagacaggctggcagccacctgtctgtgccttgaggactgtaagggtcatcaggacacgtgctgtgcacagcaggccactgttctccacacacccagtgctgttctttcttggaccatggcagctgtgagtcagcgcaccgtgtagtttgtgcatccttgtga

SEQ ID NO: 213978 - DNA, 660 bp, Homo sapiens
gacagaagggacttgccttgcctcaggttagactttggacttggacatttaggttaatgctggaatgagttaagactttgggagactgctggaaagacatgactgcattttgaaatgtgagaagaacatgagatttgggagaggcaatgtggtttcgctctgtgtccccactcaaatctcatcttgaattgtaatccacatgtgtcaggaaaggggcttggtgctaggtgattaaatcatgggggtggactttccccttactgttcttgtgataatgagtgagttgtcatgagatatggttatttgaaagtgtgtggcacagctcctttctctaactttctcttgctctctcatggtaaaatatgcttctttccctttcatcttctaccatgattgtaagttacctgaggcttcccagtcatgcttcctgttaaacctgtgagttatttgttatttttttcccttcaaactataggtttagttcttgttttttgtagttccttgaaatgtgatgttaggtttttaattactgatctttctacttttttgacgtaggtatttaatgctaaaaacgtcccttttagcactgcttttgctgtatcccacaggtgttggtatattgtgttgtcaatttaactcacagagaaaaattttaaaatt

SEQ ID NO: 213979 - DNA, 353 bp, Homo sapiens
tagttggggggtcaaagagtgaaaagaggctgcttgggtgggataggattgggctcgctgagaggacaggggttgggggtttgggaaagagtgtggactctgtagactgaggggagagttagacgtttcccctgtgtaggctcgtcttgttgatatgagaaggaagaaagagggctggcgcttcccttttcttcacactctgtgtgggggtcctgaaggaagcaggtggcctgtgttacttctgaatgttgtatcaggtgtttttgtttgtttcctatccttgcttgacaaatgagctggagtgtccaccgtaagcagtaaactagtccgtcctgcggttttctctgtggtta

SEQ ID NO: 213980 - DNA, 407 bp, Homo sapiens
ttaagtgtgcaatagcattgtgtctttaaaaaatactttttgctaaaaaaatgctagcaattagcagtcacctaagccttcagcaagtcttgatctttttgctggtgaaaggtcttgcctcgatgatgatggctgctgactgatcagggaggttgttgctgaaggctggggtagctgtggcaatttctcaaaacgacaagaacgaagtttgccgcatctgttgactcttcctttcacaatatttttctgtagcatgtgatgctgtttgacagcattttactcacagtagaacttctttcagaaattggtatcagtcctctcaaaccctgctgatactttatcaactaagtttatgtaatattctaaatggtttttgtcatttcatcagtgttcacagtatcttcacc

SEQ ID NO: 213981 - DNA, 243 bp, Homo sapiens
agtgggtcctggggaaggagtgacctaagtgtgaaccaggagtgacgcccaccaccaaagacctttcatagaacagtgaagtgttaagagcaagcattccaggaagaagactgcctgggttcaaatgctagctcggcatttacaagctatgtgacccagggcaagccacttaacttatctgggcatcagtatcctcaaatgaaaaaggggagcaataactagtttgtacatttcagggactga

SEQ ID NO: 213982 - DNA, 487 bp, Homo sapiens
tgttatctttttgaagcatttcatccaattcttattaggctaagattctgataagatcattggtcagctataacctatggctgttagattttaaagaggcaagactttcactatttggtcttggttttagttttttcctctctataaagagtttaccttgttgtgtttctgtggatacataatgactcagatacatgcgcgacatgagacaactagagaaaatggatgaggctaataataataaacaaataaacccaacaaagaaatatgacttggttccatcccttttcaaatatgtgctcagtggcattgtctttttgtttgtttgtttgtttgtttgagacagtgtctcactctgttgcccaggctggaggactatggcacaatcacagctcattgcagccttgacctcctgggctcaagtgatcctctcagctcagccttctgagtacctgggactacaggtgtgtgccaccatgtccagctt

SEQ ID NO: 213983 - DNA, 366 bp, Homo sapiens
aaaggcattgcccctaaagctggggcccaaaaaaaaaacccccttccaaaaaaaaaaaaagccaggcgtagtggctattcacaggcatgagcatagtgcaccacagcctcgaactgcttgggctcaaacagtctttctacctcagcctcccaaggagctagggctacaggtgtgcaccactgttcctggcgcagagaggttttaagagaaaagcattttgaagtttatcctattgacatgtatgtagcaggatgccacttccagggattagtcctttcctccacccatctccaccccttcctgtcatcctctatgtcccactgtctctctccttctctccagttttggtcccatcttcctgctacc

SEQ ID NO: 213984 - DNA, 1087 bp, Homo sapiens
aaaggcattgcccctaaagctggggcccaaaaaaaaaacccccttccaaaaaaaaaaaaagccaggcgtagtggctattcacaggcatgagcatagtgcaccacagcctcgaactgcttgggctcaaacagtctttctacctcagcctcccaaggagctagggctacaggtgtgcaccactgttcctggcgcagagaggttttaagagaaaagcattttgaagtttatcctattgacatgtatgtagcaggatgccacttccagggattagtcctttcctccacccccacttcctaaatgattttatttgtaccctgagggccttttccccacttcccccacagacctgcgtgagtagacctcaggcaccaactgcacaactaactattggagaagcaaagattaagctccagcacagccactaggcaaaacctgggacacagggattctaatgtgaacttgcagagtaagattctctgcttctgagaaaacagctgtgtgggctgtgaagatgggagaggaggtttgagactccagttacctcagcaggagagcagccagtccctgtcactccaccttcatctgcagtgagtgatgttccagcagtgctggcctgggctgggctgtgcctgcggctccaatgccctcctgacaacccaggaagctgtcttactccattttgtgctgctataacagaacaccacagactgggtaacataattaacagaaatgtattggctcacagttctgaggctgggaggtccaagagctaaaggccagcatctggcaagggccttcttgctgcatgatagcacagcagaaggcgccacatggtagaacagtaaagagaggatgagaacgagagagaagtaaacatgggtcaaactcgtccttttataaggaacccactcccgagaagacaaacccactctggtgataacaggattaatccacagagtcctcttgccctaatcacctcttaaaagtcccacctcttgatactgttacaataggaatacacttcatcatgagttgtttgggagggaacagacatctaaaccacagctgagcccttcttacagcaaga

SEQ ID NO: 213985 - DNA, 293 bp, Homo sapiens
gcttgttaatgacagtgtgaataaacgagtatgactggctcaattctctgcacctgaggggaaaatagcaaaataaaggagtgacacaggaaagaaaacaaagaaaagaaaaaagtacttttgagtgggagtaaggggcattttccaagtgaaaataaaggggagaatgctggggagatgattccatacatgttcattataggaacagaagagacatatcctgatagtggattgaatgggggagagaagtgtgaagaataaatcctgggccaggcctggtggctcacacctgt

SEQ ID NO: 213986 - DNA, 411 bp, Homo sapiens
tgcagtggctcacgcctgtaatcccagcactttgggaggccgaggcaggcagatcacgaggtcaggagatcgagaccatcctggctaacatggtgaaacctaaaaagagacaaagaaagtaattatgtaataacaataagaggatataacaattgcaaatatatatgcattcaacacagaacagctatataaagcaagtattattagatctaaagggagagatacacaccaatacaataacagttggggacttcaataccccactctcagcattggacagatcatctagacagaaaatcaacacagaaataccggatttatactacattttacatttagattgcattttagaccaaatggacctaacagacatttacagaacattccatccaacaggtgtagaatacacat

SEQ ID NO: 213987 - DNA, 537 bp, Homo sapiens
gctgatagtgttcttcaagtattattaatgatttcacatctacttgttctgtcaattactgaaaaggggacattaaaatctacaactagaattgtgaaactgtctgtttctttatgcagttctgacaatttttccctctatattttgaggttttgttagtggatgcgtaaacatttaggatcattatgttctcttgatgaattaatacctttccattaaaaatgacctttgctatctctttgttattctttgctctgaaatctactttgtctgatttttaatataaccactcctactttgttttaattagtgttagtgtggtatattttttctcatccttttacttttaaccttttagtgtgtttatatttaaagtgagtttcttataggtagtatagagttgggtctatttgttttgtttttatccaatctgacagtcaatctctgtcttttaattgtgatgtttggatgactaatttttgataccattatagatatggttaggtttaaatctaccatcttgctattagtctttta

SEQ ID NO: 213988 - DNA, 861 bp, Homo sapiens
tgctgcagaccaggtgagagtggaatcactactggggatggaatttgcagaatctcagaaactagtcaggtcagagatgcgactactgagcagccattgcatcagtagcactagtgtgaggcagaatcatttgacttgttttacataccaacagcagaaaggaaaacctgtacctgtgcctgcatctgtgtaaagaggatccaaagataacctgttccaaggggcagggataaaagaactttgatgtttttgattaaattattttagaactctataaatgtctgaaatatcagataaagtatgtaaactcacccctactacaagcaggagatagtgaggtaatatacttaggctagagttctgggagctgagccaagaggtccgggttagagtgatggagagcacagtcctgctcagtaacagatatatcttggggtatgataaaaacagtcctttcgctggttcaaaacatgttctgtgataggaactcctaaataaattgactgtttcctgtgtacaaaactggcaataaacatatcaccagtctcctcttaaaaccagtaactcctctcttttattataagcagatcatcattccatctgagcaatatattatgacagtcaaaggaacccatcatgtactagtgatatagtcaaacttagaacataaaagttaacctaacacatgtttactgatacatacaattgctatcttgctttacagtaactagtcataaatagtaaggaaggtttaaaaaccaatgaaaaattcaactttttaattttacactaggtcccaaaggggcaaatctccttctcagaaactatccactcagatttgtatagctgtaaaaggctttt

SEQ ID NO: 213989 - DNA, 546 bp, Homo sapiens
ctctcaatctggggcatgactttgaagggaaggttgctaagcctcctaaatcccgatacacaccaatgccgtttccccactcatctggaaacctggtgggtcctgcccaaacgcctgtatgtcaattccacctcctgcttggcgacccaccatgcccacattttccactcaagcctttcagatctgctttgggcacctgaagacagagagaatcatctttcaagagtcagaaactttgcacgtgccattccctctgcttagaatgcttttccctttctcccaattgccttatcatcagcctgggaaaatatttatttcggctcctaaaatctcagatatcacttctccaggagctttcccagatgcctcacttgattccagaaggagctatcgccacttttgcctggcgagtacgttttcaccgttacacttatacgctatggcaatttattggtgatttgtctgtctcccctactcaatagtgaattattcatctatccctggaaacctggaactgctcaataaatgtatgtggcatgaatatac

SEQ ID NO: 213990 - DNA, 150 bp, Homo sapiens
ctttctttctttctttctttctttctttctttctttctttctttctctctctctttctctttctctttctttctctcctctctctttctctctccctctctctttctgtctctgtctttctcactttctttcctttctgtctgtcttgtc

SEQ ID NO: 213991 - DNA, 454 bp, Homo sapiens
atctgtggatttgtcctagttcagagtgatacattgaaattaattttataatccataacttaaagcagtattcttcagccatttttctcattattccctcctaaggagcatttttagacctgttttctccctaatggcctaatgggccttctccccttcagatattttaatactacagatatacagtatataataactatgttatcagtagggttgaactttggagggctacagaccattgtagtgtttaagatttccaactctccataaggaccacttttattccccttagggatattgccccagttgagaatgtatgatttaaagctgttaaggccaggcatgggggctcatgcccgtaatcccagcactttgggaggccgaggcaggaggattggttgaggccaggagttcaaaaccagtcttgggcaacatagtgagaccctgtttctac

SEQ ID NO: 213992 - DNA, 547 bp, Homo sapiens
tgtatagtggaggcttgttaagaaaaaaagccaactgttcataaagaaaagtggaagtctgggtagcagaaacagaaagcagaaaacaatggagagacatagcaggtggaatcacagagttgagtaatgcatccagcctagggagatcctcaagtgggaagaatctaagccaaaccctgggtacctgggatttcctgggatccacgtcactcaccctgtccattctctgataacgatgagaatatcactaacagtaaaaatgagaacaatttcctttcatagggcatatacggtgccctgggctttctacatttggtatttaacccctagcaccatcctttgagccagggactagagtcagatgggcccacagaggaagaaactgaggcccctagaggctgggttatctgcccacggtcacgcagcagcaagtggtagggcctggattcaaaccccagtgcttccacctgcgaagacagagaccaaaggccatctgaggcgggggcatgggaacccctctgcctggtttctccggggccaggggcac

SEQ ID NO: 213993 - DNA, 492 bp, Homo sapiens
caatgtcgtagttcatcagcctccgaaagcatcctttgctctctttccagaaaggaagagcatctctgccattcgtgtctcaaggacaagcgcttcagcctcgttctctgtgagctgatctgtggatcgcggcgtgtcgggcgacatggaggaagaaagaaaaactgctgagttacagaaaaatagaatacaggactcagtagtctttgaggatgtggctgtggactttacccaggaggaatgggctttgctggatcttgctcagagaaacctctacagagatgtgatgctggaaaacttccagaacctggcctcactagggtatccgctacacacaccccatctgatctcccagtgggaacaagaggaggacctgcagacagtgaagagagaacttatccagggcatctttatgggagagcaccgggaaggcaagaacccttgggagaaactgttttggttgggggaaaaaataaacttaaagtaaaaaac

SEQ ID NO: 213994 - DNA, 502 bp, Homo sapiens
tttatacattttagggagacataaggcatcaatcaatgcatgtaagatgtacactggttcaatctggaaaggtgggacaattcgaagtgggggggcttccaggtcataggtagattcaaagattttctgattaaaaacttggaattaataaaaggaagcatctgggttaagacaaagggttgcggaggccacggttcctattacgcagatgaagcctctggtagcaggcttcagagagaacagactgtaaatgtttcttactggacttaaaaaagtgccagactcttagtgaattctctcttggatcaggaagaacacctggactgggaagggggttctttatagaaagcagattttccctgcaagagacagctttgcagggccatttcaaaatatgtcaaagaaatgtattttggggtaaaacactttggtttcttttagggcctgctatccatcatgctggtattagtgctacaaagcatctttttgtcagtcttaaggt

SEQ ID NO: 213995 - DNA, 537 bp, Homo sapiens
ttttcagtaagtttatgatatttttataatttatagaaaataaatttaagaaatggctgggaaggaattcacatttacagaactgaccacagatttactcagtattgatgcttaaagacaagtttctgttagcaatgtattgaagaaaaaaattggaacttcagtgaacagattgttttctagtataagtggtggctttttagaggtgtactattttaattttgtataatttatatataagccaatgcagaaatatacatatttatcgatatttgagctaaaaatatttatattttattttggaacaggttttatggacttaaactaggccctgcagatagctagaatctagataggcaaaggagagaagtttttctctagtgcaagtaaatagcatgggcaaaagcttggagaagaaaaaaatgtgtaatatatttgggagactttgtagaagctagcagtattgaaggtttgtactggtgagcttttggtaggtaagtgagggctatattgcagagaaatttaaatcccagaact

SEQ ID NO: 213996 - DNA, 597 bp, Homo sapiens
ttgaagtagtgtgatgttgaagaagaatttgtgatatgttcaccacatatgctttagagatattctacatctaaatatcgctgggagttagagttgggagagatttgctctagaagcaacatcattggtggtgacaccttgtataatgaattagaaaggactatagaaaagtagagtcacctagaaatggttttaactgggttttaccagttagaactctgtgatttggaatatgttatttaacttctctgggcctccgtgttctcaaatataaaattgctgtgatgatccctacgttataggattgttgtgaggctttgtgaaggagggaacacatgtaaagagtttagcacaaggctggacacatagtcaggctcaacaaatggcgatggtagttgtttcctaagcaattctatactacagagaacattctcataaaaggctgttcacaggcgagcttaggccttcagtccttcaaatagacactaacacgagcacctgctttgcatgtagcattgtgctaggtgcaagagaatcagacatgtaaaacaaaatccctgctctaatgttcatagtgagtagaagataaaaacaagt

SEQ ID NO: 213997 - DNA, 569 bp, Homo sapiens
tttgttgaccatctttggaaaaagtctatcagaaactgtttagtaaatgattattgaattaaactataacagttaattgattgtgagattttagaaatgattttttaggaacattttctaaaaaagaattcctagttaaaaaatacccatgtaagctgcccaaatgggaccttgcacacatgaagaattcaagagattgatatttactcaccaactcactgtgtaaaggagtggaaatgtgtttcctggcccacctttgggccagtgacttcacagggggcgtggcagggctcttccaggaccaagacctttcacttccctgtctcaggatagtattgtaataggcagtttagtgatttgggaattctccaccttgaaagcaacttctgaaagggaaggattagaaaaacaacacgtcattagacaggcatgacaacatgtgcctgtagtctcagctacttaggaggctgaggcaagaggatcacttgaacccaggagtttgaggctgcagtgagctctgactgtgctaccgcactcttagcctgggtgacagagcaagactctgtctc

SEQ ID NO: 213998 - DNA, 437 bp, Homo sapiens
ggcgatggcataggaggctttaggattaggtcatgagcctgagccccttatgatgggctagcacccttataaaagaggccccagaaaaaccctcgcccctgggtgaggacgcagagagaagccagccgtccatgaagcaggacactctcacagcacccagccacactgccccaacccagactccagcctccagaacagtgaggaatgttctgatgtgtccacaccactgcccacggacctgtgggagccgctggagcacccaggatgctctgtaggaatggcactgactccaggaacctggaagggcgagctcactggccatgtgggaggcgcctcatcaaatctgggcccatttttctatttgtcttttcattactgatttgtgagttcttcatatattctggacatttgatcttttaaattttaagtactgcaaa

SEQ ID NO: 213999 - DNA, 437 bp, Homo sapiens
ttaaaaggatggaaaatgcagcttaactgggaatcgtgtaaaaatactgatattagactatatgaaaatgtagagagtttattttttcccaaagtttgtgaactttttgctcaacactttctttttataaaatagatgaagctgaaaacatattgcagtaattgttttggattttagttttccttgactcctttaatccaaaaagagaaatgtgttatcaaaggaaggattattttcatttaaaaactaaaaaaaaatttgtactgttattgttggcccatgccttcagactggagttcagagtacagtcttctcattacaaactacttgggaggctgaggcaggagaatggtgtgaacctgggaggcagagcttgcagtgagccgagatcgcgccgctgggctccagcctaggcgacagagctagactccgtctca

SEQ ID NO: 214000 - DNA, 261 bp, Homo sapiens
tcataggaagacagtgattataattttagatgccagttgagaggtttttaagtgttatatattagggcaaatggaggtaacaagggttttttatttgagaagtaagtaagactgtcttgttagtggagctgacctcaaaaatccaaaaattgtatttttcttatataacaacatagtcaaaaattattaaaatatgaggcattctggtagaaatagagagcgtctcagttcttactggtaaacttaaatcagtctcttgtt

SEQ ID NO: 214001 - DNA, 633 bp, Homo sapiens
aaaatgtgcaagtggctttggaattgtgtagtaaatagagtctggaagtgtttttgaagcatattctagaaaagtttagattgtcttgaagaggctgttggtagaaatctggacattaaaggtgttctggtggggtctcagatggaaatgaagatcatgttttggacaccggagaaaaggcaaccctatttataaaataattgagagtttgatgatttggaaaattctcagctattcatatttcaaagaatgggaaagcatgttctggagagaaaacaccataggtgtgtctgaataaatttttgctacagagattaagcgtgtgactcatggatccaatcaactatctcagtagaaacggtcaccttggatgaaagatgatagaaatgaacaaagggcaggaaggctgttggactttttggttccacaaacagaaaatgggcagctagagctgcttggctagcaacctctgttagccttcaagaaaaaaataagaaaatttttaagggtggctcagatgccagtgggattttcaatgtctgggagggtgggatggttaccactgtggatcaagagggcagggccactgctattgaataccagaaggggatagggagccatctcagtgggttc

SEQ ID NO: 214002 - DNA, 671 bp, Homo sapiens
ctcgactctcttgggggcaccggagcgggcgcaggagaggcctgcggggtgcgtcccactcacagggatcctctttcagttcatttagataggtgccctttgggcccttgaaattcaacggctatgtgttcacgttcagcacgctcggctgagagctttcatttttagggcaaacgagccgagttaccggggaagcgagaggtggggcgctgcaagggagccggatgaggtgatacacgctggcgacacaatagcaggttgctctttgtgctaagactgacaccatgaggacacagatttgggggaagggggaatctctaggcaaaggctgttacagtcaaatctctgcgaacgattgtgatccgacagcggtgcaaaaggaaagagcgaatgcagtccacgccgcggaaatctaggggtagaggcaaggggggagggtattccccttgcagggaccgtccctgcatttccctctacactgagcagcgtggtcacctggtccttttcacctgtgcacaggtaacctcagactcgagtcagtgacactgctcaacgcacccatctcagctttcatcatcagtcctccacccccgccccacaacagcctaccctgcctccggctgggtttctgggcagaggccgaggcttagctcgttatcctcgcctcgcgt

SEQ ID NO: 214003 - DNA, 697 bp, Homo sapiens
ccacaacttaagagtaagaccaaaaagaaaaaaaaaagtaatggtaattaatccagaaatagtatagatgacataattagtacataaagacattaaagcagttaaaataactttattctgtgttgccaaaaagctgcagaaagtttgaccgtgctaagtcaataaataaatatatttaaaagaccaaaatcatatcctgagagagaaaatatcatattaaagtacatgaaaaataaaaattataaaatttattccatatgaaatattccagataaaaatattagtaattctgaaaatatagcatcataaactatacagactgtaacctagaaaaaaagaagaattaaaaaaaataaacagaggttcagtgaactgtgagacaaagcatgcaaagcaagtagcctaaggcatgtgcaattggattcccagaaaatagggtgtgggcagaaaatgccacaagaaataatggatatttttgcatattttattaaaactgtaaactctcagatccatgagctcaataaaatatgacataaactaaaacaaagtacatctttattgaattgcttaaaactggcattaaagaggaaattttaaaagcaatcagaaaaaaaaatacacaagacacagagagaaagaaattagaatgatagattacctctcatcagaaaaaatgcatggtggacagtaggaaaat

SEQ ID NO: 214004 - DNA, 398 bp, Homo sapiens
tggagtttcattcttcttgcccaggctggagtgcagtggggtgatctcggctcactacaacctccgcttcccaggttcaagtgattctcctgcctcagccgcctgagtagctgggattacaggcacatgccaccacatctggctaatttgtattcttagcagagacggggtttctccatgttggtcagattggtctcaaactcctgacctcaggtgatcctcccgtctcggcctcccaaagtgctgggattacaggcgtgagccactgcacccaacctctcattgatactaatgttcactttgcctgagaaagaagagaggcaacatttgttactggaaaatttagtatctcattaatagatatatctttatatctgtttatccattagacaagagca

SEQ ID NO: 214005 - DNA, 607 bp, Homo sapiens
tcatatgcatctatacatacatatatatgagacttaatacttcaatgagaaacactgaaataaaataacaaaagagcatttccactgtccatcagttgctaagtagccatgtgccccatctaatgtaatgtaatttatcatggaattttggtttaagctggacattaagaattgcaaataaatggcttttgcctaagattaatagtaacatattaatattgtttttcttccatctgcaaaagtaacattaatgaaaatcaaatgttaaaattctataattattagtaaagtgttttattaagtaccttatacatctggaattactctttagttctggaaacaatttacttagactcttctctacataagagtacgatttcatactatgatatagatttatgcaatataattgtttccttttgaattaataatatttgaatttgagctgcaagtttttaaaaaagtacttcaaaggctaattcatctttatggattaggcaaatagtctaatcaatttatggagaatgtatttggaatatgtaacagcaagtggcaggaagtactttagagttcaagactcatgtgcccatcactatgctagaagcac

SEQ ID NO: 214006 - DNA, 598 bp, Homo sapiens
aattcgcggccgcgtcgacgagaagacgacagaagggggaggcagtgtcagttcagcaggccttgcagaccatccttaggtctcctggcagcccaggcctggtggcacctatcagcagcctctgaatggccaaagggtttggaatctcagtggctgaccaagtacttgagtgagagccggtgtgggtggggcccggaaacaaaggttaatgccgccagcgggcccttccaacacagaatgacagaacacatgcccttggcgtgtctgactttggatagcaccctatcgtgagccagcctagacgagtcaccatgagtgacagtcccggctgtggttggggttgaccccgtggacaggagtgtttgacacagattgtctgaacagctgagaagtgaccaagcccacatttgtatcagcagggcacctagctattctttcaggctcttagcacagggctcgttgtttcagaaataggctccagccaggcatggtggctcatcctgtaattccagcactttgggaggccaaagtgggtgggcgcatcagctgaggtcaggagttcgagaccagcctgggcacatggcacccatctctgtct

SEQ ID NO: 214007 - DNA, 338 bp, Homo sapiens
tcaatgagaatacccattatggtggactggacaagtatagaattcctgttgggaagccagtattgcaaaggggagacatgatagactcccatttagaaattgactgtttaatcctaaatatactttgaatttattgtttgttacctgttcaaagtttgtcactacccattcttaatttggagagctccagcaccaaataacccttctgtgtccttagctatcaaatgacctacagaaagtcatggaattgttgtgatggtgtctgctgtatataagtatcctatgtcttatgtcttcagctgacctgcttagtagtccgtaatttcatctccttattc

SEQ ID NO: 214008 - DNA, 1887 bp, Homo sapiens
caaaaatgaaaagccaggtaaagtttccaagggctgtaagaagcctgcaaaacaaaatgggaagaaagcaacctccaaagtgccctctgctcctcagtttgttcactccaatgatcatgccaatcgagaggctgaaataaagaagagggttgaggagatgagggagaagcagcaagctgcccaggagcaagaaagacaaaaacgcaggtctatcaagagctactgtgaggatatcctaagacgccaggaggagtttcagtgtaaggaagaagttttgcaggaattaaatatgtttcctcagctggatgacgaggccactatgaaggcttattacaaggagtccgtgaggtggtagaatactctgatgtgattctggaagtcctggatgccagagacccattaggctgctgctgctgcttccaaatgggggaggctatcctatgggcagaaggcaacaagaagctggtcctggtcttgaaaaagattgacctggaccccaaggaggttgtgaagtggctggattaccttcggaatgagttgccaactgtggctttcaaggccaggacccagcatcaggtcagctttggagctgaaaacctcatgagggttctggggaactattgctgccttggtgaaatgcgcacccacatccatatggacattgtaggccttcccaatattgggaaaagcagcctgattaaaagcctgaagcacagccatgcatgcagtgtgggagccattcctggggtcacgaaattcatgcaggaggtctacctggacaagttcatccggctgctggatgctccagccattgttccagggcccagctcagaggtgggcaccatcctgcataactgcatccacatctagagactggcagaccccatgaccccagtggagaccatcttgcagtgctgcaacctggaggagatttccaactattaccttctctctgggtaccagactactgagcactttctgacagcagtggcccaccatttggggaagaagagagacttacacagtcaggagcaggcagccaaaactgtcctagctgactgggtgagcgggaagatcagcttctatagaccaccaccacccactcacactctgcctgcccatctcagtgctgagaattaaggaaatgaccaagttctttgacatcgaggataccgagcaagtcaatgaagacaccatggaatgcttggccactggagaatctgatgagctattgggtgacacagacccactcaaaatggagatcaagttgctccattctccgatgatggaaatagcagatgccattgaagataaagctactgtatataagattggagatctcactggttattgcaccaatccgaatcgtcatcagatggggtgggctaaactcaatgtagaccaccaccctaaaaaaaaacagtaaggtggatgtgtgcccagtggactgctgcccagtactgcagaggatcatggagatggaccccctacaacagggccaggctctagcatcctccctgaagagtaagaatttacagaaatgtgcagataaaatccccagggagctgtctgattccatgatgtctgccctccacctctctggcaatgctgatggcagtgttggtaactaattgactgatctcacttcccttccgatccaagcaccagttccagtgggacgggagattaccagtgaaatagtttggttctccctgaagcatctgcatattaaaagaacccttccccaactatgtgtctttgcctcccactgttctctccactctctccaggaaaaagagtcccaagaggctggagctgacaaacccaataccctttatttaacccctactctgttttacaacagaaataaaagaagtatcagcagga

SEQ ID NO: 214009 - DNA, 852 bp, Homo sapiens
gagtgtcaactgtcaactggtggagataaggaggaagggcttccaggcctgggggacataaaaacaagaaggtgggaataaatatgccctgtttgggctaacaaatattccatttttgactaaaggcaaagaggcttcaccttaagggagaagcaggaagagagactgcagggtttcccaaactttattatattctgctacagtaggtctggagggataagggaatttggggggaggagggtagtgcgcaggagtgtcctttttaaaattttttttctcattttaaaatagaagtaatccatgtaccttatttagaaaactcaaatcagtaaagtcaaatcactacagacggactcgtgaaaagcaaaagtctactgccccacacatccccacccccactctcactttttgccaccacttttagttatttattctgatttttatctccatacctacataatatgtgggcatttaaaaaatcattactttcagacattacccattgatgtcctgctatgagaaatgaggatttagatcatttacagcaagttcaactccgtcctgcttctagtatagtttagtttttctgtgggttattgagtaatgcctttatttcctgttccatgaactacagacaatatttctaaactagaactttgttagatgagagaataccctttcctatagcccccttccgcaccattaacctcccaacttctgtcatctggtcttttatattgtcaaaacataatgttaaattctgttctgtaatcataattgagtttttttatgtttgtctatagttgggttctaaaagttgaaaagcaataaactgctgttaatatgaaaaaa

SEQ ID NO: 214010 - DNA, 729 bp, Homo sapiens
gagtgtcaactgtcaactggtggagataaggaggaagggcttccaggcctgggggacataaaaacaagaaggtgggaataaatatgccctgtttgggctaacaaatattccatttttgactaaaggcaaagaggcttcaccttaagggagaagcaggaagagagactgcagggtttcccaaactttattatattctgctacagtaggtctggagggataagggaatttggggggaggagggtagtgcgcaggagtgtcctttttaaaattttttttctcattttaaaatagaagtaatccatgtaccttatttagaaaactcaaatcagtaaagtcaaatcactacagacggactcgtgaaaagcaaaagtctactgccccacacatccccacccccactctcactttttgccaccacttttagttatttattctgatttttatctccatacctacataatatgtgggcatttaaaaaatcattactttcagacattacccattgatgtcctgctatgagaaatgaggatttagatcatttacagcaagttcaactccgtcctgcttctagtatagtttagtttttctgtgggttattgagtaatgcctttatattgtcaaaacataatgttaaattctgttctgtaatcataattgagtttttttatgtttgtctatagttgggttctaaaagttgaaaagcaataaactgctgttaatatgaaaaaa

SEQ ID NO: 214011 - DNA, 2202 bp, Homo sapiens
atttcgttgatgctttgcgtccaaaccaaatcgttatgcttttgcatacattagggctttataaagaacaacagcgacatctgcatgtgccgcagtgccaaggagataggaaaaataccgaaaacaaaactctgtattggcttggaggctgtctgactctctgtctccctagcagcccctgacaccaccatggataggagtaattgtacagtgtaatcacatcaggcctcatctgcatattcataacagagacaaagctttggaggataaggggggagccggggtaatttaaatataaagcagcatctcatttccaaatcaagttgtgccagttagactgtgcaccaggactcagtattaagccaacattgttttacagtttggaaattggagtgaagaagatggagaagagactcactaaagagggggtgatactacattttcattcttaactgaggaaaaacaaagcaagacaacaacaacggcgacagaataaaaatgaagtaatatttgaagagtcaccagtagtggctaaccagctgctgttttaccaggaatgaaatagcccattgagggagctttaaaagcccccaattaatatgttgtgcatgtataagatctacaaagaactcactgtattctttctctccccaccaagtccccccctccccaagtactcacatattccctaaccaccacctttctgtcctgtcgggtgcagggggaaaagatcagagctacaaaataattgactaattgcttcaaaagtaacaacatccctcttcaaaaagaaaggacaaaaacaaacacatacaaaaaggtgactgttcattaatgaagggataaattaccgatggcttcttcattctctttagttcattaccccccaaaagaaacaaatataatccacgtgttaatatttcttgtcttcgttttctttgtttctaatatgatgctgtttattatatatttttaagtgttggtatttgtagaagcctctgctactgcattccccaaagagctactagtttcagcccactggagtttatattcctttaattgtctagtgcaggaacatttctgctgttttgtaaaatacactgctctgcaggaattagaagaatccaaggttgtatccaacttcaaaggtttccaagtcataatgattttagcaaaagtagaagacagatcatggaacaagtccccgtttgaagataagcatcatagggacctttttttcttccctctctccccaactttgtacttctcctggttctgaatgcccctcactaacacagtttaatgatatgcaaatgaaatatgcataaaaccattctactgtatgatgattaaacactggagacattaacagcggaggcttcactctgtgtaataatccttcccgaccatccactttgattgcagagttatggaaacccatagcagttggcagagagagcgaaagagagaaggaaggaaagacgcagggacacatcacccatctcggtgcttctcccactgcaggagaggtccccccctttgtactgcgttcctattgctgtcttttgtaatccatccatgcagtcgcaccagagcgattaacggaaaaaacctcttttctcttaatgtttcaaagctcattagccaaacgattattcctcattaacagcgaaagctcattcattaaaaggaagaatatgcccaaaagatgccagcgcagctaatcctgagtcccgtaactgggctgtaaatcccatactacttgtatattccatgcaaaagggacacgcgccaatccacatttttttttaagaaagaaaaagaaaacagtttatgtgttttgtaaaatccacaagagcagcaattaatattcccattgaatcactttatttttttgtctctcccttttgtttccagcgcctgcccctggctcagcgcccggtgccaacagaacacctttcaggatccacagcaacgcagacaacgtaagtaccagccgttccctgaaacccttttgcagattttttaaaaacaaccacctaaaacatagagagagagagacaagcctctttccccttcttctcccctgcgttatgccaccagtgtttcctcagtagccccttccaaatcgctctgccttcaagtttgtgcatgtctgtgtggcatccctcctcctccttcactcccatagtggatcttgta

SEQ ID NO: 214012 - DNA, 872 bp, Homo sapiens
ctctagatctcgtatttgaatttgtggcgcttggtgtccgcgagttgccgaatgaagctgagcgtctcagtggaaccagggatctcagggaggggaaggtataaaattttcaaatggaggagtatacctgaacctaatcatggatgtgattttatgtaagtaatatgtgagatacagataagctgattctaaaacttacaagaatggcaaagaaacaagaagagcttaaactgcaatcatcaacagagaagctttctgcaaccaaagtgaagactgaagccttaggctatggcagaagttgggcgcctgaagtacacgtggaaatatgccaactgaacattggactaccacgtcaagggtctcctacccctgggccatggatcaataccagtctgtgacctgttaggaaccggtagcaggagcgcctgcccctggctcagcgcccggtgccaacagaacacctttcaggatccacagcaacgcagacaacattttaaagcacctgatggatttggaaaatatttaatgaagacaatgatgctgacatctcaagttaaaaggttctacagagaaggcaaagattttgaaggcacaggagactatcatagatattcacaacggcatctccctaaaggatttgaaagctttgcatcaaccaaaggaaaagcaccagtgagagtcaagatacagttccagacagatgtaattggttaagataagatcatactggatgtggatgggtcctagatctgactgctgatatccttataagaagaagaaaggacacgcggagactacagtgatgttgccacaagccaagaaatgccaagaatttcgggagccaccagaagatggaagaggcagggaaaaat

SEQ ID NO: 214013 - DNA, 698 bp, Homo sapiens
  misc_feature (654)..(654): n is a, c, g, or t
ctctagatctcgtatttgaatttgtggcgcttggtgtccgcgagttgccgaatgaagctgagcgtctcagtggaaccagggatctcagggaggggaaggtataaaattttcaaatggaggagtatacctgaacctaatcatggatgtgattttatgtaagtaatatgtgagatacagataagctgattctaaaacttacaagaatggcaaagaaacaagaagagcttaaactgcaatcatcaacagagaagctttctgcaaccaaagtgaagactgaagccttaggctatggcagaagttgggcgcctgaagtacacgtggaaatatgccaactgaacattggactaccacgtcaagggtctcctacccctgggccatggatcaataccagtctgtgacctgttaggaaccggtagcaggaggtgagtagcagcctagcgagcactactgcctaagctccacctcctgtcagatcagtagtgacatgagattttcataggagcagaaaccctattgtgaactccaaacacaagggatctaggttatgcactacttatgagaatctaatgcctgatgatctgaggtggaacagtttcatcctgaaaccaccgcccccatgtgtggaaaaattgtcttccacctggtccaaatggncggaatatacccagcatttaatattgcatggtatattggtatat

SEQ ID NO: 214014 - DNA, 525 bp, Homo sapiens
ctctagatctcgtatttgaatttgtggcgcttggtgtccgcgagttgccgaatgaagctgagcgtctcagtggaaccagggatctcagggcaatcatcaacagagaagctttctgcaaccaaagtgaagactgaagccttaggctatggcagaagttgggcgcctgaagtacacgtggaaatatgccaactgaacattggactaccacgtcaagggtctcctacccctgggccatggatcaataccagtctgtgacctgttaggaaccggtagcaggaggagtgcgttgccagggtaacggaatgtaagcaggggaacagcaccttgcagatcacaaaggcaaatctctggaaagaaatttcactgagtttctcttttccttaccagtgtaataacaactcgtattttccctgcactatttaatagtctcacataaacattctttcccatttcccttttctgtatctgtttaaacatggacaatagcataaatctgaaactgtcaagctcagtgagctaagcaaa

SEQ ID NO: 214015 - DNA, 1958 bp, Homo sapiens
ctctagatctcgtatttgaatttgtggcgcttggtgtccgcgagttgccgaatgaagctgagcgtctcagtggaaccagggatctcagggaggggaaggtataaaattttcaaatggaggagtatacctgaacctaatcatggatgtgattttatgtaagtaatatgtgagatacagataagctgattctaaaacttacaagaatggcaaagaaacaagaagagcttaaactgcaatcatcaacagagaagctttctgcaaccaaagtgaagactgaagccttaggctatggcagaagttgggcgcctgaagtacacgtggaaatatgccaactgaacattggactaccacgtcaagggtctcctacccctgggccatggatcaataccagtctgtgacctgttaggaaccggtagcaggaggtgagtagcagcctagcgagcactactgcctaagctccacctcctgtcagatcagtagtgacatgagattttcataggagcagaaaccctattgtgaactccaaacacaagggatctaggttatgcactacttatgagaatctaatgcctgatgatctgaggtggaacagtttcatcctgaaaccaccgcccccatgtgtggaaaaattgtcttccacaaaactggtccctggtaccaaaaaggtcagggaccactgctgtaggtaaacctgcactggtacaaaatgacagaaatatacacagtcatttattatagcattgttatattgttatattgttattatagcattgttgcatgaatacaggattggaaataaatcaaggatctagtaataagggactggttgaataaaccatggaacacacgcaaacacacacacacatatacaaaatagagctgtatatactggtatggagagatatacagaatgtatgaagctggtggggtgaagggaaacaatatatagagcagtgtttattgtttgttaccttttgtaggaagagtggaaaagtaagagtatatatttgtattttcttgtatttttgtaaagaaactggaaaaataaaaaaaaagcaactaataaaatggttacctataaggagttgacaggaaatatggtggcaggagtgggacaaagattcatctgttgcattttttgtataacattgactgtttaaaaactttttgttgtgtactttacacaaaagaagaaagaataggttaactaaccttgatacccatcacctagcctcaacaattatcaatgcatgagctatattacttcatccataattccacacccatttcccttcactaaattattttaaagtcagtgtcagacatcatattatttcatctgtatatatccgtaaatatttcactgtgtatcgctgacagataaaggctgttttttaagaaatcatatcacactaaaaattattgtaatttcttatgtctaatggaaatttaaataatatctaattagactacatttttgtgaccattaccttatatttcagctgccctgcttccttctttatttatagtgtctaagtttattgtgggtcttcttagtacaaattagcaataaattttctcttggaaataatcttaatctcagagaaaagcctcaagaatattacaaagaatttctgtatactcttcccccagatacccaaatttaccatatttgctttgtatcgtcctcacagtctgtctctatgtatgatattatatatttaattatatatgtgttatgtttttctgaaccatttaagggtaagttgcagacataacgcctctttcccccaaaatacgttcatttgtattttctaagaatattctgatatataaccacaggggaaattaacatgatacaatactattatgaaatctacaaatttgattcatattacacctttttttcccttgtatttctttgcccttacaggaaataaataaattttttttctgta

SEQ ID NO: 214016 - DNA, 419 bp, Homo sapiens
agagaaggcctgcgtagagggaggatcccctgatggtgcccacttctccgggggtcccaggtggcgaagggagcagatgcaaagaggtggagggaaagggcctgcaggtgccacagggacaaaccagcctaatttaggatcagagaagtaagaattttaattgagttttaatagtgtctggcccttcgttctgaaatcctggtgtgcgaggctgggggagggtaggtgcatgtgaggaagggcgagccggtggccaggatgatccctgccctcgggcccagacttcaaggagatggggaacaggctgtggggtcccaatgtgcagagcagctaacatgggacaggcaagtctaagaagacagcctggaggaggtagcatttgagctgagccttggaaggcaggtggaatttccaaagat

SEQ ID NO: 214017 - DNA, 119 bp, Homo sapiens
caagtgatcctcccaccttggcctcccagagtgctggattatagtcatgaaccaccatggccggccctgaaaactacttttctacttcccttatggtggccacccttctcatcttcatg

SEQ ID NO: 214018 - DNA, 525 bp, Homo sapiens
agtattccttttgtccaaagtctttcacaatttttactgacagtggcttgcaaggctgtgcggtcttgctctagctctccatcctcctcatctggtaatatcctctttgtctgtactccatccattctggaatttgactcccaaacatttttttctctccttgttctcagagctttaacacttgttatcccctttttgtggaacatttcttcctgtactttttgtttttttgttttctacaggtctctgtttaaaagatcactttctcaaggcagcctctaggaaacactgactcacttagaacttcctttggtatattccaggacatcgttttagtaacactgattgttactaagttgtaattgcttgattactgcttgtactatcctttagtctgaaaaattataggaggacagggactgtctcttttctcatgaatctctctaaagctatattgaagaagctcaatatatatttataaatttattaaaatcttccttgaaggtttatatttatttattgttt

SEQ ID NO: 214019 - DNA, 338 bp, Homo sapiens
aaaaaatgagtaaacttatacatgatgtaaagcagaattattaaaacagatgaacggccaggggtgatggctagtgcctgtaatcccagcacttttggaggctgaggcaggcagataacctgaggtcgggagtttgagaccagcctgaccaacatggagaaaccccgtctccactaaaaatacaaaattagccaggcatggtggcacgtgcctgtagtcccagctactcgggaggctgagacaggagaatcgcttgaacccgggaggcggagattgcagtcagctgaaactgtgccattgcactccagcctgggcaacaagagcgaaactccatctca

SEQ ID NO: 214020 - DNA, 1056 bp, Homo sapiens
ccccaccctgcatcctgtggccccagacgtgaggtgccccctcccgcggggggtcctttctgccctccccaccctgcatcctgtggccccagatgtggggtgccccctccagcggggggtcctttctgtcctccccaccctgcatcctgtggccccagacgtgaggtgccccctcccgcggggggtcctttctgccctccccaccctgcatcctgtggccccagatgtggggtgccccctccagcggggggtgccccctccagcggggggtcctttctgccctccccaccctgcatcctgtggccccagatgtggggtgccccctccagcggggggtcctttctgtcctccccaccctgcatcctgtggccccagatgtgaggtgccccctccagcggggggtcctttctgccctccccaccctgcatcctgtggccccagatgggtgccccctccagcggggggtcctttctgtcctccccaccctgcatcctgtggccccagacgtggggtgccccctccagcggggggtcctttctgccctccccaccctgcatcctgtggtcccagatgtggggtgccccctccagcggggggtcctttctgtcctccccaccctgcatcctgtggccccagacgtgaggtgccccctccagcggggggtcctttctgccctccccaccctgcatcctgtggccccagatgtggggtgccccttcccgcgggggggcctttctgccctccccaccctgcatcctgtggccccagatgtggggtgccccctcacgtgggggtcctttctgccctcccctgccctccctactctccagacatttcctgcccctccccacctcaggtggcggctgctcagcagctggggtctggcccggtcccccatccctgcccatccccagcgatttttatcttggcttttggttttctgctgtatagtaggtgaaagtcatcttctcggtggagggggtgtggctggcagcccctggtcacttccagttcatctctcactgcctccttgatgaggaccaagggtcaataaat

SEQ ID NO: 214021 - DNA, 509 bp, Homo sapiens
aagataaaagtcagtttctccctcatatgaaggttcaagctagtctgaaggttttgactgcttacaaagctgtaaagtgccctggatgattgggaaatgcccatgttgttgggaaaggttttttagaaaggttattccccccatttacaaggtatagccctcattctgatgtgtcatgacagttgcctacattttcgttaagaaaggggctttggccgggtgcggtggctcacgcctgtaatcccacctctttgggaggccgaggcaggtggattacctgaggtcacgagttcgagaccagcctgaccaacatggagaaaccccatctctactaaaaatacaaaattagccaggtgtggtggcacatgcctgtaatcccagctgcttgggaggctgaggcaggagaatcattcgaacctgggaggtggaggttgcagtgagccgagatcatgccattgcactccagcctgggcaacaagagcgaaactccatctcaaaataaataaata

SEQ ID NO: 214022 - DNA, 551 bp, Homo sapiens
tgtttttgcttaatgttgagatcaggtagttctgaattttctgccttgtacttatgtcaaaaataattaagtcaaatttgcttcttgagtcttttaaagcatgtgctaaatttattttattagctcacacacactgtaagatagattcaatgaggtttatgtgatattacgttagtacataaaattgtctagttttacagactggttactctaatatctaaaagaaatcagctttttcaaatggcatgcctaagtcaaatgaataaagagaatggttttgtgatctttccttaccaagtgagaagaaataggatatttacttacttctaagtacatgaacaccaaatatgctttttaaaaaagtgttttataaatggtccagagaaagaatctaatgcacataataaatactttcaactaatgaggaaatttcaaaactgttcagtaatttgtgctctgggcttctcacatgatgaaagctgagtattctggaaagtagaacactgggactctaacattccaccctaacactctaaataaggctcctaaat

SEQ ID NO: 214023 - DNA, 544 bp, Homo sapiens
tgcaggaattacagccttacacggaaaaaaggcatatgctgttctgaaagaaagtgctgattgaaaatgtggacggtggagtgttcctatcaaaggacacaaagtattccagatgctcctagtgtcctttagtcttttccacagaaagataaggtcttcaagggagatttccccacggtaggaaggggatgagtggatggaatcttggtcattatcggtccagacacccatgaggggaagaactctgggcagagtcaaattttaaatggacctggcaaaaaactgaatggaattatgattttcccctcaaatcctttgtgatttcatctatatctcctgttgggactgcttactgacagagtggagggtatgcacttcttaactgctataagaactttctacagcaggggtcagcaaactatcaagggccaaacagtaaatattttagactttgcagaacatagggtctctgaggcatctacttaattctgctgctggagctcaaaacagccacagacaatatgtaaataaatgagcacgtctt

SEQ ID NO: 214024 - DNA, 483 bp, Homo sapiens
gtgagcctttgtgtggctgcagcccacctgctgattgaagggctggggagtcctggctcatctgtttcatgccttggtaccatggtagatgccttctgtgttccatgtagccaagccaaggttggaacactttttttggtgttatcctggaagatttcagttgttggctttctttttcttacttttcacatgtactcttttttcacatctacaaaaacctagagacaaaaaggactattgactgcaagtggttgcttatagttagacgatagtgtgcatgtgagagagtgatggagtgagaagagtaagagtcagcagccacactatggagaacctttggtcctattaagaaaattcaatttcagtccagaaataatggcgagacactgaaggatctgccagcccctgccattttggaactgttctgttggtgtgtgtgtgtgtgtgtgtgtgtgtgtgtgtgtgtttgtctgaattgcagtt

SEQ ID NO: 214025 - DNA, 119 bp, Homo sapiens
aaaaatatctctaggctccgaagctctcacaactcatccttgctccctacccttttgggaagcaattctcaaaacttgagatttatggtccagaaagctgatagtggctatcaagtttt

SEQ ID NO: 214026 - DNA, 696 bp, Homo sapiens
agggagcttcttgaatcttgttttggttatttttcccaccgggaaactgcccctaaatctggcatatatggcttttttgatagtgtattgatcacattcccttttaggacactttaggttgtctggagtttggagcccgtaggaatattgaagaagttagtgaagaaatgctatacagtcatttgttgattaatgaagggggataaggtctgagacatgtgtcgttaggtgatttattcattgtgcaaacaccatagagtgtatggtacttacacaaacctagagggtatagcctactaaacacctaggctacaaacttgtacagtgtgttactgtactgaatactgtcaacaattgtaacacaaatcaccaggcgataggaattttttagttctattgtaatcttatgaggctactctcatatatgcagcccctcattgaccaaaacatcattatgcagtgcatgaccatattgagagtattcgttttttatttactaaaaaatagtcaaaacttgaggaggaagagacagatgtcactagaaaaagggagaagtccggtaagggagaagtcagcttcctgaggtggaatcgtattacctttgggattaggacatttcattgtcattattcaccagtgtaaaacacttttacatttttctactattattactaaaaacatttttctactacttta

SEQ ID NO: 214027 - DNA, 502 bp, Homo sapiens
gtgcagtggcacaatctcggctcactgcaacatccacctcccaggttcaagtgattcttctgtctcagcctcccgagtagctgggattataggcacacaccaccatgcccagctaatttttgtatttttagtagagacaggctttcaccatcttggccaggctggtcttgagctcctgacctcatgatccacccacctcggcctcccaaagtgctggagttacaggtgtgagccactgcgccgagccaggtcacaactattttcatggcaaatactgttaatactgattcttatcactttgttgacatttagcactggtgcaaacccaagggttgctcaaacttactggttccttatcgctaatcaaggcagtgatactatactgtactagtgattattgtatttctttaccattatgcactcactgtttcttttaaaaagaaaaaagactttttttttaatgtccttgaatctgaaacattattttattaatagcccttaa

SEQ ID NO: 214028 - DNA, 410 bp, Homo sapiens
ataaataaaataataataaaatgaggcatgcctgtatctataaccattcatgtgaggtcagctggtatgttgcatatctcttttaagagttcgaagaagacaaattatgttaaatggaattgggatatggcaggcatattaaattgacatgtccaacacaaagacatggtctgtaaaagcaacacacacatatacaggcacacatgtcaggaaactaaatataaatatgtttgtgtattggtgtgtatagtttcaaattttgtagcactttggatttcagatttttggattaggaatgcccccaatccagaatactctaaaatctaaaattgagcacatgctgttggaaaacaatgccaataacttgctggatgcaggattgccacagaccttcaatttgttaaaaaaca

SEQ ID NO: 214029 - DNA, 276 bp, Homo sapiens
acatggttacagggtggtgaactcccaggtggaatggggcaggatcccagctacgtgccccccctgcattgcgggagggcaactgccctgccccgccggtggctagctcagagggtctacagtttacagttttagcgccaaacgcgccacaggaaatagtgcaaaataaaagggggaggagagatggaaggcagcggggtggccgagctccaagggccccggctgctcctcccctcctcgcccttcccccttctaccctctccgaaacagagaacc

SEQ ID NO: 214030 - DNA, 304 bp, Homo sapiens
acacccaatactgccacattcttcacatttgtagggtttctctccagcaggaattatcttatgtgtagtaaggtttaagtaccgtttaaaagcttttccacattctttagtaagggaagaggaccagtaaagccctttgccacattcttcacatttgtagaatttctcctcagtatgaattccaatatgaatgaccttatgtctactaaggtatgaggaccacttaaaagctttgccacatttggctgggtgcagtggctcaagcctgtaatctcaggaccttgggagggcagtattgggtgtg

SEQ ID NO: 214031 - DNA, 457 bp, Homo sapiens
tcaagtaggtgaatatgtatttctaacattatgttaacttgatgcactagtccttttatcattattatgtgttgttggaaaaactctcaaccatttttcctctgctgtggtgtcaacaccacaaacttcaacacagaaaacttccgagacccccaaatatgtgaggatttctccccacaagcaagcgagcgagcaagcaagcaagcaagcaagcagtcaattttgcaataatactagttgggtgtcttccagttcaattctgaccctgcctacgtggggatagtgtcacatcccacaggatgagggctcagttcccaagactgccccttccccgcttcagacaccattggcaagtccgggcctcaggaacttctgactgatcagcttcaagttggggcttccacaactcttggtttgggttcagttagttagaaacacttaatgttagagatagggt

SEQ ID NO: 214032 - DNA, 486 bp, Homo sapiens
taagaaacagagtctcgttgcccaggctggaagtacagtggctcgatctgggctcactgcaacctccacctcccaggttcaagtgattgtcctgcctcagcctcctgagtagctgggactacgggtgcatgccgcaacacctggctaatttcttttgtattttagtagagacagggtttcaccgtgttgcccaggctggtctcaaactcttgagctcaggcaatccgcccacctcgacctcccaaagtgctaggattacaggcatgagccaccatgcccggccaagttaaggctcttgagatggggaggttatcctggattatctgaccgggccccatataatcacaagggtccttatacggaaagagggattcatgagaattagagaagatataacaattaaagcagttattggagtgatgcagccatgggctaaggaatgtggacagcctctagaagctggaaaggcaaggaatggattctctc

SEQ ID NO: 214033 - DNA, 549 bp, Homo sapiens
atgctgcttataagaaaccaactttaaatgtaagatataagtagattaaaattaatagaacagaaaattatatactatgctcaacctaatcagaagaaaactagagtgctatattaaatcatatgaagtagatttcaaagcaagtaatattgctggagataaggaggaacatttcataataattaagggagtcatttcatcaagaagtattaaccgtcttagttatgcatctaataacaaaacaaaatatttgaagcaaaaactaatataaggaaaaatagacacatttacagttactattggacagttcaatatccatcttcaaataattgatacagcaattggagagaaattggtaaggttatatagcaacttgggcaatactatcagtcagcttgatctaactgacatttatggaacacgctacccaacagcataagaacacttatttttctcaaggtcacagatcatttatcacagtgtaccatatgttgagcaaaacaactccatgaattttaaaggatttaagtactgtaaaacattttctct

SEQ ID NO: 214034 - DNA, 559 bp, Homo sapiens
gaggtcactgcggtgagctgtgattgtgctactgtactccagcttaggcaacagtgtgagaccttctctcaaaatatagatatataatcttaatcacttctcaccatggttcaaacaattaatttaatctcatacctgcattagtcatttaactggtctccctgattccatcattgcttgtagtttatgtagcaccctgatcctcttcaattatctaaatcaaatcatatcacacttctgttcagagcccgacaatgactttccctctcagtaaaagacagtctttaaaatgctctgcaaggccttaggtgatcaagcctcctgatactgttccccgaaactcatttgctactgttcttagccacgctagcttacttgaatatactgggtccagttctaacttagagcttttgtactggcttttctctttggctgaaatattttatgtccttcaggtgttcacttaacttcatctcatgaggggtacactgattaccctatttaaaaatcaaaaccctccatttgtctccatacacacatttttcatctcgctgctctt

SEQ ID NO: 214035 - DNA, 262 bp, Homo sapiens
actgggtttgagcacatcaataggatttaataggtctccaccaaagtaatctctttgcccttccttgtgtgtttcctttttggttttctgttagaaacaaaacgaaaacagtgttttgtaaaacaccagattgtatttaccctttctttcctttcaatcaggaagaagctcctgttactgatagcagattgttttaggtgctttgtttttaggtgcttcctaaaccttccataaagcataaaggtgttttcatatttcacat

SEQ ID NO: 214036 - DNA, 444 bp, Homo sapiens
actgatatgagttggctgtgtccccacccaaaatctcatcttgaattgtaataatccccatgtgtcaagggcaggaccacgtggagacaattgaatcatggagctggtttccctcattctgttcccacgatagtgagttctcatgagatctgatggtttaggggcttccccctttcctgggctcttattctctctgctgccgccatgtgaagaaggatgtgtttgcgtctccttctgccatgattgttaagttttctgaggcctccccagccatgcaaaactgtgagtcaattaaacctcttttctttataaatcacccagtctttattagcagtgtgagaatggactaatacaagcaccaaattcagaacagtgtttacctagggaaagaaaaaaagaaatgggatctgaaaggcacagacagggagctttatatgtgactta

SEQ ID NO: 214037 - DNA, 597 bp, Homo sapiens
aaaagtaactcataagtcctcaaatagaagtcctttatactttggaaatttttctccctcccacttacttagacacctatcttgttatccatgggagcagctaacaatataggtggcctgctgacttggccaccactccctctgtctcggtaacagctgtctgtctagcctgtaggtgggctgtgaactccacgaggacagtgctcagagggtcttgtatagcaggtcagtgccctgctataccctggtgcctacagagggctggcacctagagagtcctcagcaggggtctgcgggtagagggagtgcatttgccagctaggactctgccactcctcatcttatgtgtagttattaaggagctggtccaacattaattacaatccatttctagggattaatccatcattttcttttcttcataaaggctgttcattggtttgaaatgaaagaagagtataggattttcttgtttgtctgaaaaaccccagctgctctgtgccaaaaagaagcatgatgcacaatacttgaggctgtttttttttttaatttgcctttcctcctccaccaaatggaaaggccctgtttcctgactcc

SEQ ID NO: 214038 - DNA, 1057 bp, Homo sapiens
atagaaaatttatttctgttaaagattgagttttgggaaatagaattttctgatttaagaaacaagggactatttccaagattaattcctcatagatcagtcatttttttcctcagaaggataacacctactgagaggcaggttctaactgtggcttagatccaaagatcctccctcatgcctccctagaggacctgtaaaggtgacttgtggaaagaacagatatgtctttatgtatgtaaagcaagtgatatctgatttcaaagaagacaaaaccaaaagcttatttttttaatgataaggaattcccttcaaaataattatagaactgatgtccctagcccttccagtatttgcattccaagtgtagttttcttgtcccacctagataagactaaagcagaaagttttgttgcatgtgcctccactttccagcagttgagcaagtatgtacctctctttacgctctcttttactccagctattgatctctgggtactgtgatccctgggtactgtgcttggcataaagtgtatgccgttttattttgtagcaattacttcacaaaactgcagagggcagcagagagctgctgatagatttataatatggacataagcttgccggagtgagagtcttggttttccccctgtttgtctgttgagcacatgcttaccataggattatttaaatatgagattattttttaaatgtatttcatgcaagtttttaactatttaataatgatagatggggtatacacttataagctcaaagtcaagtgtgtttatgttgtattcactgacctaaagtaaaagaaataccctactcagccactgcattgtagtctgctgaagagtggtttatttataagggactagagaagcactttctaacattttgccatgctacccaggattttaaattatatcagttgaagttctctagcttggatttttgggttttttggagggtggtttttttgttgtcaattaaaaaattatattcaagctacttctaatattttaagaaagtgaatcaatccatttgaagctct

SEQ ID NO: 214039 - DNA, 395 bp, Homo sapiens
gtctctgtctgtctcccaagctggagtgtagtggcgcgatcttggctcactgcaacctccacttccggggctcaagcgattctcctgccttagcctcccgagtagctgggactacaggcacgccccaccatgtaaaaatatatttttaaaaaattttatatttttattagagacggggttttaccatgttggccaggctggtttcaaagtcctgacctcaaatgacccgcccacctcggcctcccaaagtgctgggattataggcatgagccacctcgcctggccattgtgggtatgttgtgtcattttgtggctggtctttgtcttcccaggtagactgtaattaaacctaaggactttacctatttgtttctcacttctctcttcccagtaca

SEQ ID NO: 214040 - DNA, 258 bp, Homo sapiens
tcccttacgttccagcagggagtcaggaggaccaacagcccctgcgacatcgggctgcatggccacaaaataaaacaaaacaaatgtggccacatcagtgaaagaaatcactgaagccagtctggtgttggacagagaaaaatcactgaaaattgactgagccacttggaggtgttagttgacttcatgtatttatttatatccagcttgctcctaaaaggatacaaagtcacgtaaagactattcattcatgcacct

SEQ ID NO: 214041 - DNA, 331 bp, Homo sapiens
ctcccatcagacaggtctcttgcctcatccctcaaactcactcctcatttccccttaggtctatcttaaattaggcaaagatttcttaggtacaccaccaaaagtacaatagataaattaaaaactgatcaaaattaagagcttttgcccttctaaagatactgttgcaagaatgaaagccaccgggtgggagaaaatatttgcaaaacataactggccaagaacttgctccagaatatataagcaactctctaaactcagtaatagaaaacaacccaataaaaatgggcagaatatttcagtagtacttttactaaagatttctacatgg

SEQ ID NO: 214042 - DNA, 1230 bp, Homo sapiens
cacttttcagatgtctctctctctctctctctctaagagctgctctcctctctcctttcttctatctattaaattttccactccctaacccacccacatgtgattgtgtcctgaattcttggtgtgtgacgatgaaccccagggtgtataccccagacagcacagccacttcaccagcagggacagcagctgtcacatgaactggagatgaactggaggtgagtctgatgtctcggaattttgaggaaagtgggtagaaagttgccaagcaagctgaagagacaagcaaaagggatcatattccagaagaattcttagcaagaccacagtcagaacttcaatcaaggtgattgattggtctgaaagggggaatagaatgtaaataaaatacaaccatgagaaaccacatgtatgttgttgaaccttatctagacactaactgtgaaaaagccagcttggattattgatgaacgacattcagaaaaccacaattttgccatgcttatttagagaacagagacagtggtattatcagcctatagctcaattgtaaaattgggatgactagatgtcccgagactattctgttcctcggccctctcgacactcacctaagaagcttccaaatttaccacttctcagtcattgtaaggatgctgcatgtcataaggatgattatggaagattatgggcatgttctacatagagaacaagaaaagtcacaatattttcttttataaatttatattttggaatttatattagttcccctaactctaaataaccatgggaatattgacaaatttgattttccagaactttaaagctgaggctagacactaaccacagtgactttatctatgtagtagcacactctaccagctgggatgtctggataacaagttccccagattgcagcctccctccagcaccaagtaggattacgagtctgtttggtttcattttagctatgtagatttgtcaaattttgtcacctctggacttcagttttctcatatgtaaaatgatgcattggcctgaatgttttcggagaaccttcaatctctgtgagtctcttcactgaaaaaattgttgactttcttttttttattgttctgtttttcttttctatgtcaaaaaagcactatggtaaaagtctttcagtaaaacttgaaccttggggcttgttcctgagtttgacatgttaaacaaatgaaagaactgttttca

SEQ ID NO: 214043 - DNA, 183 bp, Homo sapiens
ataaaacctttaaagtcggtagtggaaagattaagtaggacttccaagaccactgaagatgttgtattttatcttgggatcagtgggaatcaattagagttttaattcaggggatatgcattacaaaagagatcactgggtccttgtgaggggaatgaatgagggagagacagtggggatagc

SEQ ID NO: 214044 - DNA, 164 bp, Homo sapiens
aataatttctgtcatatctgttgaactcacagatgtttggtgtggatatagtgtgaaccaaataaggacctttgtttcatgccagggtcagtagggcaaaggaaagtttctcagggaagacaaaattcaaaagaccatcacaacttgatattcaagaatggacc

SEQ ID NO: 214045 - DNA, 508 bp, Homo sapiens
gggctgcgggacagtgggtgccatttacctaagccaatcgccccggcagccaaaggccaagctgcatcacagcagcttacctctttctcccgcagactctctggaccatcacccaccttctctggagcccaaacatccaatcaaaccaggtcgtaaatatacaggtagtccccgcttatgatggggctatggcaggataaacctctttggagttgaaaatatcattaagtcaaaaatgcactttcaacttacgatgggtttgttgggacataacccaccatctgtcatactaaagatggtacaaactcttcctatagactcagccacttgtctcgctggggccagcatggcagcagggactggtcagattggggtcagagaatttttcctttaaacattaagtgctcaaggcagaaaagacaacatattgaaaacttggagagactgaaaaataaagcactagcatggctctagcattttaagcagcaaatcagatttttaaaaaata

SEQ ID NO: 214046 - DNA, 461 bp, Homo sapiens
gttgctgttcctgcctgagttcagggaggttccagggtaggatttagtagcagagggcatggagccatctcaatgtgttcagctctaggttgcttgactggctgccatcactttttgcctcctgctgacgtcacacacacatatcttccctgttgctcctggctggcaggagagctaagggcagctgcttccaggtgtgaccactgttgagccaagctcctgtcacagcccttattgccatgtagaagcagcttctactgaagttaagcccaaggtaacacagatcagccctctgtattacttctccagggttgccagctcattttaacccagactggtcaaaaattaatatcccatcatttcagcttgcaaagccattcaacactaggtcaatgtgaattcaatagaatttcatatcacttacaataaagactctggcttttttgaaagtgcatacagaa

SEQ ID NO: 214047 - DNA, 456 bp, Homo sapiens
taaatgaagagaatgatgactacttcatagcattgttctggaaatgaaatgagatgcactgcatatcacttttaaaaggcatttagtaagtagttgtcctcaacttttccctctcattttgtttctatatgtacaatttgaaagatgcagaattattttttaagttgttaaataatatcattttgtgtcggtgtgagaactgctggtttaaaaaacgttttcatatgtctcaccttatttgctgctgccacactaatttgagttaggtaagataattatttactattcttctttcagataaggaaattaaatctcagggagataaagagaagcaagtgtctagattcataatgccttcaacagcacagtagaaatgggagggaggtagtgacacatttcctgtgttgtggtgtttagtggagacacctcctccctgggttgtggtgtttagtggag

SEQ ID NO: 214048 - DNA, 692 bp, Homo sapiens
ccagtcctgagctgggtgtgaagttaggctggtgtctgaagtttcttccagtgttgtgagtccaagatgcagatcttgggtttgaatcctgtctctactctgcccgatttcatctctttgattcttagttttttcatctataaaagaaggactctttctggatagttgggagggctgaaggaatgtttgacacatcataggtgtttaaaatggcaactatagttttttttgtttgttttgtgtgtgtgtttttttcttaactttcattttaagttgcagggtacacgttcaggtttgttacataggtacacttgtgtcaagggagtttgttgtgcagattatttcatcacccaggtattaagtctagtacccattattaaagaaaatgtggtacgtatacgtcatggaatattatgcagccataaaaaggaaggagatcatgtcctttgcagggacatggatggagctggaggccaaatattatccttagcaaactaacacagggacacaaaactaaatactgtatattctcacttataagtgggagctaaatgatgaaaacacatggacacaaagaggggaacaacacacactgaggcctattggagggccgctacgagccgcctcccctctcccccctctctcctcaccctcgctcccctcttctccgcccctatcctcccttctttcct

SEQ ID NO: 214049 - DNA, 830 bp, Homo sapiens
ggcttcgtggagctcactcggtctgagaggtcggaggctgcgagtgtcgctgctgaaggctgtggtggaccaggctggatcgcggattctgagctacatcgcgggtttggtggtggatcttggatttgggggtggatcgcgggttgtgggggggatggcggatttggggctgggtgggggtggaaaggccacgaggagccgcggcggctcaggagcgggtggtgggcgtctgaaaagtcgccaccatgaggaagctcttcagcttcgggagacgcctgggccaggcgctcctggactccatggaccaagagtacgctggtcgggggtaccacatccgggactgggaactgcggaagatccacagggctgccatcaagggcgacgccgcggaggtggagcactgcctgacgcgcaggttccgggacttggacgcccgcgacagaaaagacaggactgttctacatttgacctgtgcccatggccgtgtggaagtggtcaccctcttgctgagcagaagatgccagatcaacatatatgatagactaaacaggacacctttaatgaaggctgtacactgccaggaagaggcttgtgccattattctcctggaacatggcgccaatccaaacattaaggatatctacagcaacactgctctccattatgctgtgtataataaggggacttcactggcagaaaaactgctttcccaccatgcaaatattgaagcactaaacgaggagggaaacactccacttttgtttgctataaattctaggagacagcaaattgtggaatttctgttgaagaaccaggcaaatttacatgcc

SEQ ID NO: 214050 - DNA, 710 bp, Homo sapiens
ggcttcgtggagctcactcggtctgagaggtcggaggctgcgagtgtcgctgctgaaggctgtggtggaccaggctggatcgcggattctgagctacatcgcgggtttggtggtggatcttggatttgggggtggatcgcgggttgtgggggggatggcggatttggggctgggtgggggtggaaaggccacgaggagccgcggcggctcaggagcgggtggtgggcgtctgaaaagtcgccaccatgaggaagctcttcagcttcgggagacgcctgggccaggcgctcctggactccatggaccaagagtacgctggtcgggggtaccacatccgggactgggaactgcggaagatccacagggctgccatcaagggcgacgccgcggaggtggagcactgcctgacgcgcaggttccgggacttggacgcccgcgacagaaaagacaggactgttctacatttgacctgtgcccatggccgtgtggaagtggtcaccctcttgctgagcagaagatgccagatcaacatatatgatagactaaacaggacacctttaatgaaggtatatagtagccaactttttcagcatgaaatggatttgatttaaatacatagaattaaaatgaatttatctcatttaaatataactagttggtgaaacctgtggaatatgtattttgaattcttagaatttatagtctagttt

SEQ ID NO: 214051 - DNA, 479 bp, Homo sapiens
ggctgccccccacccccggcccatgaatccaacactcttagagaagaggcagcagcacagggagtcagggaacccagatgctgggaagccgggtgacctgatggccacctcggaaaatgacagcctggcagatttgtgtgtaagagctcttccacccttgctggttggtacttgggaactctgatggcactatgcatggcatctctggcatactcacaccaagccctgtaaagctgtcagaggtggggtttatgggcctcatgctgcctcctagagcaactgtggccatagctagctgccctttatgagtttacaaagggctgtccccctcctcctccagggagcatgtctgagctggcgggcagcgggccaggggccaaggctggcgtgcaatgtctgggctgcctaacttttgccccacactcctatccaagctactgtggactcttctgccataaatgacagtttgtctccaagtg

SEQ ID NO: 214052 - DNA, 311 bp, Homo sapiens
cgcctctccccacttaggcagagctgggcatgatcacctagactagtactcccacacacaggagtcacacttacacagcagcagcagcttgtgtttacttctcatggcctgagaatcattggctggttcttctgtcttccacactagactgtaggttgcttgtggcctaggcagtgattttctctccagttctctggtacctgaccaagtgtgtgctgtgctaggtactcagtagatgtccctacggatgtgtgtgggcagagacagttttggtgatgtatagccacttacctttgaaacctttcagaaaa

SEQ ID NO: 214053 - DNA, 612 bp, Homo sapiens
ctatatatacctattaagcatattgattatatgattttcatttactgtgtccttatttttctgatgaatttgacaatttgagccaattttactcaatatacctactataattttggatttttcaatttacttttgaatataaaaacttttgattcatatattttgatgtgtgtaactgtatataagctcaagactactacatcttctggacagaataaaacttttactcctataaagcttccttagaaaaactcttctttgttttattttatgctctttatcctaaattccattttttccccataggattgccactcctgctttctttttgtttgcctggcatttttaactggaaatttcacttattcacattaattgtaatacataatatatgtgaatttattcttataatttttattttttgtttgttgtaggttcttattgcccttttcttcctctttcttggattaatcaattttctgggccgggcgcgttggctcacgcctgtaatcccagcactttgggaggccaaggcgggtggatcacgaggtcaggagatcgagaccatcatggctaacatggtgaaacctcgtctctattaaaaatacaaaa

SEQ ID NO: 214054 - DNA, 290 bp, Homo sapiens
tcccaagttgatcagactcagggaggctgactcactcttatcaagctcctcagagtctgactcgtaagctggaatgccaatgtcctccatctggggtctgcttttcctgccgtatttagatttgctgaggaaacataagaagcagagccaagagggatgaataatttaaagagaaatttcttatagaacctaggacctagtacattattccagccagaaacatgcatttctttttcattcaaaaacaaatttttctttttcttcccaggacagtgctggataaaactgcc

SEQ ID NO: 214055 - DNA, 354 bp, Homo sapiens
cattaatgttgaacataaatgatctaacttaaaagatacagattggcaaaatggacaaaaataatcacaaaccaaatgtctgctgtcttcaagagactcaccaaacacataacgattcttatagactcgaagttaaggggtagaaaaagatattccacacaaatggaaaccaaaagtgagcaggattaactattcttagataaaccagactttaaggcaacagcagtaaaaaaaaaaaaaaaaagacaaagaaggtcattgtgctaaaaggaaagtgtataatgctaaatgccaacatcaaaaagtcggaaagatcataagttggaaacctaatgtcataactcaaggaagtag

SEQ ID NO: 214056 - DNA, 220 bp, Homo sapiens
ggtaagctcaaaaaaatctgatagttcttgtgttcagtgccaactaacaagggttaaaaataattgaaccaagttttgacaatattaccttctactttcttcaaaaatactgggttgatgtcatctggtcccagtggtttatttattacccacttagtcaatcaagctttgaacatccaatgcatttaccaatagcagacctaaaacctttaagccatct

SEQ ID NO: 214057 - DNA, 490 bp, Homo sapiens
atgtgacagtttaagggaggttaccaagaaaaattcttccatacccaagacaattctcccactcacacttccatacaagcacacaaatgacctcatggtttttgaggaaggtcagctcatgtttcggagtctaataatgcctaaagcaagagcaaggaggggtgttgtggctgtcagaggcatgggaaaccacagcttgttcaggaatcctcaaagggcatgtgctggagcttttcaggattgaggaccagaatccacatggtcgaagacaatctcaattttgtatatctttgtagctttagggttttgaacactttagcttcccaggaagatacatgagaggaaaggttcgcaacaagtattgaatgaattaatgtatgaaatgaatgaattcaattgtttccccatccatgataagtacaaattacttcttcctcgaagacaacctgatgttgatgtttttgaggtcaggcagcccctttgtcattta

SEQ ID NO: 214058 - DNA, 662 bp, Homo sapiens
ctaatattttcactcagtctgttcaattaaatgggcgataggtcttccttgatcatagaaattgtttccactggtcatgggaattaaaacaaaatactcgtcaaatttaaacaaatttggagcagcacttaacaaaatttagatggactgccttccctagcacccatggtaatatttttatttgaaataattaatcaaaagttttttttatgattaactgtactcaaagtattcagcacacatggtagattttcaaaaggaaatcaaatctccatgtatttgataaatgtatatgcatttagtgctttaagagatttactgtataaagagttattcccataaaaatattttccccctttaaggaacttctctataaaatataaataaaaaatctaaggtagccaacatattatttatatacatttgtatatatataatatttccatatatataattttcatatatatgtatatatggatttccaaatatttcttactctaaatgagcactgtgagaaagatatgttagaaaaagggaagtattgccgggtgcagtggctcacgcctgtaatcccagcactttgagaagacaaggcgggtggatcacctgaggtcaggagtttgagaccagcctggccaacatggtgaaaccctgtctctact

SEQ ID NO: 214059 - DNA, 416 bp, Homo sapiens
catattattcaatgactaatacaaaatacggttctacctcctgtttgtggtaaagctactcatgggttttcctgtgaattcaccaccatataaattgtgataattttaggctggttttaatgttaattatgactttcaagagaacaactaaaagtttgcagtatgaaacgtggcccctgcaccagcaggaactgcagttaagttggctttcctttgaagtcagcacaaatgataactgtaaaacagtcagtttctctggcaggtctaatttgggatgtatattaaatagaaggtgcctttaaaaaataacaacttccattctatataaaggcttaatagctttctctagtcattagatgcaatttaaaacccagtaatacaatgcaatttaaaacccagtaataactttaatgatg

SEQ ID NO: 214060 - DNA, 731 bp, Homo sapiens
tgatttattttttcctttatttattttccccatcacaaatttcatacacaattctgtgatatattttaaagcaaccttgcttttattattgaacaaaaataattttcaggcttaccttaaatttttttttaacttcacaacatagaatcaacccctttccagagagttttgattcctttggtagagaataatgcaaaggacccacttctaggactctaggtgcacatgaggttgtagaggttgtagtgttcataagcactgttgctgtcatgggctactcttagtgactgagttggaaagttaattttttcaaggttatgagttcacataagggtgctgtatctaacttttcttagaatgcttggttttattgaccattaatactgtctcctacataaatattaggaagtatttttaattacttgctgtgatcagttccattgaattatgcccaaatacaggcctggtgagagatacatgttcaaaacaattagaagataaaagttgatatttatacataacacattttgtaaaacatatataccttactttatctctttctgtgactatgtgagatggatggaatgtgatctattttacgaacaaggaaactaaggcacacagcagaagttaagtgactcattagggtcatgcagctaataagtaaaggctggaattttaacctgtatcttcagaatctaaatcctgtttattttccactgtctgtacat

SEQ ID NO: 214061 - DNA, 493 bp, Homo sapiens
tgaagtaggatgcaaggttcatattatctatgaggactgtaaaaatggctccactgaccttgagcttattcgctcacaatgcatgccagttagatatgggtatttagcatgctgtattttaggaatattacatcaaatgtggaaatacggaggcacatggtaaactgtcacgtactatacaaatgatcattgtgatgacattttcttaaaatgggttatatgaagtataaagaattgagaggctgactattgccagcaattagtttagtatagccttgtttattaatctatggccagatgtggtaccttagagcctatagatcttactgtgcacacccatgaccttcagatgttcgtcgggagacacaacatagagcctggtcttggtgcttgaggaatctgggatgtcatacctgactctttgatgcattatttggataccttaatctctccaaatttccttgtttataaaatgaagatgtaaatgcctcaa

SEQ ID NO: 214062 - DNA, 349 bp, Homo sapiens
ccaggatggcgtgttggtgcattagggaccccttcctctcctgccctgctgtttaaattgttggtctgttggcgttctcaggagccctttaccagtacccttaggccccagacgacctactcctcaagctgatcatatctgctggctgtgtccctgctctgggcccagcaccctcatggttttccataacacgtatcccaactcctgctgatgggaccctcgtgagctgtctgtgtagggagcatggctgcccctgggtctgctttcctgcccctgacccacaggaataggatgtggcagagtgggggccagatgacagagatgctggtgctctctgagctgaggccca

SEQ ID NO: 214063 - DNA, 459 bp, Homo sapiens
gaaaatcaaaattcaatactcaatgaagaaaatagtttatataaagctaaaaaaaaaaagagctccataaccttattatattttaagttatctgaggaaacctcatctgaatctgcagtattaaaacctaaggacactgctccccctgcagactctggctttatcgcccttgtcttcccaaccaccagcctggagagggagcattccttcttgatttgcattgctgcttacacaccattgagcctctgtggggcacatgccatcaaattatatcatatgttcccctcatttttacagtgatccccatgctccctgtttttcccctttatttattgaagattttgatacctgccttgctgtatttctctctaaaataatttatattccttttttgatgatttcaatacctacctacataatgaattcaacatgctgacttctttatttcttgtcccccat

SEQ ID NO: 214064 - DNA, 633 bp, Homo sapiens
tattctcccccacttgacagatgggtaatctgaagcttagagaacttgaatggcttgtccaaggtcacacagcctgtacatggtgagccaggattaaatccaggcagttacctgtgccagatggcctcaaaccaaacaactgcgctgctccatgcatgccttgctttcttgtgcctctgttttatttgtttgtttgtttgatgcttgagatagggttttgctctatcacccaggctggagtgcagtgccatgatcagggctcattgcagcctccatctcctgggctcaagtgatactcccacctcagcctctcaagtagttgggactatgggcatgtgcctcggcacgcagccaattttttttttttttttttgagacagtcttgctctgtcgcccaagccggagtgcaatggcgcaatctcggctcactgcaacctccaactcccgggttcaagtgattctcctgccttagcctcccgagtagttgagattataggtgcatgccaccatgcccaactatttttttgtatttttagtagagacagggtttcacgatgttggccagactggtctcaaacacctgacctcagatgatcagcctgccttggcctcccaaagtgctgggattacagg

SEQ ID NO: 214065 - DNA, 460 bp, Homo sapiens
atttgtaactttttgtgactggctgatttcacttagcataatgtcctcaaggttcatgcatgttacagcatgtatcagaaattccttccttttaaggctgaataatattatattcactgtatggaggtatgtattttaaatttgcagacagatattctgaaaatatccttctaaaaggtgataaccttcactcccaccacagcaagtaggtccaaccgcccttcccccaccctcaccaatcctgcctactatccagcctcttcatgttgccagtttactccatggaagaggaatctggttattgttctcctttgcatatataagtaagactggtcaccgtttcacagatttattggcgacttttttttttttttgttccacctgttatctttacccactgttttctttggggctgtctttttcttagtaatttgtatgcgttcttaataaattaagaaat

SEQ ID NO: 214066 - DNA, 334 bp, Homo sapiens
ctaatttattttcaaatctgcttcagtggtggtagtgggggaatttgcaacaaagtggtgagatgcaacaataaccattgcctctttgcaactctgtgatcaaaaccagcaattctttcttttatttttaatttattttttatttttttttgagaccgagtctcgctctgtcacccaggctggagtgcaatggcgtgatcttggctcactgcaaactcccgcctcccaggttcaagcgattctcatgcctcagccgcccaagtagctgggattacaggcgtgagccaccgcacctggccaaataaacaaatcttgatggttaatgttagagata

SEQ ID NO: 214067 - DNA, 173 bp, Homo sapiens
tgctgacatcactggccacactggtcatttctttatctctcaccaccacctttcctgctatgctgttccctctgtctggaagacccttcccctctgctaactcctactcagacttcaggatcccagtgtaaatgtcccttccttggagaagccctcctgattccctctgacca

SEQ ID NO: 214068 - DNA, 181 bp, Homo sapiens
caatgaggaattgagccaaggtaacaacactggtgaggaaaggatggagcctggatttgaacccacgctggtcagattcaggagccacgctctttctgtaacccctgaaccctctcctagcattacttatatgatatgtctccatacccattacaatttccagcattccccctcaacccta

SEQ ID NO: 214069 - DNA, 466 bp, Homo sapiens
tacatgtttgataggatttaccagtgaagtcatctgaacctagagggttttctttggtttggtttttgtttttgtgggagaattaagattttttaagagatattttcagatttttctgttgtcggttttggtaatttgtgtcttttaggaaaatttcatttcatccaagttgttggatttattggcataaaattgttcagaatattcctttaatatccttttaatgtctgtagaatctaatctgtattgcagtctcttcatattggtaatttgtgtttttttccattttttcctggctcagttagtctagctggaggtttatcaattctttataagatcatttattttagatcattaatgatcttttaatacagggttattcaatcttttagcttccctgggccacaatggaaggagaattgtcttgtgccacacatagaatacactaatgataagctgatgagcc

SEQ ID NO: 214070 - DNA, 107 bp, Homo sapiens
tgtcttcacggctgattcctagtagtgatattgctagctcaaaggaaaaatgcatttgtgcttttgagggattacaggtgtgagcaaccgggccttgccccgggaat

SEQ ID NO: 214071 - DNA, 363 bp, Homo sapiens
aatctaaaaattgttccccaataagcctaatctccaaaacaatttctaagatcctaaaattttaagagctaatccagccaaccaagtttgatttgcaggacctatgagaaatcaagactaaaagaataggtttcatccaggaaagttcttataaaaactgtttcactgcacaagcatcagacttctttatgacactgatggtctcatcatcaacactagtaaaagaactgacaggaaaaaaaaaagccctattttagaagctgacctcaaaattcactatcctattactcttttagttgttgttttttgaaacagggtctcactctgtctccgaggttggagtgcagtggtgctgcaacagct

SEQ ID NO: 214072 - DNA, 582 bp, Homo sapiens
cacttaagcaaatacctctgaccccataattctaattaatgtatatcattaagtgaatcacactgactttactctgaatttccttgacagccatgctaaaatacttaccttggacataagctaagctttaagtttgttgtttataacttcaaagagagacaagggacagtgacttaagaatattctaagctataaatttacatgtggactttgctacacacctgggatgcagccagatgagttttgttccattgcagtacatctgatgaccagaattctatcagagaatgttaatgaacgaaaagcctgagctttaagactgagattggtaccacgggtagtcatggccacctgctggcagcgtagggtactgcagcccagctatggttcagactaaaagccgagaaacgcctgtggtccagggaaaggtatgaagatcatataaaccggcggtggacaggaaatgccacagtcaagaagatgcccctgggatgctgagctcttacaactcgaaatcaacagcttttacaaataaaaccgctgcaaaagcaatagctcttacaaataaaactgataatttgg

SEQ ID NO: 214073 - DNA, 830 bp, Homo sapiens
actctgttgccgaggctggagtgctttggtgtgaccctggctcactgcaacctccgcctcccggattcaagcagttctcctgcctcagcctcccaagcagccgggatcacaggcgcccgccaccatgctcagctaacttttgtatttttagtacagacggggtttcaccatgttggtcagtctggtctcgaattcctgacctcaagtgatccacccgcctcagcctcccaaagtgctgagattatagtcgtgagccaccgtgcctggccaggtttgcggttactagaatgaggcaaaagttgggagctatttccaaaatggaagactggaagacagaagaatacctatgaacttaccttggacataagctaagctttaagtttgttgtttataacttcaaagagagacaagggacagtgacttaagaatattctaagctataaatttacatgtggactttgctacacacctgggatgcagccagatgagttttgttccattgcagtacatctgatgaccagaattctatcagagaatgttaatgaacgaaaagcctgagctttaagactgagattggtaccacgggtagtcatggccacctgctggcagcgtagggtactgcagcccagctatggttcagactaaaagccgagaaacgcctgtggtccagggaaaggtatgaagatcatataaaccggcggtggacaggaaatgccacagtcaagaagatgcccctgggatgctgagctcttacaactcgaaatcaacagcttttacaaataaaaccgctgcaaaagcaatagctcttacaaataaaactgataatttgg

SEQ ID NO: 214074 - DNA, 511 bp, Homo sapiens
tgagatctagctcaatatgcccttttaagtagtcactagaattatttaataatgcagaatatatttttggtaaaaagatttgatctttttgtctgtttttcaaagtgcaaatttcctcctgaagatagacaagtcttgggtacgtttttgtgagaacagaccctttgaatgaaattttaaaaccatcagaaagtcataacatgtataatcaatagggaatttcttgctgtctaagaaaacgataggaaagaagagttccactctctccagtcttctttgctaagtctcatttctctacttgtgcatttctttggagaataactgcttgctgacttctactttcctatgaaacttttgtgaagaatggtggaaatctttgcaatgacagatgccattgcagattattatgatgtccattacttggagaatgaaattaggaagagtttatttctgacatggcacatacccttccctgcaacagaaagactgtagcctagaatctctgttaaaa

SEQ ID NO: 214075 - DNA, 421 bp, Homo sapiens
gcatttgctatggtaatcactagctacctgtggctacttaaattaaaaattcagtttctcagtcccattagatacgtttcacacgtggctagtgcccaccataagggagagtgaagatgcagaacatttccatcactgcacaaagttctattccacagcactgctccgaaagcagggtccatgcctgtcctgttctcgaatcagccaggcagctgcatctgccgagtacccattaaggtcacgggctaagttctatcagactcagcttctgctttctaaaagactcattgcagttccccgggtttttagtcttgattatacctcccagaagttgtctgctccaaaggtcaacagttcagcaggaagcagagcccatgcctttgagaggctggaggtattgcatactcccaaaaatcccagc

SEQ ID NO: 214076 - DNA, 401 bp, Homo sapiens
gcatttgctatggtaatcactagctacctgtggctacttaaattaaaaattcagtttctcagtcccattagatacgtttcacacgtggctagtgcccaccataagggagagtgaagatgcagaacatttccatcactgcacaaagttctattccacagcactgctccgaaagcagggtccatgcctgtcctgttctcgaatcagccaggcagctgcatctgccgagtacccattaaggtcacgggctaagttctatcagactcagcttctgctttctaaaagactcattgcagtctttgcctcctgggttcaagtgatcctcctacctcagcccctcaagtagctcggattacaggtgcgcaccaccacacccagctaatttttgtatttttagtagagac

SEQ ID NO: 214077 - DNA, 432 bp, Homo sapiens
ggcaacttcctgggagctaaggctactaaaaggtagaagccacagtactcatctgcagagggcttacagcctcagcaaggaccttgtggctttgtaacaacaatcagccataacaagtttacttgtggaaaagaaaaggtgtagcactttcagaagaggctatcaaagaaaagagatgaacttggaagcaagagatacgcagatgagaaaaccaaggcacagaggtgttatgtgatcacacagctagtaagtgctaaacatgagatttgcacctggcagattggtgccagaagtcgtctcttaactgctattctgtactgcctctgtcttttgaaaaagacaatgagaaccctggaaaagtgacaaggaagataaagacaactatcaaaggaatgggaaaacagcataacatttaaaagaaaagatttttgt

SEQ ID NO: 214078 - DNA, 1229 bp, Homo sapiens
tgtctgtccatgtctgaacttattgcagaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctctacggcgtgctgatggaagtggaagagcctgaagtcttacaggactcactggatagatgttattcgactccgtcaatgtactttgaacaacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacc

SEQ ID NO: 214079 - DNA, 244 bp, Homo sapiens
atttttttctttttttttttttttaaactggaagaggatgcacaggggaagaaattgaaaaaaaaattttgttggcttttgtttacctggcgtgtgtggcagccggctcgctccctctctctgcttgctatccctgacctttctttctttttgctccttttcaaaaaaaatattaatttcccccttctgtgcaatggagcatggggggggggaggagggggaagggtttgagaatccacccaag

SEQ ID NO: 214080 - DNA, 651 bp, Homo sapiens
tcagcaaaaacaacagaccttcattcagcttaggaacataataaataggacgaagttgaataaacgaaatggaggggagtgaagtattccagatggaagaggcagtacgtggccaagaggaaacagaccatgtgcgctggagaaaaaggatggccagacttgcagaaacctggaattggtgattggctttagaagtggagagacaaaaaaggaggcatagaaagtgccaacatttggctacacagggaagaaagacgtaaaataataaaaacattggcatcacctgtagactcaaatcctgtgagtgaaggacctgagcaatgaaggatggattgaactcgtgattagccttcttcagcatatgtaaaatgatgtctgcttttcttctctatttgtcattttaccgactttttatatatagtagtttccccatatccatggaggatgtatcccaagacccccagaggatgcttgaaaccacagataataacaaactctatgtatcctatgatttttcctgtacatccttacctatcataaagtgagtgtataaactaggcacaggagattaaaaacaataactcataataaaatagaacaattagtacaaccttccgaaaaaaaaagtctttcaatataataggacctcca

SEQ ID NO: 214081 - DNA, 578 bp, Homo sapiens
ttgaatgttagtatcatcaaaaagaccttcacagaaacatctaaaataatgtttgaccaaatgtctgcataccatggccaagccaagtttacacataaaattaattatcacacatcccacgaacaccatccccaacagatgctcatgagcattgtggttatgatttcaacttcagaataaggcagaaatgtgtacaaatcctgaccctttgacttatcagctctctaaaaatcattatatgtcaactttctagactttacctgaaaaacagaaaccaagatacccacagcataagattgttaggattgaagaaattgttacgattgttaggtatgaagaaatttaaacaatgatgcagctgagatatttagaattgtacctggcatgtactttgtattaaataactaataaggcctttttctggtgaaaacaaaataagcctggataaaagaagatgagaccagattggttgatggctcggcctgggtgggctcctggcccatctgaaattacattactcttatgtagtgccttttttgttattgctaaaataaaataaataaaacactctactttca

SEQ ID NO: 214082 - DNA, 498 bp, Homo sapiens
ccatttttgtgttttaattaaacaagtttggtgctgtcacagatgctgttcattgtcaacccaatggccattgtttaacccttttcccaagcaggtagaatctttctcctgcaaagagactgaaaatgctggatattcactcttccaagcccccatgacttctgggggtggccatccaacatcattctagccaatgcaagtaaaggggatatttctcaggggtgctgggaaacattttcttccctgataaacagaccgacaagtagagttatcttgtcacatgactgggctcctttctttcttcgtttgagcatgatgggatgaggatgtgattcttggagatgctgcagccaccttgtgatcatgagggagaatcactggcatactgaagatggtggagcaagagcatgggaaagcctgggggctttgagaccaccaacctctcaatttcttattatttttaatcttaataaacccctactgattaagcttctttca

SEQ ID NO: 214083 - DNA, 459 bp, Homo sapiens
agaatatcatagtgaactctcatgagttcctcactctgcttcaacagttgtcagcccatggtaaatcttgttagacatatttgtattataaaactggaaataagctagatgttcaactctagagtgctgtgttaagtatagtacgacatatctattagatagaattttgagccagtaaatgtttatgaagaatctataatagtatgaactatttatactatatattaagttaaaaggcagcatacatagtaatacatatggtataatcccaccttttttaggatttttaagattttttattactctcctatattttctaaattgtatatcatgaacatatcttaattgggaaaaattaatatttctctaatattcagaaaaatatgaatttcttcattaataaaggcagcttatttacctagcctcacagagtaagactccatctcaaaaaaaagaata

SEQ ID NO: 214084 - DNA, 380 bp, Homo sapiens
tctatgcatggagcaagtcctatcagtgttaccccctaaaggagtctctgaaatccaagcactttgctgcacccccattgcgaccatctactccaagctatcatcatgtttcatgcagacttcagcagtgatttccaaactcatctccattcgttctggtctcctctccacactgcttctaaagtaatctttgaagatgctaatctgattgatcatgtcatatgttttgttcatttttccctttcttttcttcaccaagggctttaaggatttttctaagatgttcaagtgcttcctactaaaaaatctcccacagataataattataaactctgggcaaaacactaaataaaagagacttaaggcaggtgaaaagtgaa

SEQ ID NO: 214085 - DNA, 729 bp, Homo sapiens
gagccactgggcccggctgagaaccattgttttaaagaactgacttgaggagaagcagcaggatgccaggagaaagtcatgagatacaagaaggaatgctaagcaaggaaaatggtaaatgactaaaactgaaacaaacatggactgtataaaatgataaaaatgattataaaatcgagagtagaggtaaaaatgatatctacttgttcttgtttattagaaaatgtgtaacaatgtttagctgaagtaacatgtaagccacaaagggattgatttgagctaaggaattcaaagatgtctgtgttatttgccagaaggacagaagattgattatcttttaagtatccttgttaacacttaaggacaactactgcaagaatagaaatagaggatttaacttcaaaaccggtaaagaggaaataaatgagctgggagaaatcaccagttcaaaagacagcaagaaaggagtaagagtaaaaaatgggttaaatagataattacagaaaaagattgtagaatgaaattcaactatattgataacctataattaattaaaaggactataacattcctagttaagacatagacagtcaaactagattgaaaactaaaatctgcttagtatagaatagtagacatgaaaggtatagtctattcacaacaggcattactaatacctagggatagtaggagtgaaaattaaagaatggaaaaacatataccaggtaa

SEQ ID NO: 214086 - DNA, 362 bp, Homo sapiens
gtagacacgggatcttgccacgttgcccaggctggtcccaaactcttgaactcaagtgatctgcctcccaaagtgctgggattacaggcataagccaccgtgcccagcctccactgctttctcctggcaacctgttcttgctccttttccccacccaagaggaactatctctgtagccccatgagggtgaaagggttccctggaagcctgtccccccagccaggcccctaaataccagctctatctctggccatacccacaaagggcagcagggacacaggccatcccgcagcccttgtgcataccccaggaaggggtgtaggagggaagaagaaatgtgatttgggcaaagcaggcctcgg

SEQ ID NO: 214087 - DNA, 717 bp, Homo sapiens
gccagcatcagtcggaagggtgggccccaaaactccctggatttgagcctcttaataggcaaaactgttttcatataaaccccaatcaacatcatatgctcagattcataaagaaaatttcaagtcattatggtttatttctgctaagtaggaagaactactgaagatcctttaaaatatattgtatcatgtatacattattggatttgattctggaaaataatatattctagttcataatcccttgcttgcaaattgaaagcttttttcttagcaaatttggcagcaaaacctgatctgatgtgagaggatttatcttttatttaaaagtttacttggtgtaactattcctttgtttcactgcagaaatagaatatgtttcattatatggtgctgtctctaactccacaaaatgtagggtaatatatgatacagttaataaagtccaaaaaattctgaccttcaaggcatgtctggccccagaagttttggataaggaatctatattccattataacactcacccaattctattatcttgagatgtaatacttccataatgtgtgggctttgaagtatccagcaaaagcaaagtcacagaaacacaattagcatgatttgagcatttggaagtaatataactgaaagctgttccaagtttcctctgatctaaagtatgcatatatgctattatactattgattttcctacatgtac

SEQ ID NO: 214088 - DNA, 531 bp, Homo sapiens
agccatcctacctaaatctatcccaacctgtcttactagttagtgaaaacatttttgtggagtatcttgagggtgggatgggttggaaattgtcacatattttaagattgaaaaggagcttaactataatctgctttgtctcctttcatgctggtgggtggcatgacgcctaggaaaggtaagtgatgtgtctgccttagcggaacattcaggagtaaaatcatgacttcctgagtcttatccagatcttcctttacttatgcctatttcctctgttttcaacatttatatattgcctggtaatcgccaatgtgctcattttatttacgtgactagattaccaatttactaagcactcgaatcatatctttgacttcttttgagctcccaccatctagcccaagtctttgaacatcataattcacagtagtattgttcactttaaggattaatgattgctgtgggctgcatttgttttcataaattgctctgggtgaagaaattgagagagagttggaaaactccaccaaa

SEQ ID NO: 214089 - DNA, 494 bp, Homo sapiens
aagaaagtcatagtgctcttagctcaatgagctatgtagtagctttggggaatatactagttgattctgatctctggcttaagaactaccttcctcaaatgttatgtatttaactcaaaattcacagacgatctccaggtaccctcctgcccctgtgccctgtcacccctccagcctccaccaccaaacatgaacatcagtattgaagcggagggacgaaaggcatttgcatataggagatgctgtctatattggtggcaggaggaaatgtggcatctaaaacaaggctgagagtcttttggcatttctcttattgggtgttagagaggcttcctcgcctacatagaaagagactttagtccaggggtcactggttccagtatacccttggttcagtttttacttttcagaatggctttctttttatggatttttaaaaattaaaaatcaaaattagtcatattttaaaaagtaatgactactttttttaaaac

SEQ ID NO: 214090 - DNA, 324 bp, Homo sapiens
gagtaatcccagggggctcccatcagcttggaatagagaactacagcctcaccttctgtggcctcaaaatctcctttctccaccccgatagaaagtaggcagaggacatgaaacacagaaaaggaaatacagatgatggggatagttgcccactgtccctcataataagagaaatgcagttttagctgctcacagcacctatgctcccagcctctcaggagactgaggcaggagggttgcttgaacccaggaagttgaggctgcagtgagtcgggactgcattactgcactcccgcctgggcaataagatgagaacctgtctct

SEQ ID NO: 214091 - DNA, 633 bp, Homo sapiens
ctggttctaacttttttctaccacaacgtgtattctaattggtgccaaataaattataatctgatgggtcctttatatcttaactcttataaatataatttcatttctgaatcccattttgtatgctttataaaagtgctatattgtccttttaatgaatgtatactcatgtaagtatgtattaagatgagtggccatttaaaaatattcatatctttttatttcttgcaaaatactctatgtcacctgctcccaaaaaaacgaagttttgctcaacaatatcttgagagattctacataacaaaggttccatgacaaaaaataattaggaaattctgagaaagctttcccttaagatgtcatatggccaggcacagtggctcatgcctgtaatcccagcgctgtggaaggccaaggcaagtggattgcttgagcctgggagttcaagaccagcctgggcaacatggcaaaaccatatcgctacaaaaaatatttaaaaattagccagatgtggtggcacatgtctgtagtcccagctacccaggaggctgaagcgggaggaccacctgagctcaggaggtcaaggctgcagtgagccatgatcttgctactcagcctgggaaacagagtgag

SEQ ID NO: 214092 - DNA, 569 bp, Homo sapiens
ctttaatctgcaatgataggctagcattatttctcttagaatttgtcttcagttggtatgcctccctctgcctttctgataggaatgtaatgataaatgatgactgcactcatttttaaaagttaaccagtttttgttcaattgaaaaagtaatgtacatggaaaaaatttcatgtttacaggatgttcagtgaaaagcaaatctccatttgatttcaactctcagtcttgctcctcagggcaactgctgttactcatttcttgtgtctccttccagaaatcttctctgcatacaaacactaatgagagagctgtccacattgctttttgatttgctttttgactatcttggggattatgtttttatcataatattccattttgggatgcaccatagtttgttcagacccatatggatgaccatttagtttatttatagtcttttgctaataaggacattgctgtaatgaaaaatccctatgtatctttatgaatatgtatgtatgtatttttatgtacatatgtgatctgtaggataaatgttttaaagtacattgcaaagtcaaaag

SEQ ID NO: 214093 - DNA, 816 bp, Homo sapiens
tgaaatttcactcctttccagatgcagcttctgaagaggagacctggcagcctggcgagcatccagctcgctcacgcaccctcttttctagtcccgtggccatcagtgagcttctccgggtccctcttgccacttctcagatgttcctttctgtcctaggagatttgtaaaaccagatacttaggatatgattctctagtggagggttaggcctttaggtctctaaaaattgccattcatgaccttcgggcctagggttttgagatgaatgtgcagtgtgtgtggccgctctgtgtgtcccgcttccaccagcttggcattaagcacccggagcatcgcctgctgggcaggcctggccaggggtgagcccctccattcgggggctcagggtcaaggcagattccttgcttggctttcctgctgatttcctcatgaagatgccaattcgtatttaaacatttgttatcaatggtggtgtttgtgtgctgatttctataggtagaggctgttgttttaggagccaggtttgctgggccagctcagacctcttacaaagtgaagatactaatgatcgtcttgcaaggtgccatagtgtcgtgagggtgaactgaggcagtggctatgcatggtgtctgcagcagcgtttctgaggctccaagaatatcgttcctttttcagaaatggggccagattcttgggatgtagacagtgttctcttcacggatgctaacaacttatcaaagctataatatattaagtatctctgttataataggatagatgcattcctaaaaaaatgtgttaagcaaaaatcag

SEQ ID NO: 214094 - DNA, 913 bp, Homo sapiens
tcacatattctaagaaatagactgtactctcctcaaatcgaaataacggcactttaattcttggattttccacattttcgttggtaaagctcctatttgctttctctgaatctgtatcagttcatgcagttctgccaagtggggaagctttgcaggacactgccactgtagcacttgaaatattaagatgaacagaacaagcaaaaggtgggaaaactggaaagattgaatgtcctttggagttcacagaggtttggcagtgggaggagaaaaacaaaacgaagcatagtgggagtgttgaacagactttcccaagatccccagatcctgaaattcaagaaaatatttgtcaaagtattagctgagtgcaagctaaggtatcaaaatagtgaatacacacaccaaggaataatctttgcaaaaatactttgtctcaagacaaatagaacacagcagactttaataatcaaaacagaaacaccaacatagagaacctaaggaacgaagagaatctgatttccaaagtcaccacattataaaaatcaaatgccaatcttcaacaacaacgaaaacaacaaaattcacaagacacataaagaaacaggaaaatggctcattcaaaggaataaagtgattaattggcataaactgtccctgagaaagcccagatactaaagtgacttgacatttgctcaactagataagagtgagtttcgacaaagaagtaaaggaaatttggaacataatattttatctaaaggagaatatcatcaaacaaagaaattatataaaagaaccacacaaaaattctggagctgaaaagtacagcaactgaagtttttaaaattacttgcagagatcaacaacggatttgcagattagtgaactcgaagataggaaaattgaaattatt

SEQ ID NO: 214095 - DNA, 360 bp, Homo sapiens
ctatgtatgttaaggggctaatgaaaactgtcatgaactgacaccagtccagggacaggtattttagaattattcatctacatggcttccaaggcactttttcattcttatgatttacatacaaaacaatgattctttgtaaagatgatgtcaaagtaaagcatccaagttctggtttgaagcctaaaaatgtgtaaaaaaatctaatttacaattttatttaagaaaataattattatcagtttagtaaaaattaaattagataccaggaaatgcatagttagataatttttttatttttattttttggaaatagataattcttagtgctaaacttgactattggctgctctttgaaaa

SEQ ID NO: 214096 - DNA, 434 bp, Homo sapiens
gcactcagcaaatctataattttagaaacccatcagggagtttctagatgagtttctaagaagtctaagaaatgtccaggaaggcccttagccacctcgtggaaattgggagagaagaaatgtgtgcagagaaaagagggatttttgatgcagagaaaaagaacaggtgtgtcccggctgctggctctgagtaacccgtctaatctcactgtacagaacgtacctgcactttatactaacaatgagtgccattcagcgcgccatttatgatgttcacagtggccttccttggtgtggtccctgaagccctgcaaagcagggacatgtgcggtctgaaccaaacaggggcccctgggaatagggtagcgtgttctgatacctgagctggtagtagagtcagagcaagaacaaaagccccagcgagcaatctgggt

SEQ ID NO: 214097 - DNA, 410 bp, Homo sapiens
ttaggggaaggcttaaacaatgactgtgatcaagttaggtgagagtctggggagggaagttctggcctgtgctccaccttatcagttttaggagaaaaagtactaagaatatagatgacttttcacatatcgtactgacttccttgctagagggactgggtaggtaggactcaactattcgaaaattctttgaagtgatgtgaagtttctatatattatgaaagcagggatcatgtctatcaaaatccttattttatctatagcattcaacacagtgcctaccacacacagtagaggtcagtaaacatttggtgaatcaataaacaaataaaagacacttgaccatgagaggccacaatactgagaaattggagatgtttcgcagggtggatgctgctggattcaacaga

SEQ ID NO: 214098 - DNA, 394 bp, Homo sapiens
ctgtcagtttgttcacctggcagggtgtctcaggcaaccctgtgatgtgtcagaaatgtggatacttccaatttagtgtcattttgaaaaagcatgtgagaccctcacattcccaagcagcatgcccatgtgagggtgacaggcactcggaagtctagtatgccccacagaggaacatataatccaggggagcacatgtaacgctggtcagggagcagttgtgttaagagtctgtagtccagctgtacaaagctttgtttgatttaaccatgagttaggtggcagggtaaagttgtccaatgtatggaccttcccatactatctgtgatgtttaatttgcctttgatttttttttttttttacctctgattttatgtctgtggaagaggtaagc

SEQ ID NO: 214099 - DNA, 440 bp, Homo sapiens
aaatgtttgtaagattgggcttgctctcttgtgcttctaccttctgccataagaacatgtcttggaccgcttatagcccaaggaagatgagaagcttgtaaagcatgtctcaacttgacctgaggcttagacctaagatcaacaaacccagcctacattagctgaaccccagccagttggcatatgtgggagctagaaataaatgtgtgttgttttaaaccagtgagattttgcaattgcttatgacacagtgtggtaggcagcatatggcccaccaaagaggttcatttccatatccctggaacctgtgaatgttacatgacatagcaaatgggaattaaggcttgtagatggaattaagattactaatcatttaaccttaaaatagggagattaatctggattttccagctgggcccaatataatcacaagggcactt

SEQ ID NO: 214100 - DNA, 334 bp, Homo sapiens
agagggacaatctgggattatcaagctcatgtttactcaggctctaagcctggataggctattccataattctagaatattcatgataggagagcaaaggctcactgtgcttgtaaaaaaggtttcaactgcatctcctctgaagtgataattcttgtgtacctttatatccggaagaggaaacaaaataactagggttctgtcagacttgtgcaaaggtcaggtctcctcaaagttacattaggagaaaggccagcctggcagcttctcaatgctccaatttaaaagatgcaccaaagacatttctagaaataaaattgttttaaaaatcaat

SEQ ID NO: 214101 - DNA, 440 bp, Homo sapiens
gaacattggtcgaggacagcaaagaggtcctcagataagggcaacgccctccctgtatggagagatagaagaaaaagaaattgtttatactacttattcagctgaggaactcaacatagtttttgcgttgaatcatagaatgttacagctgctgacttttcactgcataccgacttgatttgtcccattttttttctcaccaagagcatttattataccttcccctaccgaaatttttcaaaaagaaaactttttaagagctgggcgctgtggctcacacctgtaatcccagcacttcgggaggccgtgggggggcggatcatgaggtcaggagatcgagaccatcctggccaacatggtgaaaccctgtctctactaatacattagttgggtgtggtggtgggcgcctgtaatcccagttactcgagaggctgggctga

SEQ ID NO: 214102 - DNA, 177 bp, Homo sapiens
aagtcatattgctgataattatttgaaaatttctaaaactaaaacataagcatagcagatacgtttatttaatactaaccgattgtggacctctgctgtttgaattggctgttttatctagtcaaataacttgttgaatgtcatggaatctggaccgtcccttcaaatccccacccc

SEQ ID NO: 214103 - DNA, 252 bp, Homo sapiens
agtgaaaggtagcaagaggagggagagcttccagccactcgccaggcctggcctggaattggcagtggggagtgaggcagcctagaggccatatactgagcctggcccctgcacccctgccccaggcacgcactgtttggaaggggcagatctgtgagcacacaggagtagtggagtccactcccacagagatctcagggtgccccttcatgccgcgcccaccagactgcaccctcatctcctctcttccgg

SEQ ID NO: 214104 - DNA, 580 bp, Homo sapiens
cttctaaaagaaaaaaaatttcaggaacatttactctagatttcaattttgctccaacatttattactgtcttgagaacctctatgacaatttaggtcaagggacaatttattcaaaaaagaacaaaccatctacaaattctcttatcatgtgagcctcactcccattccgcatccagtgtggtttcccacaaagatgtttggagaagagaatcaatggaggtggaaatctttggtccagcagttggatgagtcacaggaccttttggcccatctatttgtttcagaaggaacaagcataatatgtgtgtgcagatttcaacactacatggacaatagcacagctgttattgttgtgtattcttctgcaagaggccatgaacccaaaagccttgtggtgaggggttaagactaagattttatttcttctttgttagttgttctttgtttagtttcttctttgtgcttaaaaatatatgaagtcattacatgtgaaaaaaatagatgtacattattttaaggtcccattctgtaaaacgtggtacaaatatgcattaaatgagagacctcagtataattta

SEQ ID NO: 214105 - DNA, 685 bp, Homo sapiens
cctgcatcatcctctcttctagccagagcatggtctctggggccaggcagacctgggttgaatacctactcctttactgtgtagtcttgggcaaattattgttggcttcagtctatttataaaatatggataaaagcaacctctgcaaagaaccactggagaagcgtattaaaatacagactcctaccctgcccacccccagtcccaactaagactcagcaggtctagctggtggctgggaaggctgcattataagcaggtacctgtgtgttctgtgtagacctggccctgccgtttgagaaacaatggtgttagaattagaggtatgaatgtaaagtgcctattacatacatacacatggctatgtaatgaatggtgctgcctttcttctaagggccttgtctcagagttatgtcattctgtacacggtacctcaggaagtcagggcagccaagacccagctcttctgactctgcacctacatccctctgtgccttcaggacacttaggtgacattcatctggctgtcaccacaggcttcctgtgggttagccagactcttcgctgcttcctcacttcagggctttggttgtggccatgacagctttccctaacctcaggttgccctctagggacttgaaactgtctcttcaggcttaaatgctatggcagaacctttcagggg

SEQ ID NO: 214106 - DNA, 607 bp, Homo sapiens
gtcatacaactaatgtggtatacctcatgtcttagaactatgaaatttagaagagcatgaataaattgtagtttttacttacaattgagccttggaaactaaattgctatgccatacaatatagatgctgaccctaaacatttctgcctgagaagtaaatcttcactgccatggtttaaatgagttgactctcaatgtatagttgaagtcaaagtaaggtcagacttctaaagggtgtgtatgttttggttaagactgccaagcatctggattaggagttcttaatttgggattggttaaccccaccccctaaaaaataatgtatgtgctttctctggggcgaggttcatagctttaatcagattctcagtggaatacagcaccccaaatgtgttaagaatcattgacctagagaggggtaatcatgtgtccctttctggggggcgggagggggtggatcatgtcaagagtatttatttataaggaaagtttggcatcctagatggcctaatggcttttaggaggctagtaattccttccgtgatacagtaaatctcttggtattaggtctattttggtaattatattttggtagaaaccatagttt

SEQ ID NO: 214107 - DNA, 492 bp, Homo sapiens
acccaggctggagtgcagtggtgcgaacatagctcactgcagcctcgacctcctgattgtgaagtgatcgtcctgcctcagcctccccagtagcagctgagactacaggcatgcgtcaccatgcctggccaatttttttggtattttctgtagagaaaaatacaaacacgtcaccatgttgccctggctggtctcgaactcctgggctcaagcgatccctccacctcggcctcccaaagtgttgggatcacaggcatgagacacgatgctcaggctgtgctgttttcaaagccctttcacacacagtccttaccttccttagtccctgaacagcctcattgtggatcaggattattatggccccaattgcatggccaagggagtgggtggagagaggctgagcccaggaccattcaggacagaactgtggtgcaaatcctcctacctttctgagccagtgagctttctttgctgaggtcctgcctctctgca

SEQ ID NO: 214108 - DNA, 147 bp, Homo sapiens
ttgctttatgtgtcatccatctgccctccaaagtacccattaatgagcaggcctcatgctcagatcctagaatcattcattaaatatatcactactgagtgtctatgatgggcatggcactgccctcagagagtacccagtagagga

SEQ ID NO: 214109 - DNA, 370 bp, Homo sapiens
tgaagtcccataacagtcagcatcaagtattatgtaatagactttttggatatccagctaggcgaagccttcaaatgatagctccggctgacatccagttactcccataagatacccggtggagaactgttcaggatgcttgctcttttcctccttcttgaaatctagccaccatgctatgaggccacccaagcagccaagtggagaatcgtggtcgtgaatgtcagcccagctgccagttgagtctccagatgactgtagctccccaccaccccatcaccccatctcacactacatgaaacaaaagaacaagccagtcaacctactgaatcatgaagagtaataaattgatgttttaagacagtaaatt

SEQ ID NO: 214110 - DNA, 743 bp, Homo sapiens
accagggatccttttaggctagtggtaatattctgtatcttgattttggtggtggttatgttggtttctgtcattgtcaaaactcatcaaattatatgcttaaagtggggtacattttatactaaagttaatttaacagtattacaccattttaattagttgctattttagctataatggcaagctatgacaggtgtattgtccttggatttttgtttggcagggtgtaaatccactatatttttttctaggtaaaatgttctctatgttaatgtacaaaaatatatggctagtatttggctaaagtaaattcacataattagtatgactttaacaaacaaaatatcattttttctttcttcagtaagttccttaaatttatcctcagccagatatctccaatttttaatattttagttaaatatcattgcatatctgctaaagtttttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccgg

SEQ ID NO: 214111 - DNA, 384 bp, Homo sapiens
gctcacacttggggaaagggcaggaggagcttccagtgaataagcaaacacatcactgtataattataatttgagataccagctgtgaaagatgctgctctgaagaggaacaaagcagtgtaagtggacagagaggggcaagtaagggagactcttccctgcaaggttgacggcctttcggtcctcaccctggctttctgcaggggtgacttttggcagatccccagctgcagcgagggcattagccaggtggagatctgtgggaagagggccccaggcaggggaactggcatgtgcaaaggccctgaggtggtgcctgcccggcatttggagaataaccaggaggcaggggcagaatgagtgaggcagggagacatacggccg

SEQ ID NO: 214112 - DNA, 421 bp, Homo sapiens
gagtgttgtaagtgctgtaaaggaaataccaaggtgcagggatgataatggagggtggggctacaaagaaaaaagtgaagttccacccatccgttttcacaaaggtaaccacttttaacagacctcttttctattcacatagaaacaagtacgtgtatatatgtggtttcacaaaacttctcagttttccacactttagtatggatgttgtgtcatgaccatatgtatagatttacttcgttctgttaatggatgaatggttttctgttgtgtgactgtatcatagcttttccgaatatgacctccattggtggaactttaggttgtctacaaattattattgttattataaatagtgctgcagaaagcatccttacacttatatccttgcactttgtgcagttaaatatttggaatttag

SEQ ID NO: 214113 - DNA, 285 bp, Homo sapiens
acccttgccattaactaggataggaaacaacaaagggtaggagtttgacaggggagaatgtttgtgctgttgagttgttgagtttaggtgcttgtggcacgagcaaggggagtgagctggtctaggaggtttttggaaacactgacctggctgcagagagggagatcctgggacacctgttttgggagttatcccagtggggaaggatcactgggaagggggccacccctttgggaggggtcagtgggacgactcccaagggaagaggttggttatagggagtta

SEQ ID NO: 214114 - DNA, 451 bp, Homo sapiens
ctttcctgagtgactgatgctgtgaggatgagcatgtggtgtttgcattggagggacaaggtgccaacttaagtcagcgcttctgagagcggatcaagtgaagttgtatctaccatgaccaaaatctcatctccaggatcacttggtcttggaactctgagccagcatattagaaatccagctgtttttctgggagaccatgtaagagactctgagactacatggagaggaagaggaaccaggtgagctgtcttccagcctctcctgtcaggcaaccagacacttgggtaagactgtctttgatcctttaaaccagaccatccagcaactcaataccaccaagtgacctccgtcaagctccatgtgtagcagaagaatctcccaactgagccctgcccatatacctgctacacaaaattatgatatagaataaagctgtggcattttaaac

SEQ ID NO: 214115 - DNA, 317 bp, Homo sapiens
gtatcttttcctttgctaactcatagatgtttaaatatattacattttaggtgttagatgatttatatatcttcagtgttaacacaaactgaagatattgctctaatattcatcacccaatgagaatttgtgatattctgcagatttggtaacattttcatggagatttaataaaaaacattgacatattcattctacagacatttattggctatgtaattcatgtcagaaactgattcgacacagcaaaatcacgtgaataagaaggtctatattgttgaaaagcttaccaatgcatcttcttcaaacacacatac

SEQ ID NO: 214116 - DNA, 418 bp, Homo sapiens
gtgagactgagattttctctagtgtgcgaatattgggtgttattattattccaagccatcttacctgctgttttcattcctatgaagccaattagaattaaaatgggctgaggccgggcacggtggctgatgcctataatcccaacactttgggagcccgaggcgggcagatcatctgaggtcaggagtttcagaccagcctggccgacatagtcatagtgaaaccccatctctactaaaaatacaaaattagccaggcgtggtggtgggcacctgtaattccagctacttgggaggctgagaccggggaatcacttgaacccaggaggcagaggttgcagtgagtcaagattttaccattgcactccagcctgggcaaaaagggcgaaactccatctcaaaataaataaataaatat

SEQ ID NO: 214117 - DNA, 643 bp, Homo sapiens
cacagtgacttatgcctgtaatcccagcactttgggaggctgaggtgggtggatcacgaggtcaggagttcaagactggcctggccaagatggtgaaaccccatctctactaaaaatacaaaaattacccaggcacggtggcaaagcgcacacgtaatcccagctactcaggaggctgaggcaggagaattgcttgacctggggggcagaggcttcagtgagccgagatcacgccactgcactccagccggggtgacagagtgagactccatctcaacaacaacaacaacaaaaagagtaaaaagctgcagaatttccactttgttgctacctcgcttctttagatttactcgtgctcttcctagtttttggacctcaggtcttaaacagaggacgtttattgatgaaagagaaactgtcccaattatcttcataaagacctctcatagccctctgatcctattataaagccatctgtttattttaaatcgtaagagttctggaacattcatttgggaatatatgcaacaattcaagagtgcaatcgacaatataaaaaatttttctaagcctataatctcagcactttgggaagccgaggtgggcagatcacaaggtcagaagattgagaccatcctggcta

SEQ ID NO: 214118 - DNA, 210 bp, Homo sapiens
tgtggaaccaatggcatagctgagacttcaggaaaggaaaattctttgagccttatcttcctcgtccataaaatgagggaagtaacaattaaataatcactaaatttcctttcagctctaaccttttctaaatgcaagctggataaattgatacaacctggcagctgttgtcatattgctatagtttttgtatttttttttttttttttt

SEQ ID NO: 214119 - DNA, 426 bp, Homo sapiens
atactataccattattgagaatgagaagagcttgagaaatttgtttatatgatatactaccgtcttccaaacacaactccttctcttccccttaagagtaattaccactattctgatttttatgcagtcactttcttgcttttctgtattgctttattacccaggtatgcatccctaaatattacagttcagttttgcttttcttttaatagtattttttgagtatcttataatcttcaggtgccccaaacatagcacctgacgtccgatacaaagacatctctctcccttttaaaatttatctattgaaaaaaccaggccaggtgcggtggctcatcactttgggagtccaaggcaggcagatcgcctgaggtcaggagtttgagactagcctggccaacatggtgaaaccccatctctgctaaa

SEQ ID NO: 214120 - DNA, 796 bp, Homo sapiens
gggtgaccaagagatacataacctattaaagccttgagaaggaacagattcagtcagaggggatgtagtaagttaaaatggtgttatccactcactagatgtatgacctatttctgataaatacatcaaaatactactttctacatcaaaatacaactaataaaatagaaaaacggacaagtatgaatgatggttcttaggctacaagtggcctgtaaacaagaggtggaaaagttcaagtctattgtttgcccaagaaatgcattattagtgagaggtactatgatctctcactgccaaagggatgattagccattggtggtttttaggggtttgcagtatgtgatgacttgacatttggtagagctgtccttattagttaaaggtgaggatttagcctttaatcactgattgccaccttttcaaataagagaagctcttaaaaaaaaaaaaagcaaaaaactttgccagatccccacgtgttattatttcgatatatccatatatatatggatatgaaaatatttggaatattttcacgaaagctttttaaatggttgtatgttattaattgaaacattgagtatatttgaaaaaagcgtgtttcagatactggtcaagatgttttgcattagagacaatagttgattacatagtgaagctaaaatgtcatgtcaattaaaatgttgtcttaatactatttatgtaaataaccctttgaaatcgaaaactagattcaagttattttgcagtaccttgatctgtctagggaggggagatttctctctaaaaatca

SEQ ID NO: 214121 - DNA, 520 bp, Homo sapiens
aatagcagctgagtagatatctattataaagtgtgtggtagttttgaaaatattttctaatactttgaagctggtgtatagaaatggagtttaattttgtatgttgatcttataatcaacaacctagttaaagtgccatattaattctaacgatctgtttgtagttcttttgggtttcctatgaagatagtcctatcacctgagaaaaatgatagctttgtttcttcctttccaatcatttacatttgtttctttgcctatattatacaagtggcaagagtttccaatgccatggttaattaaaggaagtggttcataacaggcacctgtattttatccttggctttaaaagaaatgtgtttactatttcaccattaaggatattattcggtgtgggacttgtgcagatattctctattatgttaaggaaaagcctgttttactcttcctttataaacagttttgtgcatgtgtgcatttattgagtggttttaaaattaaatatattcattttatggaa

SEQ ID NO: 214122 - DNA, 357 bp, Homo sapiens
tagtgaaagctcagtaaattttgaatgaatgaatatattgatgtcacaccagcagctctggagcatgaaggaagctactatcaccttctcttctgtgtaaagcattaagtgatagacacattttaaaatgacaagtgttcaatttctctgccaggctgtccttgcatacagactaaatagggaggctttttggactggcaaaacaattaaatacgacttgattcaggattaatagtaacttatttggtgataatgacattacaaactcttttcttcatattgcaaaaagaggatttctccatcttgaaagcctcttaatttcatacttggaggacctgcaggaagaactataattga

SEQ ID NO: 214123 - DNA, 521 bp, Homo sapiens
caaagacattttcaaataagcaaaaggtgatagaatgtgtcatccacagacctgcactataaaaaatggtagaggaagttcttcagtatgaaagtgaatgataccagatggaaactgagatctacaaaatgaaacatcactggaaatagtaaatacatgggtaagtataaaacatttttttctcatttaaaaagagtatctttaagggcaaattaattatttaaataaaaataataactacattgtatagttaacatatgcagaggtgaaatgtatgatgaggatcacaaagtaaggcgggcagaaatgatagtttactcttttaagtttcttacattatatattatttgatatttgatgaatattatttgatggtagtcagtgtttaaaagaggcatactgtaaatcctaacaaaactacaaaataaataaaactaaacgttgttgttaataaatcactagaaaagataaaatgtaacacagatcctgcataattcatccaaacaaaatcagaaaaagta

SEQ ID NO: 214124 - DNA, 150 bp, Homo sapiens
ggctaccactagaggcttggaatacctcttgagatttgcatggttgttagtttagattatggattcattctctccctccctctccttctgtccccatctcctctcttttctgtctctccctccctccctctccccttctccctctctctc

SEQ ID NO: 214125 - DNA, 451 bp, Homo sapiens
gccatttttgatacgatttacaaatacttttccctagtttgccatttgctttgtttataatgttttaagtaatcaaactttacattttcccttattttgtgccatagcattagtatcattaagaaccagaattcagttagtccttattttattttcacaattaaatctctaatccctttagaatttgtcctagtgtaatatgagaacttgatccaattttatcttttctatacacttaaccagttactccaatcaatttattacatagttcattttccccagtgatttgaggtaccaccttcatacttattttccatatgaaactgggtctgttcctagcttttccttttttttttttgagacagtctcactctgttagccaggctggagtgcagtggcacaatcacagctcacggcaacctccacctcctgggctcaagcaattctcctg

SEQ ID NO: 214126 - DNA, 379 bp, Homo sapiens
gatttctgcttgcactcactggccaattctatctgcaaggatgataagaaatattttattttagctgagcacattgctgcccagtgttctattaccatgaaaataagaggaaaatggatgttgtgtaacccagaggcttggtgcatgcatcagaatcttctggtggccttattaagacacggtagttcccccttattcacgggagatccattccaagacccccaatggatgcctaaaaccacagatagtactgaacgatatatattctgttttctatgttttatcctagacatacatacttatggtaaagtttaatttataaattaggcacaataagagatgaacaaaaataagtaataaaatgagcaattataacaat

SEQ ID NO: 214127 - DNA, 338 bp, Homo sapiens
attttcattcccagaaactgtagttaaattgtactcattttctctgtattgcatttcttttaatttataggctatcttgcaatcgcttttatttatatatttttacagtttatccgttacagagcccagagaggtgcttatgctcatggtttaggctttactgattgccaatcatggtacaagtaagcacgttcttctgaactctatctttgctagaaattgtcagctaaatccagaggctaatttgacaaaactatagtggatagtgtgttctcctgtcaaggatcacatcttttagttgtttttatttttgaggttggcagcctttgatactcagt

SEQ ID NO: 214128 - DNA, 1053 bp, Homo sapiens
cgagagagcgtccacagtgtaagaattaagtacaaaagacgctcaagaggctgcgaagagcaaacacacacacacaaacgtgcaacgaagccaagttaaaaggtaaacaggccgaagaggggggatttaggggagggtgcgggagtgcagtcgtacagcagaggaactcttaggagggtaggggcggagcttggcttcagttaccgcgactggagccgattttatacctaagatggctgcgcccacagccactcccattccaagatggccgtaccaacatggcagcccccacgtcacggagtttaccgtacagggcttctcttaaaatggcggcccccaggcaaccggcgttctcaatatggtcccttccgccctcttctggtctcaaaatggctgcccctgccctaaccaagccggggcccgcgccctgcaaccccgaaatctggatttcggtgtcctcccgattgagtcgaaggcacacgggcggccataacgaagaatcactaaacaaggggaccccaggaagcacagcgtggccgacgctggtcgcgtggatcttgcgagggaatctaggtttctacattttgccaagaaaggagaggctccctttggagcggaaatattagcggcagggggttaacccccgaccctgtccgtctcggtgcaccgctcctcagttgcttcctggtcttcccaggagctggataagcctgaagttgctcagtttgggtttcctagtagaactggggcttgtttttgctttcattttcccctcaggccgattcagccacagcagccagaaagcagtggccgcacccctaatgtgccttgcaaaagtccagcatgctgtctgggcagggaccaaacttaaggcttaacatgtcatggtcatctccaggactcaaacatggcggaggtttacgaacaccagaatgcctcctagaatcttttccttccaagggtgcacagaggcgagatgggaccagggacaagacaaagaacgtaacaatcccagtacgtgtgctcctgctagaggtcccctaaactcaggga

SEQ ID NO: 214129 - DNA, 495 bp, Homo sapiens
ggtcccagctacctgggaggctaaggtgggaggtttgcttgaggcttcagtgaactgtgaatgcaccactgcattccagcctaggccacagaacaggaccttgtttataaataaagaaataagtaaaaatataaataaaaagtaaaaataactataagtaaatataaatataaaaatgcatacatgaaaagaaacaatttttaaatttaacatcactgagggcatcctatccatttcatttcatgattccattacatcatttcacttagatgaaatgatgagatgaaatgatgagatgaaatgacgaaatgatgagatgagatgatgagatgaaattttgagatgaaatggtgagtagaaatgatgagatgaaatgatgagacgaaatgacaaaattgaaaagaaattgaaaggagaggagatgagataaaatgagatgaaatgagatgatggatgaaatgagatgaaacgagatgaaatgaaataatgaaatga

SEQ ID NO: 214130 - DNA, 1892 bp, Homo sapiens
cgcccgccagaggctcggctcgcgcggcgcggccgctgcgacttcctggagttctgcctgccgggggcgcgggcgggtgtgtgagagagaaggcgaagggagccgcggggtgggagaggagggagtcccggcgggagggcgggggagaggctggcgggaggggggctccacggagctccagccagggccgcggttcgcctgcacgtcacggctactcaaacccaagcacgtcccgaaagcggtattttctgcgtctgggaggtttttgcatcctcagttcccaccgctggggctggcggcgaccaactcgcagacctgtcgcagccagagagctgtcatttcagtaccgggattcagaattgatccagtccgcagcggagggggcacatcccagctaccgagctgctgagtgtctctggctggaacaatagtatttttttctctgcgaggctgcaattaacatcttatttgttctggctccatacaggctttgtcaggatcgcggtgcggcgaccgacgttgggctcttgcattgctttctgcttggcaatggaatcatggtttcggggtctaaacttttgtttcgttttgtagtcttaatgtatctgattctttttcaagtttccctagtaacaggtttggggacggggtgggaagaagcgagaaaaggggtgaagagaaaaaaccagattatatagaaaggaaaaagggaaaagggatgtttccccaccttttaatctaactatctatctgtctgtctatctatcatcatagatagtcattttgcctcctggacagttggctgacgaagtgtctgataaaccagcttcagatacatgctacaaaaggtcattcgcctcctgattatgtttctacttgtaaacgcagttggtggtttgcaaaacaagtgctaaaatagtgcagtgatgtggtgggaggaaccataatgggtaattcatataaagtgctggaatcttcgtaagggtgagtttctcgagcggcaggtgaagttgaataaagcaattttccatcatttgttcccctcactcttgcatttttttcctccgcttgtttctctcccctggggcgattatggatagccaagaacaccattttaaaagagattgatagtgaaaacaggaagtttatggtctgttatccactggagttgtttgaaatattaaaattggtcctttacttcttaatgcatattaatagagtgaccctcttcaaggctttcccgtcttaaacgaatgcctgggataaacactgtaaggggaaacagttaataattccccagcaggctttaactattttcccagtaacaaatcaccggcaagagagcagcctgggtggcattttggttttgtgtcattttggttctttacaatattttttattcatttaaggaaatgttaaaaggaaataattagggtttatgtccagaacaaattttgaaacaccgtttaagcaacacattttcttttaaaaacaaagaacattgagcaacacaaaggagaaaaacattttatttatttcaacttccctagagatcgtaattatgattttcgcaaggcaatttggtcagttctgttactttatccagaggaaaaaaaagcatgacagatgtggaataaaaacggaggaaaaaatgctttggatggtttatacataaaaaggaaagaatgtaatgtgaggttcagttatacctctattttgcatctagtgatttctcatattatcttgtaacactgattttgatgtttcttagaaattcttaaagtcatgacacagtggcataagaataacagctgaaagggacaatttaaaagcctaaatcctaaatggaaaggttcacttactcccaggatcatttatattcaagtagaagt

SEQ ID NO: 214131 - DNA, 2001 bp, Homo sapiens
cgcccgccagaggctcggctcgcgcggcgcggccgctgcgacttcctggagttctgcctgccgggggcgcgggcgggtgtgtgagagagaaggcgaagggagccgcggggtgggagaggagggagtcccggcgggagggcgggggagaggctggcgggaggggggctccacggagctccagccagggccgcggttcgcctgcacgtcacggctactcaaacccaagcacgtcccgaaagcggtattttctgcgtctgggaggtttttgcatcctcagttcccaccgctggggctggcggcgaccaactgtaagagaaactcactgggaggcgaggcaggggggtgcggaggatgggaaggcgactctgaagggtgggaagtgaatgctggacttgatcgtctttctctttctttcagcgcagacctgtcgcagccagagagctgtcatttcagtaccgggattcagaattgatccagtccgcagcggagggggcacatcccagctaccgagctgctgagtgtctctggctggaacaatagtatttttttctctgcgaggctgcaattaacatcttatttgttctggctccatacaggctttgtcaggatcgcggtgcggcgaccgacgttgggctcttgcattgctttctgcttggcaatggaatcatggtttcggggtctaaacttttgtttcgttttgtagtcttaatgtatctgattctttttcaagtttccctagtaacaggtttggggacggggtgggaagaagcgagaaaaggggtgaagagaaaaaaccagattatatagaaaggaaaaagggaaaagggatgtttccccaccttttaatctaactatctatctgtctgtctatctatcatcatagatagtcattttgcctcctggacagttggctgacgaagtgtctgataaaccagcttcagatacatgctacaaaaggtcattcgcctcctgattatgtttctacttgtaaacgcagttggtggtttgcaaaacaagtgctaaaatagtgcagtgatgtggtgggaggaaccataatgggtaattcatataaagtgctggaatcttcgtaagggtgagtttctcgagcggcaggtgaagttgaataaagcaattttccatcatttgttcccctcactcttgcatttttttcctccgcttgtttctctcccctggggcgattatggatagccaagaacaccattttaaaagagattgatagtgaaaacaggaagtttatggtctgttatccactggagttgtttgaaatattaaaattggtcctttacttcttaatgcatattaatagagtgaccctcttcaaggctttcccgtcttaaacgaatgcctgggataaacactgtaaggggaaacagttaataattccccagcaggctttaactattttcccagtaacaaatcaccggcaagagagcagcctgggtggcattttggttttgtgtcattttggttctttacaatattttttattcatttaaggaaatgttaaaaggaaataattagggtttatgtccagaacaaattttgaaacaccgtttaagcaacacattttcttttaaaaacaaagaacattgagcaacacaaaggagaaaaacattttatttatttcaacttccctagagatcgtaattatgattttcgcaaggcaatttggtcagttctgttactttatccagaggaaaaaaaagcatgacagatgtggaataaaaacggaggaaaaaatgctttggatggtttatacataaaaaggaaagaatgtaatgtgaggttcagttatacctctattttgcatctagtgatttctcatattatcttgtaacactgattttgatgtttcttagaaattcttaaagtcatgacacagtggcataagaataacagctgaaagggacaatttaaaagcctaaatcctaaatggaaaggttcacttactcccaggatcatttatattcaagtagaagt

SEQ ID NO: 214132 - DNA, 749 bp, Homo sapiens
ccctgatctgggtttccccgctcatgtatatcacctctcagctcacaatcactagcagatgtcttacccgggtttccccaggtccaccctgccttcttgctcttcaaaatcactaggctaggaaatacttctagaaagttaacctacaaatacacttacatgtttgcacaaaagcacaaaagtatgtggatgtctactgcagcactgttttcagtcttttgctattattagggattggtaaaaaattatcatatacagtatgtatagcacactgccatcaatgtaaagaaagggattaaaaaacacgtgcatatttctggaaggacaagaaactggggaaattagaagaagagaagttgagtttctagggttagcagagacttaagtatttctttctcaataagtttaattaaaaagtcaacttacaagaaaagagaagtagaaggctagtgatccatatatacacatacccctaccaccaaagaaagagaaccagggagagacaggtgacgggcaattccttttaggcccatgctttttttattcttttctttttttttttttgagacaggatctcactgtgttgcccaggctggagtgcagtggcacgatcactgctcactgcagcctcaatctcctggcctctaatgatcctccccacctcagcctcctgagtagcacaccaccatgcccagctaacttttgtatttttttagacatggggtttcgccacattgcccatgctggtc

SEQ ID NO: 214133 - DNA, 523 bp, Homo sapiens
tggattagctcaacgaagcagatatctttggagacgcactgtgagctaggacacagggaggaatgcaagacagccccttccttcaaggaacaatgaagacagaaacagaaatgaagtggggcgggactgtacaaaggtaccgtgggtgccgggatggtaaatgctgtgttactggtgtacacaaagtggtttgggaacatcgaggaggaaatgagttttcttaggaagatgagagaaagcctcacaaagtatgtgacacttgagtggccatctgaaggttaagagcgatgtaaaggaaggacaccattgtataagggtatcaaggctgtgggccattcctgggggagaactgtggtgtggttagatgggtcgcctggctgtgcaggaggagtgctaagacatgaggctgtagagggagatgcgggaaggaggtaaaaatgattggtggtttctgctgggagatggcatggatctaaattgggaagaaaagctaatttgaagtggagcctcccaaggtatgtag

SEQ ID NO: 214134 - DNA, 837 bp, Homo sapiens
gtgaggatgaggtcatactccatcagggcgggctccactctgatacatctggtacaacaggtgtccttataagaagaggagacagacatgaggagaaggccatggagatacagagacacagatgcagaggacggccaccctgtgaagacgtgggcagagaaacctcaagccaaggactgcccatggccaccagaagctgggagaggtgaggaaggatcctccgtggtggctttggagagaacgcagccctgcccacacctcaatctcagacttctggcctccacaactgagagggaacatgtttctgttgctttaagccacctggctgtggccctttgtcacagcagccctgggaaatgaatcaccctcttcacaaagtcctcactccataagacaaaggccttccttatccctttccctgtcctggcctttgccacagtcctctcagacttgccaagcctgcacgtgcccaagtcctgaccccacccctagttcctgctctcatgtgtgtctttcctgaattaccaaaacctcctgttcccaaggggcactagaatgttgcctgtgagggcctcggcatcctcagtactttcattccgggctccccagtcctgtcaatggtggagatgatgaattgtccaccagagccatcctcccctggtcctggcttctggacacacaagcagattgcacaatcccacctccagggatttgactaagtttctgccacagaaacagaaacaagcatggtgtgcaccatgcccaggcctctgcacccactggctggatccgactctcccagctgagccttgatatggtagagacccagcttcaact

SEQ ID NO: 214135 - DNA, 314 bp, Homo sapiens
gctcgcagtatctttaacatatttatttatttgctcaattcctttgtatgtggccagtttcctgaccccactgggccactgtcccattcagatgccgtttttatatggatttatacccttatttggtggcctccctgcttagaaaacctccttgtgcttctggctgacttcccaccctactcaccatcttccttttttttttttttttttttttgtaactcaccatcttcctcatgtgggccctggctacccctgggctgcaagaaggaaggtctgatttttatatgttgttcaggtaattaaagtttaaaaga

SEQ ID NO: 214136 - DNA, 280 bp, Homo sapiens
tctttcaggtttcaatataacctcctctgagggagctaacctaaccactctagttagagtatcctctgcactccaccccaggcattttctgtcacagctccctgttttgttttgtttatagactatatcactagctagaagtacttctttttctaaaatgttactttttaaatttctatatcagtcaggactttttaatttctcccagtcaggcattcaggacgttaggttatgccatgcttggagttatgccaactctaaaatctcagtggcttcaaac

SEQ ID NO: 214137 - DNA, 1268 bp, Homo sapiens
tctcctggtaactcacagaacatatttattcattttcaaaaatcatttctactttagtcttcacagagtattaacacatttcattatttggctggtatgtgagtagcaactaataaatatatttagatatactttttccttatgttcttacatataactaactacagacagaaaactgtttggagggctcccatatgatcaatccctgccacctatacgcaagcccttgtgtgatctcctctcactgaatgtgggctataactaccaaatatggcaaagtgatgagatgtcatttccaagaccaggtgactaacctgtgacttttgtcttgttcacactcactctctattgccttatcaatttgcacgctttgattaagcaagctgccatgttgaagaggcccatttggcaaggagctaaatcttgcgaacaatcatgtgagtaaggttagaagcagccccttccccaggagatgactataatcccagtcaacaccttgattacagtctatgagaaaccctgaagtcgaagacccagataagctgtgccctgattcctgactcacagaaactgtaagatggtaatatgttgtttaaaccactaagttttgggccaatttgtcacacagcagtaggtaactaatatactgtttaaaaaaattgtatgaattttctggattactaacgtattttttccaataattgaatccacagatattcactcttccacaaaatttcgaatttgccagtctttcagtttatggctcttttttagacattacttattaaacaatatatacaaaattataaacatgtatgtagcaacaacagagcaccaaaatatatgatgccaaaaccaagaagaaatgaagggaggaagagctaatacaacaacaataactagagacttcgatactttcagtaacggatacagaggccgggcacggtgctcacacctagcactttgggagaccgaggcaggtggatcacctgaggtcaggagtttgagaccagcctggccaacatggccagtgatgaaacctcgtctctcaggagtttgagaccagcctggccaacatggccagtggtgaaacctcgtctctactaaaaatacaaaaattagctggtcatggtggtgagcacctgtaatcccagctacttgggagggtaaggcaggagaatcacttgaatctgggaggcggaggttgcagtgagccaagatcgtgccactgcactccagcctgggcaacaagaacaaaactccatcta

SEQ ID NO: 214138 - DNA, 836 bp, Homo sapiens
ccagcagaagctagcacctttggagccttgggaacccatgaacatcccgacagtaccctcagtggaagcctttgagcacaagtttacgggaacgaggcaccagatgccgtttctcacatcctaacttgatagaggggacttgggcaagatgcagcttcaggcgttggcaggggatctgcatttcttctccacccagaaccataggccacgcgctagatgagagtgggacaaacactgccgtttgtgtttcttctcaggagctaacaccactctgtgtgtggcctgggtagggccttaagaaatctctgtcttgctgttgcaatcctgcctcactgaccgagtcactcaccatatgttgagttcctgctgcatgtcagccctgtgactgaagagatcgggtcccacaggggcagcggtataagggtgggggtacgcatcccacaccagaatccgttcccaaagcttgagtcacagcacctggggcgagtggcactgggatgctttgtgatgtgttcccatggcagcagagccttggggacacttgagtcatgcaagttcataagagggacacctagcaagttcgtattgctggagacagagtcgctctccgtatgagcagaatagtgatcgatttacgttcaggggttccatgttcttctttttgaagagacgaagtagaaatgattaggcatgtcagcaacttagcatgattctagagtatgcattcccaatgaacattctatctggaagatttagggacttctctgttatctaatctgtcagtgaaatgaagattaattttgcatcaattaattctaatacctttttttaactga

SEQ ID NO: 214139 - DNA, 393 bp, Homo sapiens
cttcttgaagctgtgagggagtcatcatctattgggcaagaggtgctgggaagagtgataagtatgacaagcaagattccttccctcatggagcttatagtctaggagggacacagacaggaaactagcaagccacaaacgcatcactgaaagtagggaatgcaactcaggtaaagagggggattgtcagagagactaaaggggcgctccttgggggtgaggagtcaggggggcctttgtttcaaggacatttgaggataaggaacatcgaaggataaggaggcggttgggtcaagactgggggtgcagggtgtctgggtagacaggggatcacgtggagaggagacagcagtgtaaagtggatgactgaggagagaacacatggggcggggc

SEQ ID NO: 214140 - DNA, 292 bp, Homo sapiens
cagttctaactgtggaggttctggagggtgtggaagttctgttctcacctctgagtagaggaattgggagactggaggacaaaataagaggaagatttatttttcactgtttgtccttttacactcttaacattttaaaaagcacatctctgtatagcccattccaaaaagataattatgcattttttaatgcatgtgtatttagtgttttacttcatcatagagccttgtttattctattcagatagaaacaattgtttatcaaataaaattgtcctccagaaaaacagac

SEQ ID NO: 214141 - DNA, 113 bp, Homo sapiens
ctgttactctttcaaacgtttatgttaaaggctcatttggtttaatttccactcagaatagatgttaaggatacaaaaccaaatgtctagctgactactactgttctttccct

SEQ ID NO: 214142 - DNA, 457 bp, Homo sapiens
ctacaatgagatatcatctgaccccagttaaaatggcatttatccaaaagacaggcaataataacaaatgttgacaaggacgtggagaaaagggaacgcttgtacactgttggtaggaatgtaagttagtacaacccctatggagaacagtttggagtttcctcaaaaaaccaaaaatagggctactatccaattcagccatcctactgctgagtatacacccaaaagaaaggaaatcagcatatcgaagagatatctgcactcccatgtttgttgcagtattgttcacaatagccaagatttggagcaacctaagtgtccaccaacagatacatggataaagaaaatgtggtacatatgtacagtcataaaaaaagaactagatttgattatttgcaataacatggatgaaactggaggtcattatttaagtgaaataaaccaggcacagaaagac

SEQ ID NO: 214143 - DNA, 470 bp, Homo sapiens
aaggaaaaacaagcagggctgaaatccagtctgcacagagctggcacagagctaccttaacccagacccagagcaaggggtacttttttgtaattggtccaatcagcagggttcctttttgtaatatgcacaaagaaatggtatattctagcagacggccttgcataacaaaaagatatgacctaagtactttaggcagcaaaatttaaaagagaaagtccatattagcttggagatgttaaagaaagacttcagctagtagaggtcttctgattacatttatcatgagataaatgcattgctattcagttgtttacttacatcatctttaccgttttttaattttctgtaaggatgtagcagggtatttttagccaagcctacataacctcagacggatcacaataggattattttcaaccctggtccaattcattgaggactaacttagtctacacaagcagtaatgg

SEQ ID NO: 214144 - DNA, 533 bp, Homo sapiens
tcctggacctgctccaggggtctctgtggctgacccctaacgaccattctggctgtgtccctggaagctggtgctgtggcccagcctggtggatggcactatcagtagctccctggaacctggggcctttaacaaactttcattaaccccgccatgcccggagtcacaatgctgaaattacatgggcctgtgcctatgaaatattaagtgcataaaaaaggacttacgaagacaggtttggagcatacatttttgccctttactaagcaattgggttagtatataaaccagtttggagggagctaataaaacttctgtttgcttgtttgaagaccaggtatttttaatgctgaatggctagcatttttaaagccaagcttgacttggtcaggtgacatagaatcaaatatagggagctggcacggtggctcacgcctgtaaatccaaaagctttaggaggctgaggcaggaggatcatttgaggccaggagttcgagaccagcctgggcaacataacaagacccatctctaca

SEQ ID NO: 214145 - DNA, 633 bp, Homo sapiens
tacagcgctaggtgggaaaatggggtttaagcagtaactagagaccaggcatgagctatgattaaccactttaaaaaatgattaattagctctaacagcaacttaaatgtcctaaagaatagatggctaccaaaattaagggtggccttcagggtacaaaactgtaaacccgggtatctgaatccgtgtcacatacagagggtaggaattagagcagtatctacatcaatactactactccttcagaacactggatgtcatgagcctgtggtatctcagctttaagaccctgaccatttattagaaactgccgttaggatcatttcagtgctaataatgcaatggtggctgggagcggaggctcacacctgtaatcccagcactttgggaggctgaggcaggcagatcacgaggtcaggagttcaagaccagcctggccaatatggtgaaaccctgtctctactaggaaaaaaaaaaaaaaaaaattagctgggcctggtggcacacatgtgtagtcccagctactcgggaggctgaagcagaaaaatcgctcgaacccaggaggcggaagttgcagtgagccgagagcgtgccactgcactccagcctgggtaacagagcgaggctctgtca

SEQ ID NO: 214146 - DNA, 292 bp, Homo sapiens
cacacgctaggggcgtgaccttgggaaaatcactttgccttgtgcttttacagaaagaacaaggccttttgtgggggattgtggagaggaatgtccatgtgtatgtgtatgtgtatgtattgcatatctatgtggtcattccctggtacatagtaggtgcttcataaacaaaaataccctcccatatcactgcccttctattccatttgtgccatagtgtgtgacctaagagtagataaagcactttttttgtttgtttgttttggtttagatggagtctcactctgtcgcc

SEQ ID NO: 214147 - DNA, 858 bp, Homo sapiens
gagcagaaggtaaagagatatctcacacaccttgtgcccttacaaatgcatagcctcccccattcccagcgtcccccaccagagtggtacatttgttagaatcggtgagcctacgctgatacatcattgccacccaaattctgtagtttacacaggagggttcgcttttgggtttgggtaaacgtataatgaccattataagtgtcatacagagtagcttcactgccctaaacatcccctgtgctctgcctaggcatccctcaacttctttaattttcatgataaaattggaagaaaagtgtttattatgtatgttttatgtatgaagagactgcagctcagagaggttaagtttattgcccacagccacatagctgctaagtggcaaaaccaggctcaaagccagggctagcttttctttctacagaactgctgcctccaacacctgcctctgccctgagcatgttgccctctagaatccgaaaagctctgtaggtggagggacttgtgttacaagatgctggtcctcaagatttgttggtcaaatgaatgaatggtgtaattctgatgtttgcctttgcagataaagagaatgctgccttttttctgcacaaagaaaaacaattacaaagcagaaaacaaagcagtgaaggctaaaaggaatattaaaattttctgaaataaagttagttattcacagtaaaatactccagactttctccaacagggcctttgctttataacccagaggacttttaggatagaaaatactgacaccaaatggtgacaagtagaactcccatgtctgggacaatagaaacatctgaaatgaactctgctctgtctggccggctcact

SEQ ID NO: 214148 - DNA, 1015 bp, Homo sapiens
gtgtatggctatcatttgttttgaggttagttgattagtcatgttgggtggtgattagtcggttgttgatgagatattgggaggtggggatcaatagagggggaaatagaatgatcaccaccgcgcccagcctaatagtatattatttttaaatgtgggctctattagtaggatcagggagttctgtaaatccttgaaattacagtaaaaaattctaatgtgaggctttttttctggaaattcctaaaccaaggctaagaaccactgttctaaaagaagtaaatagtggaattcttagagtcaagaatactttatataagcaaggtataaaagaagggcttgggctagatgatcacaaaggtctcttctagttattattaactatgacttaaagaatgtaccggcatgaactaagtgctaatactgagttaagtactatggaagatataagaaattattaaacagttaatttctttaggtttacaaattttattggaaagaaaacaatacaagatggtccatgcttaaagagtcaagtggggctcacattaagtagggctaggagacatggggaaagatggaaggaggcttaaacttgaccttgaaaaaggaggtgaataggtgggttcggaatagccaagaatgggaatgtgagttttgacattatgtggaaactccttatgcaggaaacaattggtagattgatacctaagaaggaaccaggagtgattcagatctatagtgccagggagacaagttatttaaaagttgaggatgagacttttaaaacctaacttgggtttttgttaatgtatacattttcctaacttttttcattctccccacactttcctgtgtttttggattgctgtctgtttaataacttttcagtggcacttgggaaggtgcaaatggattgtacagatggactgttttgacagtttaaagtgggaattctttatattgtttcaaggacaggcttcaaacttccccccgtctttgttttttctaacag

SEQ ID NO: 214149 - DNA, 992 bp, Homo sapiens
ggggtttcaccgtgttggtcaggatggtctcgatctcctgaccccatgatctgcccgccttggcctcccgaagtgctgggattacaggcgtgagccaccgcgcccagcctaatagtatattatttttaaatgtgggctctattagtaggatcagggagttctgtaaatccttgaaattacagtaaaaaattctaatgtgaggctttttttctggaaattcctaaaccaaggctaagaaccactgttctaaaagaagtaaatagtggaattcttagagtcaagaatactttatataagcaaggtataaaagaagggcttgggctagatgatcacaaaggtctcttctagttattattaactatgacttaaagaatgtaccggcatgaactaagtgctaatactgagttaagtactatggaagatataagaaattattaaacagttaatttctttaggtttacaaattttattggaaagaaaacaatacaagatggtccatgcttaaagagtcaagtggggctcacattaagtagggctaggagacatggggaaagatggaaggaggcttaaacttgaccttgaaaaaggaggtgaataggtgggttcggaatagccaagaatgggaatgtgagttttgacattatgtggaaactccttatgcaggaaacaattggtagattgatacctaagaaggaaccaggagtgattcagatctatagtgccagggagacaagttatttaaaagttgaggatgagacttttaaaacctaacttgggtttttgttaatgtatacattttcctaacttttttcattctccccacactttcctgtgtttttggattgctgtctgtttaataacttttcagtggcacttgggaaggtgcaaatggattgtacagatggactgttttgacagtttaaagtgggaattctttatattgtttcaaggacaggcttcaaacttccccccgtctttgttttttctaacag

SEQ ID NO: 214150 - DNA, 199 bp, Homo sapiens
gtaagtcagagtactattcatatttatataaatagcatgaaatagttatacatttgactcaagatacgtgaaagtatgggacttttatttgtccaaagaattattgatctgttaatgattgttagatttaatttaaataaattatatttgttgtaagagaaatttgaagatgagcttcatttctcttttattataaacc

SEQ ID NO: 214151 - DNA, 842 bp, Homo sapiens
agctgtaccattttacattcctaccagcagtgcacaaaagttccgatttctctacatccttaacacttgttactttgttttttgaatagtagcaatccttacgggtgtgacgtggcatctcattgtggttttgacttacatttctgtaataattagtgatgttggacatctttacatgtgcttattgactaattgtacatcatttttgaagaaatacctatttaagacctttgctaatttttaaaatcagagtttttttgttattgagttgtgggagttctttattatctattctggatattaccccttatcagatacatgatttgcaaatgttttctgcatagtgggttgccttttcactgtgttgattgtgtcctttgatacataggagcttttaattttgatacagtccaatttatcttttcttttgttgcctgtgcttttggtgtcacatctaagacatcgttgccaaatccaataccatgaagctttcctcatatgcttgcttctaagagttttatctataggtttagctcttaatgtttagatgcctaaccacagagtgtcaaaatacatgtcagaaagcaaaagaatggcaaggagaaatagatgaatccactgttacagttggagatttttaacacctctctatcagaaatggacagagacagaaaatcagtaaggacgtagttgagttcagcaacaccatcaaccaactggatataatggatgtcgaaagacaacttcattaacaacagcagaacccatattcttctcagggtcacatggaacattcaccaggacagattacaatctgggcaagaaaacaaaccttaacagat

SEQ ID NO: 214152 - DNA, 150 bp, Homo sapiens
agaaggcagaatcaaagaaactagtcagcatagctgtgatggacatttgcaggttgtactgtctagcatcaatcttcctttccattaggggaacacctgttgtgggtagcttgaagggacagtgccctgcctccttctcctggtctcctg

SEQ ID NO: 214153 - DNA, 254 bp, Homo sapiens
agattaagggttgtttcatggacagtggaaattaaatgaagtcatcagtgccactataagcatcttaagaaggtttctttgctgagttttttttaagcaaggaatactcttgtgagtattaagttaacctgtctagattgagttgtgttttcttctgcagtacttctaactttctgttttataatattcttctaggtgatgtgccaaattatagattattgaaataccttataataaaatcctcttaaactttg

SEQ ID NO: 214154 - DNA, 294 bp, Homo sapiens
gaatgagggaattgatgtacatcagagtcaagtagtaaaataagtgttaagtgggaggccgaggctggtggatcacgaggtcaggagatcgagaccatcctggctaacacggtgaaaccccgtctctattaaaaatacaaaaaattatccaggcgtggtggtgggcccctgtagtcccagctactcgggcggctgaggcaggagaatggcgtgaacccgggaggcagagcttgcggtgagctgagatggagccactgcactccagcctgggcgacagagccagactccgtctca

SEQ ID NO: 214155 - DNA, 576 bp, Homo sapiens
gatagccaatatggggtaaaatattttgcaaaccgtgatagcaaacatttggagagtgggagttgagatgcggcagatgcctgtgtatttatccctgcagcagccttgtgaattcaggaggagggacccacagaggggtgtttgaagctcagagatgttggcgggtgtgcatcactaccagtcatgcacgtggaggactggacctgagatcactatctcagctgaaatggcgctatcctaaaaattgcatgcagtcagaaatagagccctgtttggtggtggtggtggttaacaaggaaggccacccaccacatcgggcagggccagctttgtgctcccacacagtcctctacctcgggtggggtgcagcctgaagcccccttacttactggttatgcctgtgattttgcaaacagtgtcagaaagattccatgacgaccacctatggatccaagggtaagaaccttggtgcagtgtgtggtacttggcttttaattccccagagagaattctgaaaactgagtagtgaaatgaaccttctagaaaggaatgcttcaaatctcagctctgcttccc

SEQ ID NO: 214156 - DNA, 1103 bp, Homo sapiens
tagccttggctttctgctggtgttaatgtgagtgggtctctgttgacctgggcatgactcactaaactgcagggaaggtaacaccaagtgctccttcccttggggtgaatgacctgagttttgggacagactctggtctcgagccaattattttacttgtttgagcctgactaaaatgagaggaatggacaggatggtgtctaaggttcagtgctgctctgacattctcagcctagagatgtttttcctgcttacctgcaagccctgtggtgtccttgcctggccctaggattatttataagctccagtcttcattcatctgtttgcccctttttggatgtgaactctataactgtgagatagtaccttcttgttctttgtgtggcaccctttcagcagctgggtctggtatgtcactgggctggtagtcgatgctgattttcagaacaaagaatgacctttgaatagccagagtgttggctgccaggtctataacccggattgttttaatgaaagtgccaacaacaacagtatttttaaaaatggactgtcgttggagttcatcagacctttttaaaaatgtcattcccttccactcttaaatcttatagccattttgagtaattctttaaaaaaaaatctctaaagaggcctattccttatacagctgaaaatcattaattatttcctgtccttgcgtcaacttcctcttgcccagaaagggtagctgagagtggtttcctgacttctgggaagggaaaacttccttgttctcaccactctgcccttgggctctaacctcaaagtggtagagcaacagctgtactccgaacaatgttaatgtgaacctttggctaatggaagcaaaattttaggaataaaagtcactttcaattatggctgatgtaaggtgtggttgtgggaatgggggtaggaagacaggagttctgtaaggtttaagttacagaattaaaattgtttgatagaaaaagtacatgacattttattgttttcttaaactaattgtttttagacaggaggcccagagacctagctttatatcccagcctggtaagagcttgaatatcttgaaattatttggt

SEQ ID NO: 214157 - DNA, 566 bp, Homo sapiens
tagtacaactgattgatggctcaggagcaggtattgcccaaaatcctgggtatgtggaattggaattgtggagagttgttggtgggtaataagacttcgccccacagttgagatttaggaactatgtactcacttatggcaggaaggctttataagaagggggctatgagagaaaatatttgcaaatcatctgggcacagtgatgcatgcctgtagtcccagctactcaggaggctgagatggcaggatcccttaagcctagagttcgacaccagcctggacaacatagtgggatcacatctctataaatgaaggaatgaatgaaaaccattgaaaaaatatttgtaaatcatatttctgataagggatttatatccagaatatagtactcttacattcaatgataagataaaatttaataaggggcaacgatttgagtagccatttctgcaaagaagatatacaaatggccaataagcacacaaaaaggtactcaacatcccactagggaaatgcacattaaaactgcagtgagagactattttacatccgtagggtgtctgttg

SEQ ID NO: 214158 - DNA, 334 bp, Homo sapiens
caccttggagggcacagggaccgataacaaatgtatgtgtgcaccacaacacccatgtaaaacaagtctacttgccccgtgatgaaaaactattcaccttgacaaaacaggcatgatattcatttggaggcttgcttctaagaaagataaatcctgctgtcactgcacaaagagataagaaagaccggatgacagtttttcattgataaaagattctgtctgtattttaaaagaatttactttctcccctctactgatacccacatgagttaaggcagagatacactatctttcatgtttttgtcagaatgtgttattactgtgggtggcggtg

SEQ ID NO: 214159 - DNA, 333 bp, Homo sapiens
agagatgatggcagagaagcagaggggtgttttagagtgaccaggacagagacagagatgatggcgaagaaacacaagggtgttttagaggctgaatgttaggaattcagaaagcaatttcttcatgatgtgtattttcaatgttgtttcattccctcagctccatctctagagaagcggcccatgctgttgatgacctgagtctacaagtttcctcacaaattgtattcagagagcagcttcctgcttggtgggtgtccgtagtccccacagatccctacaatggagagcaactcagagactgaataaatagaaaataatttattttaggct

SEQ ID NO: 214160 - DNA, 1061 bp, Homo sapiens
ggcctgtacaaaaaactactttgtatatgccttattttattaattttgcttctgaatttcatcaaattctctgatcataactctatattcttgtaaggaatgctcagaattatactatttcactccaaattttattattattgagacgaaactgggtatagaaagttgtgggaccagtttgtaatttattgctttaaaatttggtcaagccactcaaattctctagctgtacctatgaaatagctttaatatttcaatcccctgcattttctttgaataatatggagtttgaattgaagtggtcctgaatttgagtgctgcatatgctacttttgagatatgtgatcttgagcaagttgcttaatcacattaagcctcaattctctcatctttaaaatagaaaaaataatagctactttacagtgttgagaaaagaataagatgaaacagtttattaaaaacatagaagagtgattaagacataataaagtctacataaattgtgcctattgttattactaataaaaaaaaagaaattctacgtgtcaggaatttgaacaaattacagctggatttgcatatttcttccacaagatgtatgtggtcccatctgataatagggaattggttggtaactggaatcttcttggaaacctcttaaatcacagatcttgcacttgtactgggataatctggagtgtgtgctccgctgagtttgttgaccaaatcacctacaggtgaactctccatatatgtattttcctagtcaattcctacactgacctcaagcaaacactgatcagctttctgtcataatagatgcgatttacttttttagaatttaataaaaatcaaattatactgtatgcatccttttgtgtctggattgcttttttttctctgccttacattgttgaatatattctaggtatgttttactaattgcttggttgtatattaatgcatactgcattttgtttatccattcaactattgatggaaattggagttgttttcagtttctggttataaataaaacagctatgaacatttacatacca

SEQ ID NO: 214161 - DNA, 343 bp, Homo sapiens
agttttgccatgttggccaggctggtcttgaactcttgacctcaagtgatctgcctgtctcggcctcccaaagtgctgggattacaggcatgagccaccacacccggtccagatttactgaatttaagtgtgatcctttttctctatgtggccttggctcactacatgtggtgtttccttgtagcatatgccatagggtttcatgcctgttctatcacaatgagtgctaaaagtttctattttttttttccttgggctaaaactatgaagtgtacagtgaaaacttaaataaacaaaaagtctctgccttgttacttagaaggtattatggaacatgtatatt

SEQ ID NO: 214162 - DNA, 505 bp, Homo sapiens
ggaatatttccaaccttaagttctacagattcaaactatcgatcaaacataaagatagaaaaaaagcattttcaggcatgtggcagggtaacaagctcatcctggtttgtccaggattttcctggcttcagcagcattagtctcacatcctgggaattccctcagtcctaggtaaactatttacccagatataacctggttaaaaaaaaaaaaacctaaaattcacatgtcccaataatctctcaatcccaggcaaatcaaggaagttggtgacccctgatgaggtctcaaaaactttctgtgtcatggtcactttctagcgaggttactagaggattctgtcaactgaatcatgagatttaacaaaaagtaaggactgtagctcacatcatcctcaatggtgaaacactagacattttccccgatgaatggaataagacaagggtgcctactctcactatttctattcaactttgtactagaagttctagccaggggagttaag

SEQ ID NO: 214163 - DNA, 616 bp, Homo sapiens
ataatttccttgataagatttagtattaatcactcaatcgtaggtttttttttaactaattaatttatttagatggagtctcgctctgctgcccaggctggagtgcagtcgtgcaatctcgactcactgcaacctccacctctcgggttcaagcaattcccctgtctcagcttcctgagtagctgggactaaggcgctggctaatttttgtatctttagtagaggcggggtttcaccatgttgctaggctgttctagatctcctgacctcaggtgatccactcaccttggcctccccaagtgctgggattacaggtgtgagtcaccgcgcccagccaatcatagatttttaactgcctaaaattgttcagtgtgtctgatgaagactactattttttgagcttttactgtgtgccaagcactgtattcagttatttgttgaatttccccaacaacttcaggtggcaagtattatttttatacatgagtaaactcaggcatggagagaaaaatagcttgtgcaaaatcacgcagcgactatgtggtacagcttcgactttctgagttgaaagtttgcacttctaaccagaacttggtacctcctcccttgcagctgg

SEQ ID NO: 214164 - DNA, 457 bp, Homo sapiens
tgcattccagcctgggtgatagagtatctcaaaaaaaaaaaaaaaaaaaaaagaaaagaaaaaaaaaggtgggggaaaagtataaaaattccttaaattaagaatctcttaaaatgaagagaatgtgactattaatgataatgatattatatttttaaaattcctacttttattgttttattgtggtaaaacagacatacaatttaccattttaaacttttttttttttttaaagagacagggtctcgctatgttgcccaggctagactcaaacccctgaactggagccatgtacgcacctcagcttcccaagtagctgggacgacagatgcatgacactgagcctggttgatttttttttttttttttttttttttgagagggaatatcactctgtcacccaggctggagtgcagtggcacaatctccgttcgctgcaacctctgcctcctgggtt

SEQ ID NO: 214165 - DNA, 1034 bp, Homo sapiens
tgcaatagttttggtttctcctggtgtgattttattataaatacctgtatattgaaattattcatttattcagtacagcttgttgagcaccaagaatgtgccaggtttagggctggatgcttggaacacaaagacaagtaagtcatggatggttccctgcccgcagggctttgctataaaacagtgaaaataaggagaacagaaggaagtctaaaagacaaaggaaaatgttttgtctctgtttatagttttgattgtcttttcatgcactctaaaagatgaatataaaaactactaaggaatgagactatattatttttgtaatacttcgtcgaatgcaaatagtaaaataaaaataattttcttatacatggaaaatcacatttcatgttacatttcattaagagcctaaaggacatgagtgtaatttccaagaggcagaattttttattcactgctgtatattcagtggctagaacattggctgacgcatactagtcacttaataaatatttgctgaataaatgaaatggaaaatatgaactagcagaattttgtattttgtagatgttattagtatgaattgtatttcctaatagaagtgtctaaaatatgtgatgcctacttctgattaaatatataacattttcaataaaatattaagagttagaatatgttttgaagcagtgtgtaaattgtgaagtaattttagaatgttcctaaagtaattcatattagatttttaggcacaaaatttatttttaaataaattacaaagggttaataaatacaccagattctgaatttttaacaccatttggaaagtggtatgagaaatatatcaaattctgtttttttatttattattcatgtgtttattcttaactctatctcttgcaaatatcatcccaggcttattccttatatataaaagtaagggcaagacagagctacttctgatgtcttaaataaatatcacttgtatggttttaaattttgaaaacactttttaaaaaatttgaaagccttcttga

SEQ ID NO: 214166 - DNA, 274 bp, Homo sapiens
gtaatggttgcacagcaatgtgaatgtacttaataccactgaactctacacttaaaaacagttaaaatggcaaaattttgttatgtatatcttgccaacattaaaaataacaagtaaatatgctcattatcccttagaccaaactatcctacttctggcaatttgtcctctaggtattctacaaaatgatatgtatatggacaggacatttgtactatgtgtaattaaaaaaactgaaaaaaagatgctcaccaacaaagggcaagatgaataa

SEQ ID NO: 214167 - DNA, 478 bp, Homo sapiens
gtgaaaccacatctctactaaaaaatatatacaacaattagctgggcatggtggcaggcacctgtagtcccagctactcaggaggctgaggcaggagaatcgcttgaacccaggaggtggaggctgcagtgagccgagatcgtgccactgtactccagcctaggtgacagagtgagactccgtctcaaacaaaacaaaacaaaacaaaacaaaacaaaaatgtaatgggcaggctatctgcctggagacaaagtacatgcccatttctgagaacattatttgtcctggaaaggtagtttcatagtgggattcttcttccctgcttcttcctgggtcccacaaggttgatcttcctccatacctttcttttgttccctaacattttacagcattgattttctaacaaaaggaaggaaagttcctagggaggtatatcaacatttctaaaaggaaatgtatgtatactttgaaaatacat

SEQ ID NO: 214168 - DNA, 382 bp, Homo sapiens
acatttctccagtaaaacgtgtctgatgggttaggaccatttgtctccaaggaatggcagtggttttctttttaattgtttgtttgtgtttttcaagataatgctgagagacatccaaggagtacagttcaagaggtgattttaaaaagcagataattacttgagaatggctagagtcattggaatctgattagctcctttcactatcaaatacctattttgattttcaatactagggagaaactgattttatcacattataatgtttattgcaaaacaaagtcataactctttaaaaatgtgtatgttggtcatgtttatttaaaattacatttaaggaatcatatatgactcataccacaaatgtaattcatcagacact

SEQ ID NO: 214169 - DNA, 521 bp, Homo sapiens
aacccctgcttctgccgcagcacagggaggggttctctctggaagttcccttatctgatgaaaacttcttccaaaggaaatgcacttgtcttaagattccctttctctctgaatctcatcaaataaccaggaaaaatcaaccacttgagaagagactcaaagtcctcaccatgcccagacagattttcatttattcttctgagagctgcaccaagagattacttaagagactgttttggcataagactaccattaacagtgcagtttcaccccccaccttcccgtaactcatcccattcaacttctgaaaataatcatttacaaactattgtctgatctttgggctcattaaattcccctaaatattattcactacctttcaaaattgtccactcccctctgtcttcgacctctcccctaggaagagggtgcattttaaacctcagctatctggaccttctttgaatctcatattctatctcatgtacacattaatacatttgtatgccttttatccagtt

SEQ ID NO: 214170 - DNA, 751 bp, Homo sapiens
ttatttttctttatttgaatgtaacacaatctagatcatgctggatcattcttttattatttctttgaagaattgtgtttcctgagtaggttgagtattttatagacaacacattaatagtcaaatacttatgaactgtcaacaccgtattgtatatttccctacataccaatttggataattggagttaatgagaccaaacgatcaaaactagtgtgatgtgttcagatagtacatgatgtaggaagatccagctataaaactatcacttcaaagtggtcaatacagatgctcagtgaagcttagtttttgaaatattatgtacctaagcaacacaatgaatgactttgctgagtgaattttacaaacctatagtcttttctgcatttcattaattctcttagagtgcactgtgttaaggcagaatgtattacgtgtgaataagaagtgtccagtaattttcgaagtgcagattgtgatccattagtgaattaccttaacagttcagatgtttatgacaagaatcaaacatagataatagaaaatattgtgtccggacttggtgggttcttggtcttactgacttaaagaatagaagccgctgaccctcgcggtgagtgttacagttcttaaaggcggcgtgtccggagtttgttccttctgatgttcagatgtgttcggagtttcttccttctggtgggttcgtggtctcgctggctcaggagtgaagctgcagaccttcgcggtgagt

SEQ ID NO: 214171 - DNA, 472 bp, Homo sapiens
agatagggtctagctctgtcacccaggctggagtgcagtggcaggatcacaactcactgcagcctcaactgccagaatacaagcgatcctcccacctcagcctcttgagtaggtgggactacaggcacacaccaccacacctggctaaattttgtactacttgtagagatgggatcttgctatgttgcccaggctggtctctaactcccaagctcaagcaatccgcccacctcgtcctcttaaagcgctgggatttcatgcgtgagccaccgcgcctggtgtgtctttccatttcagatcagactggaccaaccctttgggtttgcagacaaggaaaccgagacccagagaagggaagcaacatgctcaagcccacacaacaagctgctgggaagggccaggaaagaatctgtcccccagatgactctgctcagcaccggctcccttctctcctcatcccataccccataac

SEQ ID NO: 214172 - DNA, 200 bp, Homo sapiens
gagaaaagagatatagagagtttcagaaactttccagtttcaagatccatcccttctcaagacccaactatatatatcctgtcctacagttcttaaaagaacccctgtacactaagtacatttcccctttttattcaggatgtctcagccaggcacggtggctcacgcctgtaatcccagcactttgggaggctgaggtg

SEQ ID NO: 214173 - DNA, 556 bp, Homo sapiens
aaagatactaactggagcccttatcactagatactgttgcatataaatagtaggtatatggtacgttagaagaaggggtcctagtattcttgaccgtgattatttgagatgatgtgattaatcatctacaaggtaatctgacgctaatggttctatgtgatccttcctccttgggagattaagcacttaattgtcctactgttcttccaaagaaatacttaagtgagataccttgaggaggtggtaaggctaagaaagtggattcctgagtaaaatgtcctggattccaatcctcgtattatttgtgaaattttgggtgagtcacttaatctctccaagactaaattttcctatctatgaaatgaatttaattgctgtgcctactccataggattattataagaagtaaatgatgccgggtacagtggctcacacctgtaatcccaggtggctgggattacaggcatgcaccaccacgcatggctaattttgtttttttagtagagacggggtatctccatgttggtcaggctggtctcgaactcccgacctcagg

SEQ ID NO: 214174 - DNA, 424 bp, Homo sapiens
cacgtgagagccttcagaataaagacccaagctaacaataagatacagaagcttttatattaatatcatcttagttgatagaaataatgtggactcagagcatgccccacaacaggttttagttgtaaggcaggttataagagagagaaaggaagaggcttgactggcaagggtggtcttgttaggtaaatgaagcttccctcagagaaaatagatggtaaatgtttccttttagacttttaaaggtgtcagcctctcaatctctcttagttctaggaaaggcatacaaaaggccttagtaagctgagcgtggtggctcatgcctgtaatcctagcactttgggaggccaaggcctagcactttgatcatgaggtcaagagatcaagaccatcctggccaacatggtgaaaccccgtctctgct

SEQ ID NO: 214175 - DNA, 784 bp, Homo sapiens
agctcgcctttccagggttatttttggctgaggctgttcgctgatggcaaaaggtttcagccccctcccaaatccctccccgtccttgttctaaagagaaactggtgtgtgtaggctgcgcactcccagggagacagggagacgggccgggcgccggagaggcttttgggacaccccgaaagtgagtccaacttggggagaaactgagggcagctcgggcggtctggcagcggagaaggtgggtgggagaaaactttacaggaaggcagaagcaatctctgccgagagagtcagccgagcggccgcgcggagaggaggggcgggcggtccccaggcgggcgggtgcagggcgcagggcgccgacctgctggagagggggcccgggcgcgaggcggagtcccggcgcgcagccaggctggtggaggcccccggcaggctgcagattccctccggctccgggagccgcagcaggaccggccaggaggcgccatggaggggagccccatcccggtgctgacagtgcccaccgcgccctacgaggaccagcggccggccggcggcgggggtctgcggtgacccaccggcctcttttagggccagcgcaactacctgcccaactttatccagagcgtgctgtcgtccatcgacctgcgcgaccgtcagggctgcaccatggtggtgggcagcgacggcaggtactttagcaggacggccatcgagatcgtggtgcagatggccgcggccaacgggattggacgactgattattggacagaatggcatct

SEQ ID NO: 214176 - DNA, 701 bp, Homo sapiens
cggcgatcgcgggtgaaggctggggccaggcgcgggtggaggcgtcaccggggtcgggctagcaggccctggaatcaggcttttgggacaccccgaaagtgagtccaacttggggagaaactgagggcagctcgggcggtctggcagcggagaaggtgggtgggagaaaactttacaggaaggcagaagcaatctctgccgagagagtcagccgagcggccgcgcggagaggaggggcgggcggtccccaggcgggcgggtgcagggcgcagggcgccgacctgctggagagggggcccgggcgcgaggcggagtcccggcgcgcagccaggctggtggaggcccccggcaggctgcagattccctccggctccgggagccgcagcaggaccggccaggaggcgccatggaggggagccccatcccggtgctgacagtgcccaccgcgccctacgaggaccagcggccggccggcggcgggggtctgcggtgacccaccggcctcttttagggccagcgcaactacctgcccaactttatccagagcgtgctgtcgtccatcgacctgcgcgaccgtcagggctgcaccatggtggtgggcagcgacggcaggtactttagcaggacggccatcgagatcgtggtgcagatggccgcggccaacgggattggacgactgattattggacagaatggcatct

SEQ ID NO: 214177 - DNA, 524 bp, Homo sapiens
ccaggaagttgacatttgcacaataatgctaactagactacaggcttcattcagttttcagcagtttttacctgccactcagttggggagagggggcattatgtgtgggggtatgaacaagtaagtgtgagtaagtatagtcttttgcaaaattgaatcccctgtatggattcctgtaaccaccatcacaatcaggatacagaatggttctattgccataaagcaatgagcagggcctacccctttgtactcacaccaccttcttcactgtctcctggtaaccactaatctgttctctatttctatcattttgtcatttcaagaatgttatataaatagaatcatatagtatgcaaacttttgagattggttttttcactaagcataatgcccatgaaatccctccaagttgttgcatgtgccaatcatttgttcatcttattgctgaagagtattccatgatatagacacaccagtttgtttaaccatttacccattaaaggacatttgtgttatttccaatt

SEQ ID NO: 214178 - DNA, 155 bp, Homo sapiens
aaatacttttatggatcgtggttcaaaaacagcccagtgctgcttcacaggaaactgaggcagaaggatccctggaccctaggagttccaggctagctgggcaacatagcaagacccttgtttcttgataaaagaaaaaaaagaaacaaagaacc

SEQ ID NO: 214179 - DNA, 350 bp, Homo sapiens
atcaccttgtttaatcctagtgacagtcttgtgagatgggatttattgtccccatttcacatggggaaactggtggggtgtggtggctcacacctgtgatcccagcactttgggaggctgaggcaggaggatcacttgagcccaggagttcgaagccagcctgcgcagtaagacctcatcttaccataaatgtttaaaaattagccaggcatggtggtacctgtctgtagttccagctactctggaggctgaggcaggaggattgcttgagcctgacaggtggaggctgcagtgagccatgataatgccactgcactctagcctgggtgacagagtgagactctatctta

SEQ ID NO: 214180 - DNA, 575 bp, Homo sapiens
atattattaaccatgctgaccatgccacatttccccagcatctaggagtgttctcttcctagagcatgctttctgagttgttcacgtgaacatctacaatgttgcaggagcctttttttttcctatgggcaaaatcatctattgaccaaaacaagacatttaagtcactcagattctgaaggtaccccaaaaccagggataccccttttcctctttactgatcatcgagccaaggaaaagccactggaagggacttgggctcacacttacaaatagctggcttgcatggaaggcattagaagtggtttcctgaagacctggacaactgcctggctatcgttctggctgagtggaccctcagatacccaagtggtgtgagctggctgcactctgttctttgggctctgagaaacaaatcctttggattttcaaaactatatttagaattttcataaagtctgtaacagacttggccctaggatggccaagtctccatctggatagcccagcctgtgatcaaaggctgtgggcatcttcatcgtatggaaaagtaaattcactggcacatctcacta

SEQ ID NO: 214181 - DNA, 497 bp, Homo sapiens
gagccggcagcccctctccgtttccttagacacttactgatgctgctcctcccagcctgatgagtgacggatgaagatattagatttctattatccctaagtctctcgtttgtttcctgaggcaagtctacataaggccgggttcccttgtttccaaggcccgcctatcgtgtttgcactgactgagctcctccctggtgggcccctagaagctgttgtacttatcaagtattcttcagccctctattcttttacctactcaggaaattgccctcttattatcaagaagacctcatcaaacaagtttcttatctgactcctctctaacgagaaacccataaacctccagacaggcaccaccggacaggcagcctggtgtggggacctgggagtcccagacagaggttttcagtcctagctctaccacttgctagcaggagaagtttgctatcctagttgggttcttcctgaagccgaccctaagacaaggccttgga

SEQ ID NO: 214182 - DNA, 414 bp, Homo sapiens
  misc_feature (359)..(359): n is a, c, g, or t
  misc_feature (361)..(361): n is a, c, g, or t
gagccggcagcccctctccgtttccttagacacttactgatgctgctcctcccagcctgatgagtgacggatgaagatattagatttctattatccctaagtctctcgtttgtttcctgaggcaagtctacataaggccgggttcccttgtttccaaggcccgcctatcgtgtttgcactgactgagctcctccctggtgggcccctagaagctgttgtacttatcaagtattcttcagccctctattcttttacctactcaggaaattgccctcttattatcaagaagacctcatcaaacaagtttcttatctgactcctctccctcctccaccctccaccctcaagtaggccccagngnctggtggttctaatcttgtgttcataagttcttgtgctctgtcacccaggctg

SEQ ID NO: 214183 - DNA, 427 bp, Homo sapiens
gacctcaaactgagagttataccattggcttccctggtctccggctttacaacttggactgagccacactactggcttctccggttctccagcttgcagaaagttatatgggacttctcagcctccataatcataataaacaggattcccaggagtgacttggttctgaatgacttggaagtcaaaaggaagagtccgtttctccagtaacaaaagtatgcctgacaagaggctctaagctgtcctggatgccaatctttgtgccgactactttacagtgattgattgctcatacttcacggcaaccctgtggaatagataacatcatcatcccccttttactgaggtgtggggaagttacctctattgcccatgatcatagtttagctggcgctgctttataaaagaatgaatgaataaattaatg

SEQ ID NO: 214184 - DNA, 417 bp, Homo sapiens
agcaccagaaattattgtgtatcctggaattaacctaacacaaatgcacaaaatctttatgaggaaaaatataaaactctttcaaaggatgctttaaaagactcagataaaagacatgcctttttttttttttgagacggggtctcactccatctcccaagctggaatacaagtggcgtgatctctgctcactgcaacctctgcccccaggcttaagagatcctcccacctcaggctcccaagtagcagggaccacaggtgtacacgaccacacaaggctaatttttttgtacttttggcagtgatggggttttgccatgttgcccaggctggtcttgaacctcctgggctcaagtgatctgcccacctcggccttccaaagtgctgggattacgagcctgcgcaacagcctgggtg

SEQ ID NO: 214185 - DNA, 322 bp, Homo sapiens
agtccctacaggaccgtgcttctcccctacctctgggcctgtctggaatgttctgtctactagcccacctattccttctacctggccatctcccctgctgaagctttgagactgtgagttctagagacagagatgtgggtttgactctaggttttgtaccttctggctggaagtctagtcattcttctctgaatcttagctgtgagaagtcagtgagatcatgcatgtatcgtgcttagcaaagtctagcaatatacatgtgccttggttgcaccagcgtggtttgagagatatgtccatcaatccaatagttcggataacc

SEQ ID NO: 214186 - DNA, 461 bp, Homo sapiens
tttgaattagttggatttccatggttatttaaaaactaggcccacttattttctaaggcacttttcatttgtaatatcactgaaattgaaattccttttggtttgttagaactctgataggaaaaggcagccagaagaataggaaaatttaccttcaggactttctgccagataatattgttgaatattttagtttatttactcttagaatctttattctgggaattaaaaaggtaagcgaatctttcatgtacctcatcaattttatgtatctgaatgttataatctactttagccagttacataaataaaatcaattctatatttaagctaaaaaataaaacatacaaatctggagacctgcctaaacagtggcactttagggaaaatataacggggagttttaggtcattataagttgaacatattgtactacacagtactgtaagaaggaatagttc

SEQ ID NO: 214187 - DNA, 390 bp, Homo sapiens
agcctggtagagaagtgagaagccatacttccattctctgagtgcactgactcttagcaactatgagcagaatcatggatgcaaggatttttataaaattgcaaagtggaaactgcattcttgtagcatggggtaaggagaactcatacttgagacaggtgaagagctaggtttggggatgaaagcaagtggacgaggcatgtttttcttgggagaaatcctgggaacagaattgaaccacttgtggaaaggcaggtaggggaaaggagggaattcagagggatgaccaaggtagaagctcagtcctgctgatgggctctgcatctctcagttgaggtgggaggtggtgggaacaggaagcacattggtcttagagccactgcctcctgg

SEQ ID NO: 214188 - DNA, 455 bp, Homo sapiens
aaccagtgcaagttttgaaacataatttagctggcaaatgcacagtgatggaaattagtaatgactgatggagagccgtacatacctgttgctccttatcctttcagaatggctgctttggcagatctgcctgtgctgggagctactcaacatcacttcattttcatctggacctagtgagagtccctttgcctaacgaatttctgaaatttatttatttactagaccccttataatattcatggctttaaaaaatgacacagcatctttattttattacatgtcaattttattaataatatttaggggtttttttaaattataaaaatggcacatgctttttataaaatgttttaataccacagatgagtatcacatccacagtcaaggcatccctttgttctggtgttgtgtcccacttcccaaaaataaatacggttaacactgatgaacac

SEQ ID NO: 214189 - DNA, 357 bp, Homo sapiens
agtcaaagtcatagaaatagagagtaaaatggtggttgccagaagttgtgggggttaggagatgttgatcataggacacaaaatttcaatttggaggaataaattcatgagatctcttgtacatcatggtggctatagttaatgataatattaatatattgcatacttgaaaattgcaatggtataaaagagagtagattttaagtgttctttccataggaaaataaatatttgaggtaatgcatatattattttgatttagctgttccataatgtatacatatatcaaaacatcaagctgtatgttataaatatatataatttttacttgccaattaaagaaagaatgctaactct

SEQ ID NO: 214190 - DNA, 431 bp, Homo sapiens
tcagcagcctgaacgggggcttggctctggctctccagtcctcatccatgatgccccagaactcaaccttccatctgagagctgaactcgctcctccaatgttctctgaataatggaagtgtcagagcagagggattcaagggtcctggccaaggatcagctgccctatctgccttcacatgttcctgaggacccagagactccaggctgccccctgaccactggagatggctgcaaagggggcgtcctctggaagatggtcagcagcctctagaggaagcagacatcctggacgctgacctccagggcctaatgctctgccccctctcctgacctgcacctcgagggggatgtgtagagggtctgctctgggagtcttggctgtggcccccacctacccaagaaagccaatgcccacgatcagctcagct

SEQ ID NO: 214191 - DNA, 405 bp, Homo sapiens
ctctatataagatgcaaacacttttattttttctgaaatgatctttttgtgaaaaaattaaaaaggttgctcaccagttgctaaaattaaatgcggaaatttccttagtggaattgatacatttgaatgctggcttcggggatcccaaatgtgattgcttctatcggtgcctgtaaaggagtctgtaattatggaagcagtcttaggctgtaggtaagatctggagccagggtggacctttgtatgttcagcaatgaggggatatttttgatgagctggaatatccaattgaacagctgtaacaaagtttctgagaatcttttcctcatggttgtttatagtttgcttccagcctgggcaacaaaggcaaaactccatctcaacaacaacaacaacaaaaaaaaa

SEQ ID NO: 214192 - DNA, 1019 bp, Homo sapiens
ctctatataagatgcaaacacttttattttttctgaaatgatctttttgtgaaaaaattaaaaaggttgctcaccagttgctaaaattaaatgcggaaatttccttagtggaattgatacatttgaatgctggcttcggggatcccaaatgtgattgcttctatcggtgcctgtaaaggagtctgtaattatggaagcagtcttaggctgtaggtaagatctggagccagggtggacctttgtatgttcagcaatgaggggatatttttgatgagctggaatatccaattgaacagctgtaacaaagtttctgagaatcttttcctcatggttgtttatagtttgcttccagcacacccagatctgacactttctggccttaaagttgcataaaacaccctgtcagttgtaggcagtaagacagggtcttgggccgactggggacaaatatcagaatcttcctggggccagtagcaccagaatggggcctggcagacagagagccaaggttcttctgggagaaaccagcaatgctctggtggaacgaggtctgttctccacgtctgacacggtcctcagccagtttctaccaatcagattggagcctttgccggctcagcctggcagatgggcatgtgcacgttttgggcatgtgcaagttttgggcctgtgcccaggctgtaaggtactgctgacaggctgcgggctgtggtcttggaagggaaggttcaaggggtggtgcaaggctagtacagcctgtgctggattacccaggaaagctgccagcatgaccactgggtgaccagagaagctcaacaggtcttctctgttccagcacagtcctctcagtgggcatgtggagagctaccagaaggccatgggttacccagggtctctcctttaaagagggcggaagtcccctgtaatgcttgttacctggtcagcctgagggcacttgactgtgtgtcctatgctgcaagggatgtaggaaggcaggctgtggttagagtgtgggcttt

SEQ ID NO: 214193 - DNA, 728 bp, Homo sapiens
aatgacaacaaaaacccgaatgaaaacaacaacgatttaagggagagaaggagtaggtatgggtagatttcgagagtcagggaacaggtttcatttgccctttcaagtttatataaactaaagcaaacaattaaatttgaagcctgctgacactgtaatagatttcaagtaagctggtagaatttaatgaagtgtattagatgtcagctatagtattagtagcattttaacaatcagccaataaaacaagagcacagtcttctgtgcctgcaactttgtagaagatgttttatagtggtatggtactgcaagataaaaaaagtagaaaggattttagcccttgatccttcattttgtggggagaaattgctctcatttagggaagtgatacgttagtaataggcattgagtgggcagataactgaatagaacaggttgtaagttggtggcatttgggtcctgaaggttgagcaggattgtgataggacctggttgggaagagcggttgtagtagcagcagcgtgaggatgggcatggcttggtcttgattgaatgtgtctataggagaggagaaacaaagccaggtgagcagactttgcttgctgaatgaaaagggtgtctctgtttttcctttacttctcatctgtcattgtgtgaccctggtggttatagtttggggcagcaaattctgggtccttaccttattactgtttgggtgtgctttgata

SEQ ID NO: 214194 - DNA, 318 bp, Homo sapiens
gtcctgcatggagcttgttcctgtgccagcacctggagcagccagccagatcctgcactcgctcactcacgtgctccctcccaaaagaggttgagtgcggggggccaagtagagggggcacccctgctgtgagtctagcagaggggccaagaaaagtgctgcatcattagttcatacctctttagccacctagagtctacaccatatcatagcttcctaaagggtctttctgacttctgctgttccccctctaattaactttccaggctgctactcagattaaagtttctatattgctctgattatgtccatccttcc

SEQ ID NO: 214195 - DNA, 531 bp, Homo sapiens
gtcgacccacgcgtccgatggaaacaagaattgtgataggcaaaacacaactaagggagatgcatctaccttaataggcatctttcctatgagagagtgaagacacttgaaatgattatgggcaaattgttagtaagccaaaagattcctcttgatagtttgtttctgattttttttttccatcttaggcaagggccttaaatatcataatatagggataccttcaaggagcagtagaacatgtttccttttggtaaagttctggttagagcttttggtctgtcatacggtgagggactttgaaaaccagctctgtaagtttttaactttctaaatatagaagggagattactttggaaaatctgaattaaaaaagagaagtctccagaactctggtctgtaggctcaggtgtaaacagcataccatgcatgaaatgcctggtgtagtctggcccctaactagactagctgttctgaattctgcgtgagtgctgctctgtagtcagactcgtaagtcagacattcctctaa

SEQ ID NO: 214196 - DNA, 681 bp, Homo sapiens
ttaaataaaataaataaataaataaataataagttcacataaaacctctcccatggtgtatgtagtacatcttctagataattatttgtagttgattaatccatcatactaatattgacacttaaaattcaatagctaattgacatgttactatattatatacaaagtaaaaagctagagtgaaaattcaatacatacagcaaattttagaaagatttcaactacagtttgtggtgctatcaattattacatgaaaattttaatatgcaactctgactataaatatttatccattaatatttattaaatgtatgttatgtgccaagcactgcgctgaggttacagatacaaagatgaatatgatacattctctgcccacaagcatggaaagaaataactataatgaaatgtggtaagtgctgtaactataacaaagttataagcacttgtttttactatagcatttaagtaggctgcagaaacctattcatttacttcgtgcatataagttattctttgatgtagatattatctcctgttattctcctagggagtcactgtgcttattcacaaccaattctaaccagctctaggtctaatagtgtaggatatgaaaactgattacagagaacctagtttgggagacatgtaaatatgcttactccctttactacatcaagt

SEQ ID NO: 214197 - DNA, 540 bp, Homo sapiens
gtagcgggagacagagaaagggcagggtctctccggatgctccaaggtgctggacgcacaggtccctttctgtagtccttgtcatgtaagatcttttcatttaggctaagcaaatccagatgttcttcaaataattcaggcatatttggcccaagcataaacttgtcttcatttttcatccaatctgacaaacgtttgcaatcgcctcactctgtgagttccaggacaccttcgggctggaaggggttaatgagaacaagccctccctggtggcttcccttccccctggtgctgcccctcggcccctcccaggccagcaggatttgctgtccaaaggccctcaaaagacatccaagcagtcttttcttagaaacaggaaactgtcttcggccaagtacaaatgaagtgaagcacccagaaacctgaggaccgctccaaactgaggcctggaggcagacagggagggcccaactcctggcagggcctccaggactcaggctctcatgaatgagactgaaaaaaagaaaataaaaaaagaaa

SEQ ID NO: 214198 - DNA, 1602 bp, Homo sapiens
acttgtcaaattgcggatcttggagttaagagaaaatcacttgaaaactctaccaaacatctgaagatccagagtgtgccccttgcccaatcgcctgagactatacagtgacacctacaacagaggatgtggagggagcagcttttcgggcaccagaaatggcagcatcaggagcatcagcacgaatagactttgtagaggtagttctcccaaactatattatgaaaccaaacatttttggtgcgctacctgctgatgggggctgccttcttactgcctagtatctacaaaatgtttggtctttgttaaagtttaacgatgacatttctgactaatatagagagacctgatttttttccaaatgtgttcagttgccataactttcaatgaatatgaaattttatcagtctcagaaaaacattaatacccatatttttatctaattgatttcactatttgttatgttaaggtgcttttgtgtataattttgtatatatttttaaatgggatcaaactaagccataatttaaaagtcatcctaatgcagtaaataagataatttctctagtttgttaaattcttcagagaccgaatataattgctcgtttttctgtcatactccctgatgatgttccattgtggacttattttgcaaagttcccagatggcacaagtcaaaatatgaaatgctgatgattgattgattttatgtatcctttcatcttatgtaatttaatgtggaacagttattttgtagctctaaaatacatttgttaattaaccatattggcttttcatgcagttcaatggcttatagcatttcaatttgcatagaaaatgaatctctgtaatgatacttttgctaaataaataacaatcgacataatgggttcatttgcttttaacattttatacatacaatttagaagtaggatatatttcatattgaaattttgaaaagcttgaaattcaacatacaaggtcaccatcttgctgatgcctaatgcagtacagcaaattcattcttcatcccatgttaactcctttttggaacaagtcaaaatacaaataatttacaatgattgtgttggagctattgcttgattaaatacaattcaaaggttctttttataaaacaggtgtgagcaggacacattgcacttacgggcttttcctatttttttggttctatttcattttactgcctaggaaagaaacatttttttgtaaaacctatgctatggaactgaaatgtactttattgaatatttctattctgttttatgaatatcaattatgtgaaatatataaatataaaattgccttagaatgcctaactctttgtataaaacagatatctgaaagtagatgttggttttttgttcaaattgtgtaaatgctgatttttccatgagtacttatgaagatctatatgtaaaaattttaagtctgcttactgtgtttgtaccaccttgttcttagctgtgtatactctatgctaattgacttctgtcattgtcacatatattgcatatgtctctcaaaaattaaaaggtatattgctattctaaaaataaaaaatgtaaattcctgaaaaagctg

SEQ ID NO: 214199 - DNA, 122 bp, Homo sapiens
caagataagcctagaacatcttgtcacagcagaaagcagggaagctacagaggattttaacaaaaaaaaacctaaaaagttagcgcaagaggcttctcctgaccaaagatgagacaatttta

SEQ ID NO: 214200 - DNA, 473 bp, Homo sapiens
caggtggcctttgagtgtatgtggtaaagagtttttattacagtccaagagttccacaaataagttatcatgcatcacaaaaagtttcacttcttaattgcatatgattttcttttaaatgcaaaaatatgaggatcatcattgcacacctgctgtacatattttttaatgcatgttctaaaagagatcaagaaaaaatgcggaagaagataaaatttctttggaatttcaatcttttcctgagattccctaggtacaggcactgtgcacatgcttctgacatgctgtagttcattgagtcctggctacagccctgtgacagtgatatctccaactgacagataagaaggaaaagatcaaagaaatttcatgaaacttggaccagatcaaataaaactggcactcagaacttaggatctttgaagcccgccctctcctatcattcttttatttccttccctgcaaaactatct

SEQ ID NO: 214201 - DNA, 479 bp, Homo sapiens
tcttctaaaaggttgtttcccagatttagtgttgtcaaaattagaagaatttttttttccttttgagacagtctcactctgtcacccaggctggcgtgcattggcatgatctcggctcactgcactccagcctgggcaacagagcaagactctgtctcaaaacaaaacaaaacaaaacaaaaaaaaaacagtcttctccaggcacatgaaatgcctgtctcctcttttaagggagattttatgaagtttcagaatgaaaaaagtgatttaacttaaatttagtcctgtatcattacaatatattatttttataaataaacaggcatcattggcaatgatgattggcaatctagtcatcactggtctatgttgaaaacactactaaaacatttgtgatctcaaagctcagttaagaaaatactttggacattaaatacatattggagcttttcataaccattctgatgttggagcggccc

SEQ ID NO: 214202 - DNA, 376 bp, Homo sapiens
tccagcaagaagtcataactttatttatgatagaaacagtacaaatttcaaaccaagctgcagttactcctttgagacaccaaaaaaagttgcttccatatggttacattgttaattccataatcgcatttacaatatcattactgttgttcttcagggctcggactgcctttgctctcgacacatttgcttgtgacatgaccaattctatgtccttaacttctacacctgtttcatcgacctcttcctcttcactctcctcttgtgggagcttaagctcccaacaagaattttagatcacatttgtcttactcacataaatgttatgaagcttaagatggataatacaaatggttttgacattacttactgcacg

SEQ ID NO: 214203 - DNA, 298 bp, Homo sapiens
gaaaatatacaagatgagcttcatcttgtatattttaggaaactactacagaccactgggattgtgccaaggacaaaggagccaacataaataagctgccactggtcaaagaaagaataatttgaacatcgaaaatgaatgggaggcaaaaatccatgagtttataattctaaacaaacaaacaaaactctagtcatgttttgaggctcctaaggcacaaattaattattctgggaatatgtaggtaaatggtatatgaggaagaggtcttctttcctgaagaatcccagccaataaa

SEQ ID NO: 214204 - DNA, 558 bp, Homo sapiens
gctgctcagcctgtgatcttgcgcatggcctctcccctctgggataccgtttcgccttctgaaataaggataacgatatctgcttcacaagttgccatttggattaaatttaataactcagacaaagggctggcattgcctggcacatagcaactaacaatcactatacgtttcccctttcttcctgcagagtctacttttcattctctgccagcacctgcgccactcactcttgcttatctagcctagttgctagttagaattggggcaggaatgttccagaaggaggcatattgactggctttggccatcattgccaggcggatgtcagtacagctggaatggaggcagctgaaggaacctgcttctcaaggaaatgagcaaaaggacctagcttccgtaggctctcaaagcacgtccctttgggatggttcaggagctgtggtcctgaagccttaatgacctgaagtaaaagctcagaaacccaccccagactttacctagaccttccccccttccttttatctcgctttcccatgaacaagattattttaatgg

SEQ ID NO: 214205 - DNA, 149 bp, Homo sapiens
atatgtgtctaatatttgtttcttttgtatgatatatgttaaaccttatatgaatgttttcatctgtttctaccacatctcagatgttcttgataggaataatttctctatagtatttaaaatacatcttaatgtgttcattcctgttt

SEQ ID NO: 214206 - DNA, 350 bp, Homo sapiens
ctgtctacaagaaacgcttttcaaatgtaattccataggtatgttaaaaggatggaaaaattcatactttgctttttatcctgtttttagaagtaaccatttctgtttgctgcaatcatgaatgatgtttcctattgtgaaatatcattcatgattgcaaaaagacaacactaatactaatcaaaataaaactggagtggatataataatatcagataaagtagattttagaacaaagattaccagagctaaacagagacatgacataatgataaaagggtcactttactaagatgacacaacaatcctaattgtgtgtatcgcaaacaacagagcttcaaaatacatga

SEQ ID NO: 214207 - DNA, 474 bp, Homo sapiens
gtctgccctttccctctgaatactttcagttcagcatctgcccttggcagggcaccagaatatcctgacaagccctaagagaaaataaagatgcaggcatcatagccagctgggtcagtgacagtgatcctccccaccagcgagccctgcacgctgcacagcgcttccaggcaggtgatacctgtgagccggcagcccaggggctcaggcacctgaggaaagggacgccagagggcgtagcgggacacaggcaactgtggcaaggcctgttcagtgagatggaaatgtaagctggagaaaaaaaactgaaagatgagagacaaaactgtgaaataagaattgctatggagaatgaacatcagagaacaaaaaaggctcttgggaattaagcataggcatcagaaattaaaaatgaaatgagtttggaaggtaaacttgagtaactctcacagagagtagagtgaaagacaaaac

SEQ ID NO: 214208 - DNA, 1222 bp, Homo sapiens
  misc_feature (785)..(785): n is a, c, g, or t
  misc_feature (891)..(891): n is a, c, g, or t
caataaacattatacatagttttaattgcattgatgggagtgggagttttgcattttcacatcttacataatggatgaacagagaactttagttcttagtaagaaaacaaaaacattgaaccatggatagaacagtggggagctctcttttgaacaacttgtaggttgatgagtaaatcaacactagcacttatgtctatccagaaaataatcaggagattatcacagctcatgagataagcacagtagatacgttatagcttttaaacaaatttctttctaaacacaataaaaggagaaatttaattgttttgcttaagataaaaacctaagtaggctgggcgcggtggctcacgcctgtaatcccagcactttgggaggctgaggtgggtggataaggaggtcaggaggtcgagatcatcctggccaacatggtgaaaccccatggctactaaaaatacaaaaattagccagtgtagtggcgtgcacccgtagtcccagttactcaggagggtgaggcaggagaatcgcttgaacccaggaggtggaggttacagtgagctgagacagcaccgttgcagcttgggcgacagagcaagactcggtcttcaaaaaaaaaaaaaaaaagaaagataaaagaaagaaaaaaaaacaaaaaaaccttgcggcggtttggccccagcgacttaagattggccaagttatgcatgcggccgaattttaacttacttggccatttggccttatggggtcggtatacaattaattgcccgggtttcacaagngggactggaaaaccctgtggttcccaattaatgcgctggagcaaatccctttcgccgttggcggaaagcgaaaggcccgaaggatggcctttccaaagttgcgacnctttatggaaaggaaattgagcggtatatttgtgaaaatccggaaatttgttaaacacccttttttaccaaggcccaaatggaaaaccctttaataaagaattcccctttagggtgagttctcacttggacaagtctcttttagaagggccccacacaaggggaaaaccttttaggcgggccatttggaccaccctctaaaattttggcggggcccagaataatggcccctagggccccctatcttctgcaaaagccccactgccggataatcggacccttagcctggcgcctcggttacacctccttctttctttatggtcctttcttcg

SEQ ID NO: 214209 - DNA, 277 bp, Homo sapiens
aaaataaaagacgcaatgaagaaaaaaaatacaagaaacgaaatgaaagaggaggagaacacactaaaaaaaaaaaaagaagaagaaacacagaatgaacaaatacaaaagtaaaagagaaaaaagtaacgcgaaagaacgaaccgccccgccccgccgcccgccgaccgccgccgcccgaccgctccccgcccccagcggacgcgcgcgcgacgagacgtggggtgggggtggggggggcgcgccggcgcccgccgggctccccgggggcggccgc

SEQ ID NO: 214210 - DNA, 419 bp, Homo sapiens
ggttggcatagctaagagaaccaggaatccattagttttctgacatatagaaaacaaaagacaactttttcacttcctgcagagcatgggcttatgaaagggatggtttatacttccattgaaaagggaactggggctaaatacaaaagtagcctgtcattatgttctctttgctcaaaggagaggagcacaatgatttgtcaggagagcaggtaacggtgacaactgtgattaagtaaaaatgttcacagatgtgtaacattagtcagtttagctgtatcagtcacttatgatgattggactagatgaaatacacattaaatcatatatattatgtaaatatgtcttaacagaggttttaatttccccagaaacccatactgtgtctccccatctcatccaccctcatccctcccctg

SEQ ID NO: 214211 - DNA, 794 bp, Homo sapiens
  misc_feature (678)..(678): n is a, c, g, or t
ggtgtggtggctcacgcctgtaatccccgcactttgggaggctgaggcgggcagatcacctgaggtcaggagttcaagaccagtctggcaaacatggtgaaaccctgcttctactaaaaatacaaaaattagccgtgcatggtggcccacgcctgtaatccaggctacttgggaggctgaggcaggagaatcacttgaacatgggaggtggaggctgcagtgagccaagactgcgtcattgcactccagcctgggcaacagagcgagacgccatcttaaataaataaataaataaatgctattaaatagaatgtcaaattcccaagaacaactgacaatgatagacaatgaaattacattttgtttttaactgagacagagtcttgctctgttaaccaggatggagtgcagtggtatgatcacagcccgctgcagcctcaacttcccaggctcaagcaatgatcctgcctcagcctcctgagtagatgggacgacaggcacacaccagcctgcccaggtgacttttcattttttgtagagacaaggtcttcctacgttgcccagcctggtctcgaactcctgggctcaagtgatccttccaccttggcctcccaaagtgttggaattacaggcataagccaccacacctggcctgaatcacttttctcactcgtttancctcctagacttctctcccgccgttctcccccaatcctctgtactcctctaccctcggatcccattccctcccacgtcacgcaccccctctgttatcttgcgctcctcttcgtccg

SEQ ID NO: 214212 - DNA, 418 bp, Homo sapiens
aaagtgctgggattacaggtgtgaaccgctgcgcccaccggcctggagtcactcatttctaggaggagaactatcctgctagacggaccaggtttcctaactcgtttctggtagaaggatgtgaggattgttgcattaggaagatgggtcctaatacagctttttccaagtttcctgggcgttacttcttccaagtcttatgggtgtttttcaggttcccattaggctgttagacagaggtatgcccagggggtagatcccgacagtggggtcgtggctgtagacactggggcaaggcaggctgtttgcgccctccatgagtgctgaagagacagcatcgtggtgatctcgatgaggccctcacaagaggtctttcatgacatggtggcacgagaaaggtaggagggtcaagaaccag

SEQ ID NO: 214213 - DNA, 340 bp, Homo sapiens
ctgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaa

SEQ ID NO: 214214 - DNA, 466 bp, Homo sapiens
atatgacctggcccacagctacctctctactctcatttcctaccattcctacctcatttccttttcatttgttcttttctgccacattgacctccagtgctatccttaaacacactaggcatgctcaagatttttttttttgtacaggctgttctacctaggaagctcttcccttagatcaacagtgtcttgcttcttgtaagtctttgttctaatatcatcttagaagaaagtcttcacttatcattcagtcaacaagaatctcctacttcccctcattctttatcttcttgctttggtttgtttgtttattgccacttttttttagagatggtgtcttgctatgttgcccaggctgccttgaacttctgggctgaagcagttgccccacctcagccccctgaatagccggaactacaattttctgtctattttttgttttctaaattttttgcttgattttttt

SEQ ID NO: 214215 - DNA, 235 bp, Homo sapiens
agtgcaatggtgcgatctcagcttactgcaacctctgctgcccaggttcaagcagttgtcctgtctcagcgtcctgcattgctggggctacaggcgcacaccaccacacccggctagattgtgtattttcaatagagacggggtttcaccgtattggtcaggctggtctcaaactcctgacctcaggtgatctgcctgccttggcctcccaaagtgctaggattacaggcgtgag

SEQ ID NO: 214216 - DNA, 435 bp, Homo sapiens
tgaagaactggtcccatcagtgagaaactcctagatttggtcatgattatgctccaaggtgtaatggacttgcatgatggaagccattcatactagcaagaatcactagtgaatttctgaagtttgatttgggtaagataccatatgagttgaaactattctactggatctcctataatacaaagtatgttttctcaagcactttttagctgtaaaggtaacaacgtaaatttaaaatagaagtgcagttggcaatttatccatttaaatcatataccttgaaagccctttttaatttcagagttttactgacacagagaacaagggagagtttggaggaaataagagaattaagaatgattcattatgaagagatattattgtaagattggttacaagagcaagggttattggataagttcaatttgtaagtac

SEQ ID NO: 214217 - DNA, 443 bp, Homo sapiens
tactttatgctttagatattagggaaataggttttttcaagttctttgcacatgcacttgcctttgcctgaaacatttaggctttcctttggtcacttgatgagttcctgcttgtcctttagcactcaccctgtattatctcatagatgataccttccctgatggaagtattttaaggagaggaatgaagaaagctcttggaatcggagaagagagatacttctggttgtaataaaatcccccacatctttgttcccatgacagatgtgtttgcttctgttacagtgtttttaacttgtaaggttctgtcttccccactacacctgagtttagggactgtctcttactaaattttgcactcttcatgcctggaaaatagtaagcattcaataaatgcccttcaaattaacgagaggataatgagaaaaagactgctctttaaa

SEQ ID NO: 214218 - DNA, 451 bp, Homo sapiens
tttccacctgccactcatcagcaagagttcagcagatgcacaggcatcaggaagcctcctctgatcactctgctccctgaagcaagtcaagaaaccggggaagagttctctaacctttccctgaagcaggtcctaggaccttgattcaagaagtgccctgtctatctccagagagaaagaacatctttatttctgaagacacagacacagagaagaatcctaacatgcagcccttgctaggttccccccaccccagtttattcccgttagatcacgccctgttgtccctcaatcacacttctgtgtgatcgcccacaaaaatatagttttctggctggtcatggtggctcacgcctctaatcccaacactttgggaggctgaggcagggtggattgcctgagttcaggagttcgagaccagcctggacagcatggtgaaaccctgtctcta

SEQ ID NO: 214219 - DNA, 446 bp, Homo sapiens
gtttcaatcattcttagctggaaggagtgagtgaaggtgtgggttatggttcaaatgttacatactctcagtggtctgtagagtttttgtagattttcttgaatttttttttcatttgctgtatgcctttaggacaaatttccaagatctcaaatagtttagtttttctagtttttcaccagttatgcttatttctctgggaagtgcatctacagagctcttcatgctacctgcccagaactagaactctacagtccatttttaatcccatctagtacctttcaaatttttaaatattaaactattctatcatagagtttcaattttgttcttatttatagttaccattactctggtggtatttcctttatgttttctcattatgttcatattaaaaatatatttgaacatcattatgataaaagatttcacatattgtcgctaat

SEQ ID NO: 214220 - DNA, 565 bp, Homo sapiens
cgaacgcattagagtaatgaaaatgcctgtctgactgggatgtttatatttttcatgattatgtcatttctttgccttggcctatagtaagtttgtatgtgaatgctttgcatgagggtcatagctacttggtttaccttgaaatcaatgattcagaaattgctttttgtgttccagttgcatgtagctgtgactccttttaaaagtgtggtaacaatgtggtaggaatttaaaagcttcccaactttagacatagattattttgatcctttctgaactggattcataaactttggttccaaagaacagcagctgtagaagggagccagatcttgactcactgttgaggttctgcttcttgagagatttcatatttagtgcaacccaattccttggttcgttcttctcccccagtactagatagccaagttgggtggtaggaaggaagaaaatatgcagcaagtcgagtctagttgtcatgctcctttggaccagaaaggaccttaaagattgtctcgtcatgttgttcctataccttttgttttcgtctacctgtaaaatgaaa

SEQ ID NO: 214221 - DNA, 171 bp, Homo sapiens
gccatagccagactgaatcagcacaattggtatcacagtaggatattcctttgtgactttaaggcgcaggttaaatccccatcccaggcagcccaattcccagcacccctgttttgtgtctactcaggatttcttcccttccttttctttttctttccttcttttcccttt

SEQ ID NO: 214222 - DNA, 419 bp, Homo sapiens
cttcacttttattctttatcccagtaggagctatttagaagtaatattattattgtttggaagtgttattggtgttgcttttaattttcaagcctgaaaaggcttggttaccttttttttctcctaagttaattttactgtggttagagaatctgatctgtacctatcaattttgtgtttgtttgtttgagacttgcttttaggtctactatgtgatcacttttctgtaaatggctttggtatattgaacagaatgcagagtctctaaatttggggctctatatttgttcactgtcacacttcttgatggtattcttaaatactttatcttactaatttttatctgctttatctattggttattaagaaagtgtgccaaaagctcccgttgattgtcttccattaaatgttttcttgca

SEQ ID NO: 214223 - DNA, 392 bp, Homo sapiens
aattccagctcggtactcctaattggttcttcgatgacgcagcctccagagtagctgggaccacaggcgcatgccaccacacccactaatttttgcctttttatttttattttttttggtagagacagggtttcgtcatgtttgccaggctggtcttgaactcctgagctcaagcagtcctcacgcctcagcctcccaaagtgctgggattacaggcgtgagccaccacgcccagcccaaaaccagggaattctcttgaactccttcccctcccctgcatcctgttggccaccaggtcctgtcacttccatcacagaaacgccaccttccctccctcgccattcccgctgctcatgccaatcgtcatcgaagaaccaattagggtggagccc

SEQ ID NO: 214224 - DNA, 282 bp, Homo sapiens
accgatcttgattctttttatttgatgcttttacgctgactacaccatccagccctccatttagcatgagaggtgagagtacacgttgtggtgctcatggtgtgaaggagaaagcagcctttccccattgagggcaatgataagtatgggtttttccaagaaggaagctcccttctgttctgagtttgttgggtatttttccttatgaaagtatgttggattttgttggattgggtactggttgactctacgtccgtgtgtaatcccagatccttcgtagag

SEQ ID NO: 214225 - DNA, 463 bp, Homo sapiens
actgtgcccagcctgctgtcattcttgaaccataatttcactggttatagaattctgagttgtcagttttttctttcaggactttaaaatatagggttccagtgtctttggcctccgttgtttctgtcaaggaatcagcattcatctagctattcccctgtagaccacatgttgtttttccctggatgcttttaagactttttatccaagtttgattgctcagtacctatctctgggcaaaaaagcctccagaaaccagaaacttatctagttttattcccctctgtcaggtgtagactccactccagcttctacctacttgagatattctatactgactccaggctgttgttattttgttctttcaaatattttgtccagagctataatgttttctgcagaattgaccagatagcagctactctctgtgaccaggagccttgatcttccagacttgctgatg

SEQ ID NO: 214226 - DNA, 366 bp, Homo sapiens
aatgtgattccaattgcttggtggtgtagatgtgaacccagtgaggaagcctgttctaattaatgtcgtctaattcggtgactccttttgagttctgtgtaagaatcaaatggtgatctgtcatctaaaattatgtttaccagcctgtcagctgacaacccgattaaaatgttgaaaacaaagaattggaaattatttgacttcaaagtatgtgtattgttcaggcattagtcattcattatgggaaatgacagttttctgggaaaactatctcctaatagcaaggcttgaccaagactcatgatatgattattaattatatctattatgctttcacttgaaagccatcttgttttggaaataaat

SEQ ID NO: 214227 - DNA, 446 bp, Homo sapiens
gagtggtctttgttctcaaggaattttgtttgttttgacttctgtgtgggttttctgaaggagaggggctttcctatgttttacctaactcagaattctctcagggcagggaagtgttcctcaaaaacattgagaggcaaaagaactagcactgattcctgggacaaaaaagaacaattgaggcaataataaacacaccaaaatctagaaggaaaagctgggaatgagaattttgttttggaatcaatgctttaaaaagttctcacatataacagggaacctacacatacccagggtaggatgcatggttggaaaagacctgataagaccacaggctttcaactttgactagtccttacacaaagtgcaagaagaaagagaaagctaaggcaaacttgtaaatgccccaattaaatattagaggtgtgccccaacccagaaccaac

SEQ ID NO: 214228 - DNA, 353 bp, Homo sapiens
ttgtattttcagtagagacggggtttcaccatgttggccaggctgatcttgaactcctgaccttgtgatccgcccgccttagcctcccaaagtgctcggattacaggcatgagccaccgcgcctggcctgttcttccttttttttaaagctgttgtttctctaactaggaaagccatttgtgttcattgaggaaaatttggaaaaagtgaaaaatgatacaaagataaattatataatcattttgagttagttcactgttaacattttggcctattgtctttttctatgcatattgtatgttactccttttacaagtttaggtaattttgtattttatagtttatggtaagct

SEQ ID NO: 214229 - DNA, 210 bp, Homo sapiens
tagctgctcactcccaaagcctgacaagttgatgccattgctgtctgaggccgcctccagctcagtagtcagctcagtgctcgtgtgcttcttccgggcttgtaataccttcatgaacgctccttctggattccctacagatagatgcttcttcaactgtcaggtaagacacaataagtctttctgagtttctcttatagggtttagctt

SEQ ID NO: 214230 - DNA, 1212 bp, Homo sapiens
taaatatgtcatagttacactctgctcatcacaaaccacttatggaatgaaacatgtttgctttccagtttgaaaattatacatagttaccactaccagttcagacagctgccaaagaatcatttttaaagtgctgaaaactgtctaagtactttgatttcaacaatcacgttttctttgtggcttagggtaaggataggagtatgaagaggtgggctaatttttagaaatatccccatatgagctggtatccttaattatagtgaaggtgcgggagaacaaggaaggtgatgaataggtatagaatataatccctttaagttttccctgaatgtgtttataatgagtaaacatatacactaagtatgcacacaccacacacacacacacacatatatatctacctacatatgcgtgcacacacacacacacacacacacacacacacatacacataagatacacaaaatgaactcgatcatatgttttggaaatacggactaaattaactattctattttcgtatattgtgaatgcactctgatgtatcaaactcttgcaaaatgtaaattggtcttcaattctctttggtagcttgttactaaaaaaagagagaaaatccttttaaaacttttcagggaaaccatgatttccttggcctcaaggatttgtgatgaaacagcagaaaaaattttgaagccacacaaactctgggttcttttctcaacacccgccatgtatcaattctgtaaccttaggcaaattatttaaactttctaagccttgattttctcatctactaaaaacagcaataatctaagatcaagataaaacaaaactcacccagaacaaagtatagtctccatgaataaagaacatgtctgttttgtttccccagcacctagaacaatatgcgatgtatacaatggcagatactaaatattatttatccagcagaaaacaataaagttgcaggaccaaccctgtcaactaagctaatgctacataaaaattacatgcaggattagctaaagaacataaattctacacatatactaattcttagggtctctgggttttcttaatgttatttccttcagaaaatgggcataaattcctatctaatgacatctcacatcctcatcaagaagcaagtcatgaaatttaagccttacaaggtatattctttttggggttttacaactattaatg

SEQ ID NO: 214231 - DNA, 417 bp, Homo sapiens
tctgcttagtaggtggtttcccaaagatgatccaatgcaatgagtcatccctctgagcacttactgcacattatttctttttactaatcctcggtgcttttggttgcatgttttttaacctttagagccctcctgggaggttcagagtcttctcactatgaatataaaacagactctactacatccccccacatgtccctcttgtcctttacttcctatacttttcaaatctaagataatccatcacttaggagaacagtcaggatcatgtccaaagataaaagatcagcagtaagtttctccagagttagcagcagctccatctcattcccagtataaaaatcaaaaatgtagatggatgtaagtcaatgtgtagaacccatatcaagaaaactataaaacttgattgagatacat

SEQ ID NO: 214232 - DNA, 481 bp, Homo sapiens
gcacttgtccaaggtcacatggctggaaatgggcagaaccagaagtcaagcccagatctgctaaaaccacagccccagctcttggccacacctcagcttctctgatacaaatttcagaatcgacacttaaaagtggtcacctggaaacaggtcagggcccagtccttccattcaccaggggccaagtcctcaggcacctcactttaccttctgcacccctcatcatttgctaaggaagggagccccctaccctctgtggggggcatagggaacttaaacatgacccttaggtaaggtgcccagccagactcagccaaggtacgggttcagcaaccggcggcccagagccagagacacagctccaggtaaaggaccacgtgctgacgtcctaagattccctgaccacagcaggctggggatggggagacaaaaaggggctgaaagctgtggaaagacttggtcttctgagaaggggcctctc

SEQ ID NO: 214233 - DNA, 817 bp, Homo sapiens
acaggatcccccccgcaccactgcaagactatgtgaatccactgcttcccacccctaaaaccctgacaataccaagtgctagtgaagatgagcaacgactaaaactctcatccactgctgatgagggcgaaaaatgatgcaaccctccagaaacatctgagagtttcctgtaaagctaaacatgtatttattccaatgacccagccatctcacttgcaggtctttaaccaaaagaaagaaaaacatgttcacacaaagaactgcatgtgaatagctttagcagcttcattaagaatcaccaaaaactagaaaccatccacgtgtccttcaactgagaaatgcagaaaaagctggggtctatccatatgatgaaacactactcagcaatgaaaagaaacaactgaaacactcccactaagtagtcagatgactctaataaactatgttaacgaaaagaagcctgactcaacctctacctcccctgcattgtatgatgccattttccatttaatatgacattctagaaaaagcaaaatcatagacacagaaaacagatcaatcgttgctgaggagccggacacggtggctcacgcctgtaatcccagcactttgggaggccaaggcgggcaaatcacgacgtcaggagttcaagaccagcctgaccaacatggtgaaaccccgcctctactaaaaatacaaaaattagtcgggcatggtggtgcgcacctgtaatcccaggtactcaggaggctgaagcaggagaatcacttgaacccgagaggcagaggttgcagtgagccgagatcgcaccacactg

SEQ ID NO: 214234 - DNA, 293 bp, Homo sapiens
ggatttttagtagaggttgggttcagcgtgttggccaggctggtcttgaactcctgacctcaagtgatctgcctgccttagcctcccaaaagtgctgggattacaggcgggcgtgagccaccatacccagcctttttttatttttattattttaattttactttaagttctggggtacatgtgcagaatgtgcaggtttgttatataggtgtacatgtgccatggtgaactgctttcttaaaattctcttctcccttgactccagggtaccattcccttctgatctttttttc

SEQ ID NO: 214235 - DNA, 388 bp, Homo sapiens
gcccccgaattgtcagggattccaagaaagaaaatgtctctgtctctgtctctctctttttaattctcaaggaggcagcccaaaagagaaagagaagagagtaataaaccaaggtaaagttaagatgggactaactcagctgacagataacaatccccatgaaacccaggcttgacccctagtaacaatgccatgaaagaatagatagaaatgcactttgaaaaagatgacactttagaacataatcaaatggacttgcatgggtcacaacacatccttcataccaggaaacgctgcgtgagggttctcagaagtcgcatgactcatatagtccgtcaactctcaggaatgggttctgagaattccaagtaagacaaccccatgcctg

SEQ ID NO: 214236 - DNA, 342 bp, Homo sapiens
ttgaatttgtagattagtttaggacatattgccatcttaataatattacattgaacataggatgtttttctatttatttaggttttgtttaattcctttccctttcttgtagtttttggtgtataagtcttgcatttttaaaaaattaaatctattcctaagttttttattatttttgctgctattacgaatggattttttaaaattttatttttggattgttcattgctagtgtacagaaatacaattactttttgtatattgatccctgccaccttgttgaactttattatactagttttttagtggatttcttagtattttctatatacaatatcatgt

SEQ ID NO: 214237 - DNA, 520 bp, Homo sapiens
agaacatgcaatgcattgcccgcttcctttcccctgtcttgcttgtcttggtttttctcttctcctccctttccctctccctctcctcttctctcttttcttcccttttttcttctctctccctcttgctttctttcctttctagcttaacaatattccccaccttatcccctggaattttgcccaggtactttagaagaatctccctcctttacttccttttcttttttcctcctttatctcttttatttgtttagtccatttgtagaccattttttaaattatcattgataaatgcatgaatattgccatcaaaacatcagtggaaaggaaagttctatatctgagggtgaaattaggcaactggtatagtcaggatcaaaaatcctgggagtcattttagaaaagccaggtctggcgtggtgcctcactcctgtaaacccagcactttgggaggctgaagcgggtgggtcatttgaggtcaggagttcgagaccagcctggccaacacggtgaaact

SEQ ID NO: 214238 - DNA, 391 bp, Homo sapiens
gaattctgaatgtctttggttttaggacatgcgtgagaggcaagttcctactcagggtcccacagtatttcagttctatgtcttcagacctgaattaacaatccagcatctcccctgcattccagcagcactgagaggggtcacagggagtcgcccagagaaccaggtgggcttcattcctttgtcctgagccagctctccgtgggctgctctcagttagcagactgggaatggagtgtccacttgaaaacaacgtgctcttcattacaatgaaacaaacacgagcggcttgagtttaattttagcttcatttatgtatcgtgggagatatagaactgttcctgggtccaagaaatcatactgtaaattgagctaattagattctttaaaa

SEQ ID NO: 214239 - DNA, 571 bp, Homo sapiens
aagtggttcagccgggattcaagcacaggctgtctggttttagaaccttcctcttttatcttgcctgggagagttttcatcgatgccactgttatgtgttggcattggccaagaggcaggcctgggattgcttgggatgtgcctgtttaacaatcgtagtcatttgctgactactgtggttaagaaatttttcattagagacaaatttccaaactaggaaggaagaacttcattgtcatttactcctgatgcagacttttaaaatttcatgagtgaatagacatgattccatataaatgattacatcacatgcaaataccatttcccatagcgtcatgattaagggctcctatggattacccagcggggagtgatgttggtgattatggaaggtggccttgtttccttgtttaggaatgctgggatttgatctgattattagaggcctctcttctagaggccaagcacctccccaggccacagaggatttgaaggtgatgctgtgtttgttcattacattttggaagatattcagatcaaatcccagcattcctaaaaaagttggcggccg

SEQ ID NO: 214240 - DNA, 381 bp, Homo sapiens
gcctgactgggacagaggtagtgtccagcttcacctttcatatccaggccctaatacaggaagagtactcagggttcgactcctgggagcacactttctttctttctttttcttttttttagacagagttttgctcgtgttgcccaggctggagtgcaatggcacaatctcgactcactgcaacctccgcctcccgggttcaagcgattctcctgcttcagcctcccgagtagctgggattacaggcatgcgccaccacgcccagctaattttatatttttagtagagacagggtttttccatgttggtcaggctggtctcaaactcctgacctcaggtgatccacccgcctcggccttccaaaatgctgggattacaggc

SEQ ID NO: 214241 - DNA, 399 bp, Homo sapiens
tacttttattattattcctctcaattaaaaataattttcattaaaaattatcattttcaaggctatggaacaatatgtgtcatacagcataattgtaaaaacatatacagtcatccctcggtatacagagaggattagttccagccccccatctctgcatataccaaaatccatgcatactcacatttcacagtcagccctctggaacccacatataggaaaagtccaaatattagttgggcacagtaccaagcacctatagtctcagcatcccgagtagctgggctgatagggcgggtaccacacgactgtagtttcagctactccggaggctgacgaaggagaatagcttgaacaaaggatgcggaggttgcaaagagcccagaattgtgccactcg

SEQ ID NO: 214242 - DNA, 287 bp, Homo sapiens
cgagcccttagtcatgcgcatagctggttcttgcgaagaaaaggacttacaggcgtgagccaccacacccagccctgaaagccaaatgaaaataaatgttttaaggagaagacagttattaactatgccaaatgctctgtaagatcaaaccaaatgaagactgagaattaaccattggatttagaagtttggaggttattaatgttgttgacaagtagtcacactgaagtggtggggttgaaaatctcactacagtaggttcaagacagaatacccctctcacctct

SEQ ID NO: 214243 - DNA, 566 bp, Homo sapiens
ttagacatgactttcaataaataaccaaatggaattactttcagattagttgaattaaaatattttcatatatatattttgttgacagtgaatagataagagttattacaaaagtgaaagcctatttaatcaccaattttatattcatgcaagaatggaatgattccccatgtagttagggtacaaactagcctatctgttaattggtaccttttgaatttggttttggactatatgtcacaggtgtatcatttcgataatgtaatctcgtccactgtatgactgacagcttctgcatgatttccctattggacagtgacaaaatctgtttgctttatagtgagtacatacacttctatcagcaatattatcttccctgtgcaagagtgtcagttaacaataaaacatgaagtctggggtgggagaagcagtgaaaaaagatggggagattgaggagaaaacactgtaacaaaagaaacatgttttactatgaagcttaaactgaatattaaaatataaagctgactattctaaactgcagtacattaccaagatattgttatcag

SEQ ID NO: 214244 - DNA, 394 bp, Homo sapiens
ggtgtcaagtaagagagtttctaagagcagcaaggttctgccgcgtttacaacccaaatttcttgctcatggtcaagccatcataccaagccactaagaggaggaaaaaaggagcccctcctctaggaggccaaagaggagaaggattttaaagaaatcaaagaagccttgactcaggccccagctttaggactgccagatctaactaatcaagcttttcttcttgtatgtgcacaagtgaaagggaggccataggggttctgactcaagccataaggtcatggcatcgcctggtggcatatttatccaggcaattagattctgttgcacttggatggcctccttgtcttaaagcactagcagccactgccgtactggtgcaggaagctagtaa

SEQ ID NO: 214245 - DNA, 417 bp, Homo sapiens
taatggagtctcgctctgtcgcccaggctggagtgcagtggtgtgatctcagctcgctgcaagctctgcctcccggcttcacgccattctcctgcctcagcctcccgagtagctggaactaggcacccgtcaccatgcccagctaattttttgtattttttagtagagacgtggtttcacagtgtttgccaagatggtctcgatctcctgacctcgtgatccacccacctcagcctcccaaaatactgggattacaggcgtgagccaccgcgcctggctctcctacgttttctttaagaagttttatagttttgcttcttacatttaaaattatgattcattttgagttaatttttatgtatggcatgaggtacaaatttaatttcatctttataaatgtggttatccacttgtccc

SEQ ID NO: 214246 - DNA, 240 bp, Homo sapiens
aaggtataccatgattttatgatttatttacatttaggggggaacccctcagtgaaccatttactccccattttaactcccctgccccgatcctttcagtttccagttaaaacaatgcattaaccaatgttaaatcttaaatctcgtgagtttctctccatcacaccctaatattttaaaaaaattattcctttacatttaaaactgaacattggctactgaagaatgatttaaaggctg

SEQ ID NO: 214247 - DNA, 1150 bp, Homo sapiens
tcagagacagagtctcgctctgtcacccaagctggagtgcagtggcgtgatctcaactcactgcaatctccacctcctgggtttaagcgattctcctgcctcagcctcctgagtagctgggactacaggcactgccaccacgcccagctacattttttttttttttggagacggagtcttggctcactgcaagctccgcctcccgggttcacaccattctcctgcttcagcctcccgagtagctgggactacaggcgcccgccaccacgcctggctaattttttgtatttttaatagagacggggtttcaccacgttagccaggatggtctcgatctcctgaccttgtgatccgcccacctcagcctcccagagtaaatttttttagtagagatgggatttcaccgtgttgctaaggctggtctcaaactcctgagctcaggcaatcagcccgctttggcctcacaaagtgctgggattacaggtgtgagccactgcaaaagcccataaaattgtttaatacctggatcttttgccccatttaatggtagaccaaaaaaaaaaaaccttataacaaaaaaacatgtcggccgcttggcccatcgacttagactcgagcagcttatgatgccgccggaattcggctaattggccaatcgccctataggagccgattacattaatggcccgcgtttaaacgttggacttgaaaaccctggcgtcccaatttaacgctttgagaaaacccctttccctgtggcggaaacacaacggcccaccgacgcttttcacaattgccaacttatgggaagggaactgcagcttaaattttgtaaatccggtaaatttgtccttttttttacccagggccaatcggaaacctttaaatcaagatatccccctaacgttaggcttccatttcccagtcccctttagacgggcttcactctagggtccttttaggggggcccttgtgccctccactaacattttggctgggtgcaacccattaccttagggcgtcttttcatctcctcgcaccaacctctatgtccctatcgcacgccttcactctcccctagctatcatttacacctccccctcgttcatactcccactccttctcggtccccctcctctcgcgtcttccc

SEQ ID NO: 214248 - DNA, 436 bp, Homo sapiens
cgaggtgccttagttgcacacatatcaccgtccccgaatcttacagtcctatcagaatctccaggccctccatacagcttggatacaagggaaagtaaagaggaaactaaggtgaaggtgatcaaaatcaaaggaattctgagaaactgtcacaactaagagggctaaggagacctgatgactaaatgtaatgtggttttctgaatgcgatcatggaagagaaaaagaatactgggtaaaaactaaggaaatctaaataaagggtggactttaattaataataatgtatcaatattagttcattagttgttacaaatgcataatactaatgctaagatgttaataaaaagagaaattgggtgcagaatatgtggggaccctctattaccttccatttttttcctgtaaattaaaaacttgtttttttaaaaaaaat

SEQ ID NO: 214249 - DNA, 831 bp, Homo sapiens
ttggaagcaaagacagagagggcacctggagaatggttgccagagtgaaattccccagacaatagagataatttggaactgtttaaagaacaagggaagaagagcccaaggaccgtagcaaggccctgattctgggagacgagagaacacgctgacttagaatgcttgtctctgcatcctggtcagaaagtagatggacgacactttcatctccgactggattttggtgagagatgggcaaaccccgggctctaggctggagcagcagctcttgtatccacacaaaatcaggactggtggagggagccatcttcaaacataaatttgcgtcttttggcaatgcactccttgggtttggaagcttccctccaagatgctgagcccaatgtttggggaaagccagggaaacagatgctgggtcagtgctgctcccacctcctctgctcccctcctgagggctccactgagtcaccagccagcaaacagcccatgcgccctggagcagatggactgtgggtacacgagcctctgaactcttgggcagcatgggcacaacatccttttggcctcacccaatgacctggctgtgaggccagaggagctccgtgctgctaggagatccaggcagaaacatccaggagtggaagctcagcccagcggctgggaggctgtggcacctcctgtccacatggcaggccaggccgaggtgggctggctacacagtggggctccccctctctgataagggatcgaacggatgcttgaaaataaatggcacctgtggagaaagtgccccatccctgattatgtcatcggagcctctggtcccca

SEQ ID NO: 214250 - DNA, 1160 bp, Homo sapiens
ttggaagcaaagacagagagggcacctggagaatggttgccagagtgaaattccccagacaatagagataatttggaactgtttaaagaacaagggaagaagagcccaaggaccgtagcaaggccctgattctgggagacgagagaacacgctgacttagaatgcttgtctctgcatcctggtcagaaagtagatggacgacactttcatctccgactggattttggtgagagatgggcaaaccccgggctctaggctggagcagcagctcttgtatccacacaaaatcaggactggtggagggagccatcttcaaacataaatttgcgtcttttggcaatgcactccttgggtttggaagcttccctccaagatgctgagcccaatgtttggggaaagccagggaaacagatgctgggtcagtgctgctcccacctcctctgctcccctcctgagggctccactgagtcaccagccagcaaacagcccatgcgccctggagcagatggactgtgggtacacgagcctctgaactcttgggcagcatgggcacaacatccttttggcctcacccaatgacctggctgtgaggccagaggagctccgtgctgctaggagatccaggcagaaacatccaggagtggaagctcagcccagcggctgggaggctgtggcacctcctgtccacatggcaggccaggccgaggtgggctggctacacagtggggctccccctctctgataaggacacagcatttgtctcctccagaggatacagcaccaaggcgccatcttggaagtagactggagctcttagcagaccagaacctgtgggtgtgttgatcttgtacttcctgacctccagaactgtgagaaatgcatttctgttgtttataagttgcccagtctcaggtattttgttacagcatcacaaacagactaagacaatctcctagaggagaaatcctctcttccactacatgcattgtgtctgtgtatggtagctggagctggagcagccacgctgcaacccaggggccagccaagggcaaggctgagagtgttatcactgatgtgtcaggtggttctttgttgttttgagaaagaactttaattgagataatttatgtaacataaaatttactgttttacagtgtaca

SEQ ID NO: 214251 - DNA, 623 bp, Homo sapiens
agcatttacgtgctcccaggcattctgttacacttaaagaggctcatggaagagatttgggcaagtggtataactctacaagctgctatattcaagtcctagttccagcttagccaaaacacctactccgattgcaactgatctttttcttggttgctagaaaactgagagtcatatgtgtagcctacctccagcaaaccaataggaccttacaccatgcattttgcatacaaaactgctggcttaatcttatctttcacactcacggttttcttttgtcctatttttctctgtacttatttttaatttaccctgatgtacacatttatgtaaactacgttaaatcctttcctctggaataaagtagggtgtaaataaatttaacaaaacaacaaagagtgatgatgagccaggtcttcactcctgaaggcctcaaaacgaactggcagtgatctgtgaaaactacagagaactgcccgttcatctccacagattactgaagtctgtgaaaactactccagccaggaccaccattatagcctgctgcctgttgtgttcacaatcgatgcacaaactcaaccctgaaatggagagaaaaatagggggaaaaagacattaggaaa

SEQ ID NO: 214252 - DNA, 914 bp, Homo sapiens
  misc_feature (168)..(168): n is a, c, g, or t
  misc_feature (315)..(315): n is a, c, g, or t
tgcaccttggcctggctgttggtcagcttggcagggctgaaggtgaccacgtcatgtagggagaactgtacgtaagggtgtaccacatacagcatctccggcgactccagcaaggcctcagcccgtaaaagactagggcaagcagggtctgccccgaggggggcaggnggccttctctggcatatgaagggcattgggtagtttcacccactggcaggaaggagcaaccatagaccctctgcagagcctgccgtactgagtccaaggcagggacagctgagggggcagggctgtgactgtacggctggccgtaangtgtggtatgcatggcgccacaggttgcgataattctgggcggcaacctcctgcatgaagcgagtgagggtctcagggccgcaggacccgtcctcaaagggcaggcccccgcccagagggtaggacagtctccgcttccgcagcccatgcacctccacgcgcgtccagccggcaggcagcctttgcacagagcgctgcaggagagtcctgacttccgcttctcccaggccctctgcgcggggacagggtcccaggggcagccggcgatcgcggaggctggccagccagcgcgcaggcactagggccaccacgtgggtgccccccggggccggagccagctgcctgggatcgatgctcaggtccctctccacgctccggagcagctcctgcatgtctgggcttggcggggaatgccagcccccggccggggttctgagagcgccttcccgccccccgctgccctgggccatctcctccaggccgcccgggggcagcgcggggctgagcccagccacggccctgctggcgacggcttccggggtgccaggccggcggggctgggatgggcgcgggacaggggctggggcggaggcggccgc

SEQ ID NO: 214253 - DNA, 675 bp, Homo sapiens
tgcttagttggtgctggacacagggtaaattgtcagtaatgctagctattattaacatcttcccatctagccctaaatctggctctcctcaggaagtcctgctctgtgggagaggaataggggctgacagggtcagtctatgcctaatcttccaggctaatagtttccaaatgggaaaccttgcagagtgctcaaaaacttttctgggatatggggagacttgaatttctgtgtcagagtttgctgtgtattgactaaacctcattgccttttccttccaagcatgagctagactacatttcccagcctcccttgctgggaccacatgactgcctttggacgaatggagtcagggcagccatgatgccataatgttgccccttccaggtctaggtcttaagtccccttgcaccatgcaggcctcaagtcttcctctctttctccattctttggttaaaagaagaggattccaaggccttagaggatgaaagggccatgagatggaaagatcctgcatcctcaaatgaatgcaaggggccaacgccctctctaccaaacccaacatgagaaagaaagaaactttattctgtcaagccactgaaatttgggagatatatttgttatagagattcacctgtatcatgtcaacttctattaaaatttattttaaaaata

SEQ ID NO: 214254 - DNA, 619 bp, Homo sapiens
tgcttagttggtgctggacacagggtaaattgtcagtaatgctagctattattaacatcttcccatctagccctaaatctggctctcctcaggaagtcctgctctgtgggagaggaataggggctgacagggtcagtctatgcctaatcttccaggctaatagtttccaaatgggaaaccttgcagagtgctcaaaaacttttctgggatatggggagacttgaatttctgtgtcagagtttgctgtgtattgactaaacctcattgccttttccttccaagcatgagctagactacatttcccagcctcccttgctgggaccacatgactgcctttggacgaatggagtcagggcagccatgatgccataatgttgccccttccaggtctaggtcttaagtccccttgcaccatgcaggcctcaagtcttcctctctttctccattctttgatcctgcatcctcaaatgaatgcaaggggccaacgccctctctaccaaacccaacatgagaaagaaagaaactttattctgtcaagccactgaaatttgggagatatatttgttatagagattcacctgtatcatgtcaacttctattaaaatttattttaaaaata

SEQ ID NO: 214255 - DNA, 682 bp, Homo sapiens
gggtcccggaaatcctgccttccatatgtgggcttccgcaggcagcctgagccagctatggctcacgttctgcaagcccaggcctgccaccagagggaaagtgccctagatgcccaggcatgccttcctcttggtggccaaagatttcccaggcagctcccagcaggctgtgagggggggctttccagaaatatgcccttaaagatgctctgatagagaaaacataacatgttctttggcaggttgtgggcatctatcatacagtaatcatgggcagtcgggatggtgtaggattggagcctcccgatgtctagacactttggtctgttcacagtttcaaaaacattttaattacaaaccactttatggtgtaaggtgacccacatggagttatcaagaacttctgagtaagtttgctaacttcttttgtggcagctgcaagttgactcaaaactacattccgctggtgagtatgggttgtctggcctggaagacatgtgtgagttgctctaaggggctcgctgttctcttactatctggaaggcctcaaagttcctctggtgggaaagattttcttctgcaaacaccctgggatttgtctcttgaagaatcagggttttggactctcctacgtaaccatcttctgtgggttggatatcagatgtgtatccaacccccagaa

SEQ ID NO: 214256 - DNA, 259 bp, Homo sapiens
caaggaagggttctcccctaaggccttaggaggaaggacagccctgtcaacaccttgatttgtgacttccagcctccagaactgtgacaggataaacctctgttattttaagccacccagtttgcggtatgctggccaccccaggaaactaatctaattcctagtaacaaagaaacctaattaattgtggaggagaagaaaggaacagttttgccatcctgggagcatggctgggcccatcagcggaggaaggtcccca

SEQ ID NO: 214257 - DNA, 679 bp, Homo sapiens
tacagaggcccttgagaggacggacaagagataatgttgggcagaaggttggcaagactgtcaaggatgttgagggtgggcatagagtccagctttggagggcagcttggcagaaaggtgcccatcaccccaatgtagcaggtttcacctgtgatgcctttgcaaaaaggaggtctagacagatggctgtcaggggtgtggctgccacagaagcacgccctggccacccccacactgtgatgagtgccaggccttctaggcagagatggaggtgccctctgcctagccgggaactgacaccctagactagtgcaggacctagccaaggagaactcccacgcaggagcagagcacccaagaggagcagtgtaggggatgtgggttcatagagctgcctgtctgcctctctgggacttgggcttctggtgtggctgtgactgggtgggtgtcagggctttggccaactctgtgtctgtatcttccttatcatatctcaaacacggcacagcaccaactcaaagaacctcacataggtgggcttttctccctttaaaaaatgtggtggacctggtgtggcagctcacgaggtcaggagtttgagaccagtctggccaacatggtgaaaccccatgtctactaaaacaatacactagccggtgtggtgccggtgcctgtccct

SEQ ID NO: 214258 - DNA, 383 bp, Homo sapiens
caatttagtgaccttccagtcacactttttacttatgtatttacaagtaaaagaatatgtaaagacaattgagtattgtgcaacattgatgtgtatttataaaatagctttattttataataaagtaatatgtgtagatagtgtcatgaaggaaatattctccccataatatagtttcccttcttcatttcagcacatgaaattaaacaaacagaggaaacttcatctcaaacccatctaacctagtcagtaccatagtaagctgctttaaatcatatttaaaacaaggtagagtacaaataaatacatgcatgtaagacccaaattaaagcccctcaaaaatctattacttttaatttcataaataaattttttattgggct

SEQ ID NO: 214259 - DNA, 556 bp, Homo sapiens
cgttccctctctgttgccaccctgctcttctcctgggcttaccagattgaactggcggaacaccgtgattccatgagatgagcagttctgggctgggacagctaaggagttaagggacaaccttagctgtactctgggggctgggtgtggcatccccagctcagaaggcagggccagtcagggggccatgccctgggtgctggtggggtctcagtgctttgggaatttggacagcaaggaaggacccctcatcgccactcctcctgctgggctggtgcccacgggtgtccagtgggactcctcacatggtatgtccttcgtgaggcctgccactgcagtcctctaggtcctgtgtggcccatggcatagtgcccacatcacctctgtcctactgtctacccaagccagactcccagccagctgccagtatcactcctgcatttggaaatgcagacagcagacacgttggagcgtctctgagcagaaagctgtgccagggctctgggatgcccagagaaaaagaagacaaggcctggccctttgtcaaaaaaaaata

SEQ ID NO: 214260 - DNA, 1134 bp, Homo sapiens
cgcctcccgcggagccgctcgctcgcctgagtcggagtcgggaacccggcgtcgttgccatggcgactcccaggcttccccacaagactcccacagcctggaggctgctgcgataccccagaggaaagctgcacccccgtaaataacccttcagcctcccgccgtgcccctggaccctgctcgcttcctcctctacccaggcgcggagctcagcctacctcgtggacccgcgcatttgcgggggcttgaattcccgagcttctcgcttcctacgcgcgcagcagacacgcagctcggtggccttggctttcatggcctcccagcgtgtgccaaaggtccccctcaaggaggaggaaaagcagtgaacccatctaataactatgctcatgacataatgagccctgcgatcccggaccaaggccatcataagaggagagcaggctgcctaataagctgtctccacctgccacaaacgtaggcgttcctggacaaaatatttccttgcagagattaaacagatttctatttaatgaggtcagaatgtgaggcgttaagtcttaaactataccatctagtgtggaattcaattttaccaggtttctacaataataagagttaatagtgaaactgttgtcatccttagttttaaattatgtatcactcattgtcaactaataggagacacctattctaatatcagtatgtcattgtttttctgtaaacgactggctaaatttatttttaaaatgtcattgtctggtttagaactgtctatactacatctgcatttcaatatattatctacagaaaaataagttttttctcctctctcttattattattattattattttttggagccggagtctcgctctgtcgcccaggctggggtgcagtggcgcgatctgggctcactgcaacctccgcctcccgggttcaagcaattctcctgcttcagcctcccgagcagctgggactacaggcacacagcaccaagccaggctaattttttgtatttttagtagagacggggtttcaccgcgttgtgcaggctagtctaactcctgagctcaggcaatctgcccccctcggcctcccaaagtgctagataacaggcgtgagccacagagcccg

SEQ ID NO: 214261 - DNA, 485 bp, Homo sapiens
gcctgggcaacaatgcaagaccccatctctatttttgcaaaaaaaaaaaaaaaaaaaaaagacatcattaagaaaatggaaagacaagcaataggctaggagataaaatctgcaaaacacatatctgataaaggagttgtatccagaatttacaataaactcttacaactgagtaagacaaacaacccaagcaaagtggattacctaaggtcagaacagaagatgtggcccaaaactagtatctctagcatagttcaatgttaatttcatgatttaaaatcacagttcacagcaaaaaagataacagggaaatgaacaaaaaatatgtcattgctgtacttgagcctattcagtccttcaaaaaattactaaaatatataaaatggaatattactcagcatttaaaaaggaataaaattctgacatatggtacaacatgaaacctgaagacattatgctaagtgaaatacaccagacacaaaagg

SEQ ID NO: 214262 - DNA, 310 bp, Homo sapiens
ccttctttcttgatctattaagaagctttatgggatgacaatccattgcttttataaagcactctgagcatttcactatactttctaatgtggtttctctatggaagtggaggagacaaacattgttccagttttacataagtgaaaactagttcagaaaagtgagaaattttatctaaggccatgcaggaccaagtgcagtggcttacatctataatcccagcactttgggaggccaaggcaggaggattgtttgagctcaggagttggagaccagcctgggcaacatagcaagaccttgtctctacta

SEQ ID NO: 214263 - DNA, 348 bp, Homo sapiens
ctattgtgacttttactgagtaaatacagttgattttaattattcagcgcagttacgtttccgtaaaatcacagtgaatattgaattagcaaatactgaagcattgctcctaggggaaatacagggttaggtttctatgggcctctggtcacatttcatcaaccaatcaattataaccttgttttatgtgtgtttctatttaaagacaccttattaactatatgttgttgattcattaacacggcacactcacagtctgaacaaaacttatctagcacacgaattttctttgcaaggcccatcacagccttcttgttcttaggaacgccagacactgcttcagcacta

SEQ ID NO: 214264 - DNA, 467 bp, Homo sapiens
aacaatctgccactaatacaattgagggaaattgagccactttagtaacatccagagaataatagtcattctggaaccatgtatgcatgggtgggaggttgtggggagctgaaaacaacagaaatttatgctcacagttcttgaggccagaagttcagaatcagtatgtcagcagggctatgttcccctgaaggctttgggggcaactgcagtgacccctggagttcttggtttgtggccactccactctccactggagctgttttaatgcactatttaatttaaaacctttgaatgaacattggttgcttctaatcaataacattttagaaattttatactgattcaaaggctttaaaatgttgaatacgtgtaaaataattgagtctctgttcacaaataagtatgtatgtatgtggcaagagagttggtaggttttgtttgtttgtttgagatggagtcttact

SEQ ID NO: 214265 - DNA, 533 bp, Homo sapiens
agactgttctttcctccattgaattaccttggcacccttgtcaaagatcaattggccatatatgtgtggatctttttttagattctgttgttatgtttgtctgtccttacattaatacaacactgtcttgataactgtagctttgtagtaagtcctgaaatcaaatagtgtgagtcctctacatttttgttgttgttgattaagattatttcaacaatttgaggtcaagtatatattaaagtaattgtatcaatttctacaaagaaagactgatgttttgatttggattgtgttgtgtctatatattttaataatatgaaatcttctcattgacttttcatttatttatttatttattttgagatggagtctagctgttgttgccgaggttggagtgcaatggcgcgatctcggctcaccgcaacctccgcctcccaggagaatcgcttgcaatcccaggaggtggaggttgcagtgagccaggatcgcactactgcacttcagcctgagcaacagagcaagactctgtctca

SEQ ID NO: 214266 - DNA, 361 bp, Homo sapiens
ggttcacttcaacttctgcctcccgggttcaagcaattctcctgcctcagcctctcgagtagctagctgggactacaggcacacacaactacgcctggctaattttggtatttttagtagagacagggtttcaccatgttggccaggcttgtcttcaactcctgacctgaggtgacccacctgcctctgcctcccaaagtcctgggcttacaggcgtgagccaccgcacctggccgccatcctcattttaaatataggatttatttttcctaaagcacactttaataaacctccttatacaacttaatcacacacaaaaattcatattcgttaaagaaaaaaatagaccatgcacatgagc

SEQ ID NO: 214267 - DNA, 493 bp, Homo sapiens
  misc_feature (236)..(236): n is a, c, g, or t
  misc_feature (438)..(438): n is a, c, g, or t
  misc_feature (446)..(446): n is a, c, g, or t
  misc_feature (452)..(452): n is a, c, g, or t
  misc_feature (488)..(488): n is a, c, g, or t
gtcggcctccaggttggatgtcagaggacagctggaggatctgatgggccagcacaaggacctctgggaattccacatgctggagcagcgactggcccgggagatccgtgccctggagagaagcaaggagcagctgctctcggagaggaggctggtgcgcgccaagctgcgggaggtggagcggcggctgcactcgccgcctgaggtcgagggcgccatggcggtgaatgacgggnctgaaggcggaagctggagataattcggggaagcaaggtccggaagccgccccccaaggttcgggggccggcagaggagagaggccggactctgagctctccccgcgctctgcgacgaggaggattcccgagccgccggtggggctggcccctgacgccctctaggggccagcagggacccggcccgtgtcccgacccttcncctcgagnacccgnccaagaaataaaggggcgatgatttaccgaccaaanaaaaa

SEQ ID NO: 214268 - DNA, 421 bp, Homo sapiens
ttggagctcattcgaggagagacttggagactttgtgagggaaagacacagggaaacgctgccggcattttcccaaacctggactgggagcaggacaacactgggggatcttccctatctggttcaacccatcttgtgcccccaatccccctacccctacattttctatttgatgttttgggggaatttttttatttttgccgctttccttagtttctgtctccattacaacatcctaacactctaattggctttgtatgggacaaacaggaagtattgcttctggcaggatgggattttctgtcctgttgattgatggattaatttttattgagcacggtgtgctaccagcggaaccaaaaatccaagatacaattccagctctaggagtctatgttctaataaaagtaagaacaacata

SEQ ID NO: 214269 - DNA, 1350 bp, Homo sapiens
aaaatttaagtgggtaaaatattttaatatgtcagtggaaagtgcagtggagcaggtaatgcaggagctagagcttgcagttgtacatagggtgatcaaggagggcttcacttaatgacatttaagcagagacttcaaggaggtgagggagctatatgtatacccaagggaagagatgctgaattgagatcagattctatatatattttgaaggtggaaccagtggaatttgctgatggatcagatgtatgataggaaagagaagaggaattaaggatgatgccaattgttttgatctgataaaatggcaggatggaattgaagatttactgagttcaggaagaccttaggtgaaataagtgtggagcaggggcaagattggagttgaattagataactaagtaggggaaacaaaggggagaggttggggcagagataaaagtttgggagtcatgaagataaagatattatttaaagtcatgaaggccaggcgtggtggcttacgccataatcctcacactttgggaggccaaggcgggcagattgcctgaggtcaggagttcaagaccagcctggacaacacagtgaaaccctgtgtctgctaaaatacaaaaaattagccggctgtggtggcatgcacctgtagtcccagcttcttgaaaggctgaggcaagagaatcgcttgaaccctggaggcggagattgcagtgagccaagatcatgccactgcactctagcctgggtaacagaacgagactccatctccaaagttaaataaataaataaataaagtcatgagacgggatttggtcaccaaggaagtgagtatatatagagaagaggtccaagggctgggcccttgaatatttaatattatttagaagtctgtaagatgaagtagttagcagaagaaattgaggagagaccagtgaggtgggtagaaaactgaagaatgtgtttcaagaagcaggaactggccagttcctgcttcttgaaacaaaatgcaaattggtgcttgttggggttagacaagccacagaaaagaagcttctttaaattaatttttgaaagtttagagggagaaaattcagtcaatgggatgtttatctgcaagaatgtctgatatcacctggaatcatgtatctgggagtctggctggattttccacttttttattagaattctcaaatggcttatcggtgaaatttgtaagagagtctcaattttcctgttctgtgtcctgttctgttatgaaaccttaggatgagctcaggcaaccacagggtagctgagaaaatgggatcccttcttgcttgtttattttgtcacatctatatcctctgcatttca

SEQ ID NO: 214270 - DNA, 490 bp, Homo sapiens
aataaagtcatgagacgggatttggtcaccaaggaagtgagtatatatagagaagaggtccaagggctgggcccttgaatatttaatattatttagaagtctgtaagatgaagtagttagcagaagaaattgaggagagaccagtgaggtgggtagaaaactgaagaatgtgtttcaaggaggaagtgattgtgtcaagagatcctgataggtcaagtgagaattggccattgagtttacctatatggagggtcatagtgatagttttggtgaagagatagggacaaaagcctaattggggagagttccagagagtataggaggagaggaattagaataattgtatagacaattatttaaaggaattttgctttaagtgggattaagtaatgctatagcatcactttatagtgctttaagtaggattaaggttagttgttttaagtttgtttattcaattaaaggagttttgctttaaatgggattagag

SEQ ID NO: 214271 - DNA, 1008 bp, Homo sapiens
tcttagcctttttttctacacttgtgctgacccccaaatttccatctttagctcagacctaatcttgagacgcccatgcccagatgccttcctggcccctccacctgggtttcttggtgcacttggcagagaagttcaggtcttatgatggcctctccaggccctgcccttctaactctctgctgttatccccttaccctcccatgctcactctgtaccagccatgcggcctgcctcctatttgaaacaggggtgtcttcacttactgttccctctatctggaagctcccctggcccccagtgttcatgtaactcattcctaacttccccaggtctttcttcaagggcagtctccctgaacccccaaactaaagctgaatccccactcacttccagctttccttccctgcttctattttcctttgtaactgaacactaagttccacatgactccccgcactgtgattcccaaggtgtgggccaggatctgagggggtccccaaaattgtttcaggtgttctatgaagtcacagccactccatgatacactaaggtgtttagaggggaaaatctacattctataaagacacctttttgtttatgtcttgttcactgctgtgtctctagaactggcacacagtaggcactcaaatatttttccaagaataaaatatgtgttaaattaattgcagtgttctacatccatggattatttcaattccaactgcatcatctaatctgagtcattctcagagttttctaccaaaatgccctaatcaaagaggcaagtaaatacaaaaaaatgggaaccaggtgtggtggctcacacttgtaattccagcactttggaaggattaggtgggagaatcacttgagcctgggagttccagaccagcccgggtaacaaaacaagaccctgtctccacaaaaaaatttaaaaattagtggggtgtggcagcacgtgcctgtagtcccactactatgggagttgaggcaggaggattgcct

SEQ ID NO: 214272 - DNA, 479 bp, Homo sapiens
tgttttttctataaatctcattgctaatatctgagacaggagcaacactgagctttgtgcgtgctgcacagtgtttttgtttataagacagtttcccggtgtctaatggcattggatcccacaacaccatgggaggtcggggggtcaggcactcctagaaggccacatggagcagagcatgagaccgcaggttctgcagttgaaatgcctgtcctggagcactgctcagcctctcactggctgcctcaccttggacaagtactctgtttccttgtgcctcattttctccagctgaaaagtggaactaatacagcagtccttgcttatccacggtttcactttccagttttagttacatgcagccaatcatggtccaaaaatattaagtggaaaatcccagaagtaaacaattcataggttttaaattgtgcactgttaagagcagcttgatgaaatctcatgctgtccactccatccca

SEQ ID NO: 214273 - DNA, 472 bp, Homo sapiens
acttgaaagattagttgccatcaactgaaatgaggcagctacaagatgaagctaacagggtcacctatcagtagttcatttttggacatgttgagtttgacatggctactgagacctccaagtggctgttagtcttccaagtggagatagcaggtagccagttggagagattttggagtttggggagaaaggcatttaaaaccttgagccttgatgagatcaccaagggagtgaatgcagtacttaaagaagaccaaggactcagcccagggacattgcaacatcaagagacagagagaagagaaggaaccagtaaaggagactgaggaagaaaggtcaatgaggtaggaaaaccaagatagtggagtcttattcgggaagcaaaagtgaagagtgtttcaaggtggaaggagtggtcagctatgccaatgctgctcataggtcaagtaggatgagaacagagagttgaccc

SEQ ID NO: 214274 - DNA, 397 bp, Homo sapiens
tagggttttgtgtttgtgttcatttgggatattggcctgaagttttcttttttgttgtgtctttgccagattttggtatcaggataattctggccttgtagaatgagttagggagcagggggagtccctcctcctcaatttttttgaatattttcagtaggattggtgccagttcttatttgtatgcctggtagaattcagtgtgaatccttctagtccatggctttttttttgttggtaggtttttaattactgactcaaatttggaacttgttattggtcttttcaggttttcactttcttcctggttcaatctttggaggttgtgtgttcccataaatttatttcctctagatttcttatttgtgttcatagagatgttcataatagtctctga

SEQ ID NO: 214275 - DNA, 353 bp, Homo sapiens
gagcatttactgttcaggtggctctgtttggtctgggcatgtaaagaaatgtaaagtagaccaggtgcggtggctcacacctgtaatcctagcactttgggaggttgaggcaggcagattatttgaggtcgggagttcgagaccagcctggccaacatggtgaaacctcatctctactaaaaatacaaaaacaaacaaacaaaaaaaactagcctggcatggtggcccacacctgtaatcctaactactcagaggttgaggcaggagaatctcttgaacccgggaggccgagattgcaatgagtcgagatcgtgccactgcactccagcctgggtgatagagatggtgtctca

SEQ ID NO: 214276 - DNA, 429 bp, Homo sapiens
aaattgccttagtcttaaataatttccaagaaggttttttccactgtgaaagccttgggcacacataaacattgtctagagttccttttgggcagagcccctttgaggtgtgtgtcatggaaagatgtaggaagtagctctaagtgatgtcaaatgcctagggctgggtcttaaagactttctgtgtggaggaggaacttttttaaaaatttaaatatgaatgtatctgtgtactgtgtaatgcaacggtattatgatatcccaaagggacttttaacatacaccaaagaggcttctttataacagaattaaacaagtgttatttatgtttttgcaaagtaaccaaaatatgtgcttttattttcagatgtatcacgtcttaactttttaaaaactaaattaaggagactctttacatatttctgtgac

SEQ ID NO: 214277 - DNA, 448 bp, Homo sapiens
agacacagtcggttgttgtctgttacctcagatgccagcactttctgaatgactctggttgtctcactgggtttctaacatgttgaaagcagatgagtgtgtaagttatcttgtgtcaactgcacatggtctatctaatctatctatatgggtgattgtattactatacatagtgtacttgttttcttttttcttttttttttgtttttaagcttttatgaactggtaacaattttgcttggagctcaagatgagttgggtcctgccagatggcactgttatttctctggcagaagtagctagttattttctcttttccttcaacacttctctccttgtcctcaagcattaaatcatgcatatacaatacaaatccttacagccgctgttattttcagtccattgtatctatttcctgttgaccgaaggttatgaggcttgggtagtg

SEQ ID NO: 214278 - DNA, 352 bp, Homo sapiens
gacgcttctcctggtgccttctccctgtgctgcagtcaggaatgcctgctttccaggctcccgctgctcagctgttgccctggctctttcattcaccataagcctggaaaccgcttctcctgtgctgagtcacctgttccgtggaggctgtttcctccttgttcatggtttgctctccctgcctggttggagcacgtcttccagcagcttcctgagaaagagagtgcatgggaggtctattttgtggaatctgaaaatatctttagtatattgttgtatttgattggtattcaagggaaatacaatcctaagttggaaatccttctccctttgaattttgaaggcatgtctt

SEQ ID NO: 214279 - DNA, 493 bp, Homo sapiens
agtggtccatgtggctagattatattcacatataattttttttgatgacagtgaaacgtggttacatgcttgacaaatatatgctaaacataaaataaatgtaagtcaaatgtacaaaaagtttgttcatatttttcttttgtcagtaaatcttttgaaattgccttggttttatgatgtagttttactaggactaaacttcaatagctcataattatgtaattaattatatacagcttcaaaagcaattactaattgacccagcttgctaacatgacgcctggtgaccatcagtcactgataatgaaaacaggaaaacagctggggccacatcaactcctagcttattttgggtgccaaacagccacttaaaacaaaatttaaaatgctctgacttcagatgaaccacatcccatgatcaaaaccactcaaacagctgtcaccctgcaagctgaaagttttgagatcaaatcaaatcaaaccttctaatttg

SEQ ID NO: 214280 - DNA, 411 bp, Homo sapiens
caaaaagaaaaatggtgataataacaactcatcttcattgataacttagtgtgtgctggacatcatgccaaacatgtaacgtaagctattttagtaatccttgtgatatatgtatgtcatccttattttgcaaaagctcagagaggttaaggaacttgtctaagaccacacaggtagcaaggagggaagcacagaaggaggtcctggccattctcttcatagcttcagagaaccttctctcctgcaccttctccttggtccctggttttaatgtttggcaacactgactgccaagaaatccatcgcatctggtaatgacatggaagagtggagacaggacactggcctcaaggccaagtccatgtttccagccctgactctatgacctcctgccaaaacaaacaaacagaa

SEQ ID NO: 214281 - DNA, 448 bp, Homo sapiens
tatatcttgataatctggtaatataagttgaagaacaactttgttcttcaaaatcactttgtctattccaggttctttgcattgctctataattttagaatgagttaattaattttctcaaaacaaacaaaacgccctgctgacattttgttggcagtacattgaatcagtagataaatttagagagaattatctcaaaattgagtcttacagttcatgaacatggaatacatttccatttattgaattcatctttaatttctttccttaaggttttgttgtttcctgtctaaaggtcttgcacatctgttaaatttattcctgttttacattttttatgtttttacaaactgttaaggttttaaaaattttatttttcagtagctttgctttaatataattgttttatacttttaccctttattcagcaataaattatttaatttaa

SEQ ID NO: 214282 - DNA, 326 bp, Homo sapiens
gagttggcaggcaaaggcaagagggaagaatgtcacagaaagtggaaataaaggaaggtttttaaaaagtttcttagaagcagacaaaaacatatactggggaaaggacaccctaattcaataaatggtgctgggtaaactggatcaccaaatgcagaagaatgaaactggatccctctcaccatatacaacaattaactcaaattggattaaagacttgaatgtaggaccataagctgtaaaaattttagaagaaaacctagaaaaattattgtagacattggcctaggcaaagaatttatgactaagaaccaaaagcaaatgca

SEQ ID NO: 214283 - DNA, 531 bp, Homo sapiens
gtcaggactgatcctctcaactactgaccatttcacctccattcatgtccatgccacatcaggctgtgttgtctagatggaatgaatccaccccaaatgtccctttctggaggaagccaccattatgctgtgcctccaacacgtccacacacaccaagtcacctcgctcatgcaaggtgtgtgtcctctaacaaagtttcacgctctaaacccagataacttttgaaacccaagttctgttgattcccctactttgggtgctccatagttgctcatttgtctactaaacactgccccaggcaattaaatattccaaagtgaccagcagaatttttatgttaattctgacattgcgttgttagtacaagtgtttttcccccttcaaatttatgtctttgttactgataaatgtaactgataatgcttttttcagctatgttgccaagcatatttatataaaaatatactcagattgttttcagaatttgacaaagatgatagcaacaatgataatctcatttgttttatact

SEQ ID NO: 214284 - DNA, 290 bp, Homo sapiens
caactcgagctcgtacccctaattggttcttcgatgacgatatgattttatacttagaaaaccttaaagactgtaaaaaaaaggcaactagaattgataaacaattttagtaaggtttcaggatacaaaatccatgtacaaaatttagtagcatttctatacaccaataacatgcagactgagaatcgaatcaagaacacaatcccatttacaaatcccagaaagaaagtaaaatacctaggaatgcagctcaccaagaaggtgaaagacgtcatcgaagaaccaattag

SEQ ID NO: 214285 - DNA, 565 bp, Homo sapiens
agaaaaaagaaacattttctgaagacagaaatttggtctgacttcaaaaaaaaatcacactcatactttctccaaaccagctttatgggccttttggaaaatgaatgaggagatatttacaaatctggagacctcaagataacggaaataggcaatgcaaaaccttcttaactctttaaagtacactgacctcttactaaaaacagctatttgtttcaaagaagaaaagttttaaattggcagaagcacatgttggagaattagaacagtattatctgtctcttattcagaattcagtgagagcagagcctcctgattgtctggcataatacatttattttggtatttgttgttgttaaagcctccatgctgggaagagctgtgataaatactgatatcctcaatttaggaaggcagtccctttaggatgtagtttcagcaatgtatatatggcaaatttagaaacaaaagtttcttagcaacttatagttgaaattgaaatgagacagtataccatttactttatttgactatgccaagtaactttttaaatctgtctctgtag

SEQ ID NO: 214286 - DNA, 694 bp, Homo sapiens
gagaatgaagctttgaatgagctacaactcttgctgctttttaacgtagcttctagagtgcactgggaatgtgagctgtcgtttcttcaagactactgtggatctggagagcaagggatgggactagggcaagttaaaatagaaagctcatcattcttaatgagattgagctttttaaaaataaatgcaacttggatgcaagctttttattaatttttagagttctgataaagttgattctattttccagttttctttgtgcttttgtggaagagacagtttttagagatgcttactctgctgcttcccgcgatgctctcttcactcggtctctctcatcccatatcgccagtccccccacgcccatccttcccactgtcacaccactctcaccccctccccccacctctcactctcggcaaccccctgtgactcaccaccttctcacccctgcctacactcctaccgcccacctccgccctgccttctcctgctctcttcaatcaccctctcttctcgtctcactcctcccctcactccataactgcaccacgcgctcctcagctctctcatctcttccctctcgctcgcctcgcacccatcccacccctctctctccctcaccctatctctcgccctcacgtctttcctccttcatctcgcacctcgccgttccctcctccccgcctctcct

SEQ ID NO: 214287 - DNA, 386 bp, Homo sapiens
ttgaaagcaagcaatgttccagtgttaacatttctgatttgggggatgccagatagtgaaatttggattaaacagagggaatttatagtcttattctaattaataaatggacttaacggggttctgaaaataaaacaacctcataattagttggtaattaacatagctaagagccaggtagaactgtccaacctgtgtcatattctcacaggtgtgcccacaaaatacaatattatatagaataaatacattgcccaccttcattcatccagcaagatgtactgacttttcactgtaggcatgaacctgaagggaattaaaaatgaaggatggtccttgctctcacaaaagctgccaaattgggtacactcactcagtgtcttcaa

SEQ ID NO: 214288 - DNA, 196 bp, Homo sapiens
aaacaaacaagatcaaaagacggacaaactgtcactatggataatatttcagctaaatagatctaccaacaaaagtataggacatttagataggaggaaacaaacacaggtacaagccatatacatatctactaacccaaatctttatttcttaacatgtttaaataccataaaagtcccttctaggatggacatt

SEQ ID NO: 214289 - DNA, 191 bp, Homo sapiens
aaacaaacaagatcaaaagacggacaaactgtcactatggataatatttcagctaaatagatctaccaacaaaagtataggacatttagataggaggaaacaaacacaggtacaagccatatacagggaagccagctagatgttagagtatggagcaatcgaggaggcataaccactcttgttgggagctt

SEQ ID NO: 214290 - DNA, 445 bp, Homo sapiens
aaaaaaaaaaaaaaaaaaaaaaaaaatttggttctaataggctttggtgagactgtaagattggtgcaacttttaaaatgacaatttggcaatgtttgtcaaagctaaaaaaatgcacataccatgcttcatctagcaatttcatttctaagaatttgttctacaaatatactggctctatgtcaattaatctgtagactgactcatcaaatttaccaattgtgttggtgtattcaggaaaatttttttaaatagatatggtcaaaattacatcacttcatggaaaaatttttcagtttattctgatttcttttcaatccttttaaaagttgttttatgtatttcccccagcatcttagtatttttaggattattttgtcaacttcaaagtgcctctaccaaccttattttttggtgtttttgactaaagtttacagctatttat

SEQ ID NO: 214291 - DNA, 1059 bp, Homo sapiens
gcagaggttgcagtgagctgagattgtgccactgcactccagcctgggtgacacagcaagaccttgtctccaaaaaataaaaaaataaaaaaataactggaacattgccaaactgaatagaaaataatccaagtctatgcagtttgtaagaaatacacctaagacataaggaatgagagagactggaaataaagatatggaaaaatctattccaaaagaaagctggcatagcaggttaatagtagccaaaactgatttgaaggcaaaaatcattatttgcgttaaaaattatcagaaaaaaattgtaaaggaagaattaagcaagaagctataattccaaatcagtatgcatcttatagcatggccttaaaatagatagatagaatacaaaatatgtagatagaatataggaagaaaatatatagatacaaatatgaataaatttataaatctataaaatggaaaaatttaacatgtctttttgagtaattgatggtcaaacagacaaaaacaacttgagaagataacagaagatttgaacaaccaaccaacaggcttcattttttggatatgtaccaagccccacgcttaatagatgagaatatacattctttttagggagttttaaaaaaattgaacacacactgaattcataaatcaagtctcaacaaaaccaatgaatggatattatgcaaactattctcgtactcaattcagttaagactgaaattgagcaaaaagataaccaaaataattttatatatttggaaatttaaaagcatacttctaagtaactcatagatcaaagaaaaaataataatggaaattataagtaaagccgaatgataatataaatactgtgtatcagaattatgggttacaactaaagcagcatttagagggaaatttatatcatcacaaagaagatgagggtaagaaaaactaattaagaacattaaaaaagccaaagggaaatttacagccttacatgcttatattagaaaaaaaacagagttcattatttattagtcttagtatttgactgagaagttattttta

SEQ ID NO: 214292 - DNA, 644 bp, Homo sapiens
cagcatcaccgttgcactaattacatcattttcctgcccatgaggcctttggggcccccagagtgctgacccaggagcctgttcccccagtctatggctcagtcaccagagagggcacaagggcaattctcctcccactctctgccaaccatacaggcatggatctgccccctcaccccaaagggcctcacaagtccagaatgccagggggaagccaaccagtctcttctcaagggaagaacatgatcccagcatcttctatactatgctagatacacaaggtttcctaggactcctcagcattggtggatctgcccagacctaagcatttcataccagcagctcagctcagacctgcctggcttgcccattctcagtgggactgggatcagggtctatagaagctgcctccaaaaggtcccatgcctgaccctcataccgtatcacctaaaggttctctgactctccgtcctctgcttcctgagtcttcaataccaccctcccttgcggggcctctggcaaggcagcatgggataacaaaaagggcgggaggcagtggggtaaggagacccaagttccagtcccagagctgtagctaatggtgtggccttgggcaaatctcttccttccctggcttccatttc

SEQ ID NO: 214293 - DNA, 434 bp, Homo sapiens
tattgtcctggcacacagtctcaataatgaaaatcaatgtcagcttccttagttttaggagtaggagaaacaggtttctggagactcctagaagcatttctagatccatctcttcattagcagaaaattaacagttgactttctttccctcacactcaaacaaatgtgtcacacttgcaataaatgacattctgtcagaattgtccgtagcttcttccccatgctatcgaaacaaaacatcatttgttcctgtggtttctttgagacgatctcattgctttatatttattccaacagtagcctctgcctgcctgtcaccctcctcactattctcagtatcagtgacaatgaaggcaccatctttctgcagctaatgagagtactgctgtagccactggcattgggaccctggagtttgcctttgctggccagag

SEQ ID NO: 214294 - DNA, 402 bp, Homo sapiens
tcatggcctgtcattggtcttctggaattcgaaatcatatgggtacaggtcacaagttttcttggtcatgaagcttctctagtctcttccttgggtttgtggacacctgactcccacagaaggaggctggcaataagatataatgatctgtttgtgctgcaattgaaaaccagcagcaagaagccttattattatccaacccctcattactagtgttgtcctcctccgttagcttggtatctgccagcctgaacgggcctggcatctcctttctgccccctcccactgccatgctgtgcccttccttgctctctctggtgtctgcttcccagggactggccctcctccctgcccctgtcagcctgcctccgaggccacagatctggttttcctcccttctgt

SEQ ID NO: 214295 - DNA, 901 bp, Homo sapiens
gaagagaactacacaaaggtgaaaatagggatttgtggggcgttttcttggactctggtgaccataatcctatatggtttttttctttttctgttttagttgtttaatatgaattacattgactgatttttttaaatgttaagccaaccttgcatttctgtaataattcccatttggtcatgatgtattagtcatttagtatattgttgaatttgatttgctattttgttttgttttgttttgtttttttgtaacaagttttgcaccaatgttcacgagtgatatttgtccctaactttctttcttgcttgcttgcttttttttctttgtaattttatatcttgcccaggtttggctttggtatcagcataatgccagctttatagagtaagttgggaagtattcctgctcttcagctctctggaagagtttgtgaataattggtattatttcttccttaaatgtttggtagaattcaccaaggaagctgtctgggcctggagtttgttttgtaggaaagtttctaactataagtttgatttctgtggtagatagagggctgtacaagttatatgtacatctgtctgtgtgtgtgttgtctgtctgtcactctggccctgaagtgtgttttgtaggacagcatctaactacaagtttgatttccatggtagatggagggctatactagttatatatacatctgtctgtccgtccatctgtttgtcactccatccatccatctatctctagagtgagctttgatggtttgtgtctttcaaggagtttttctgttttatttaagtactcaaatttttcaaaatattattttcatacttgtagaatttgtagtggtgcaacctcttctattcctgatactggtaatgtctatatttttctttta

SEQ ID NO: 214296 - DNA, 407 bp, Homo sapiens
aactcataggagaagaataagcccatgcaactgaaggcagaggagaggatgctccagaatgctagaagaattaggtttgtgaaagaattagtgtttccatctgactcagagaaatctgaactgctagatcaacctgaggtggcttgaggaagacagcaggtatggctatatttgcaggatgttgagatcctacattgatctgcagtcccattacaaccaatgccatttaaatgacaactactgtgaaatgaaaatatttgcaagatccagtaggctctttgtactatgcactgaaatcctagcataagggaatattttgggtgtctctttgaagtcaagtataacaggatttgaccaatactgcctgaagtgtaaatatagtcaataaaaatcatttttacattctg

SEQ ID NO: 214297 - DNA, 500 bp, Homo sapiens
agagagagtacggagtgtctggaggcagacaaggcccagtcttgcgggagcacacaagggaggaagaagctattgtgtccggaattggttccttctggtgggttcttggtctcactgacttcaagaatgaagctgcagacccttgcagtgagtgttacagttcttaaagatggtgtgtctggagtttgttccttcagatgttcagatgtgtctggagtttcttccttctggtgggtttgtggtcttgctgacttcaggagtgaagctgtgatccattgcagtgaatgttacagctcttaaaggtggttcatctggagtttttcattcctccagatgggttcgtggtctcgctgacttcaggagtgaagccacagaccttcccagtgagtgttacagctgttaaaggtggcacgtccggagttggttgttcctcccagtgggtttgtggtctcgctggcttcaggagtgaaaccacagacctttgcagggagtgttacagc

SEQ ID NO: 214298 - DNA, 515 bp, Homo sapiens
ccatttttattactgccattgcactgggtgcccattaaacgtaatgcatacacacacaacatcaacaacaatgaccaaaactattgcttgtgcagttaatagaaaccaaatttcccagaagcttgcaactccacatgtcacatgttttgcttttttcccactgatttaagaatctctccctaagctaattttcttctccgttcgctctaccccaggccccaaatgcccatggtctaaaggtcttttgtcaaccacactcaaagacttccatctccttgagggtgaacttgtctgcctggtttcattacttgcatggcactcctctcagatggggactttgaccttctgaaattcctgttgaagattaaataccaaacccagcagtccacaggagagttaacagacggtttcagtacacacagcaagacttccagagtggtcaaattattaatccacgggaaaatgcggatcagatggtcaaacgcaggacataactcacatagggaaccggcttt

SEQ ID NO: 214299 - DNA, 294 bp, Homo sapiens
acaagcccaggagaggcctcataggaggggtcagggcacttggtgggtgtgccctgtgagttagaacctgtgagtgggaattattatcccagtttccagataagggagcaaactgaggctcagagaggttaaggaacttgtccaagctagtgataaacaaaggcaggagctgggcgcagtggctcatgcctgtaatcccagcactttgggaggctaaggcgggcagattgcttgaggccaggagttcaagaccagcttgaccaacatggcaaaatcccgtctctactaaaaata

SEQ ID NO: 214300 - DNA, 383 bp, Homo sapiens
gctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatca

SEQ ID NO: 214301 - DNA, 169 bp, Homo sapiens
agggggaattggagtctccctgcgggctgtggggtagggttgctgtgcagtgccccctctctagcccgttctagggagggagatgaaaacaacccccaatccgcaaacagcttggagggaaaaaagaggcactagggtgaaaggaatgaaaggtgcaagcgtagaccag

SEQ ID NO: 214302 - DNA, 665 bp, Homo sapiens
gcgacagagcgagcattccagccagcaatgaatgagagttcctgttgctcctcatcctcaccagcatttgttgttgtgaatgttcaggattttggccattctaacaggtgtgtagtggtgccttgttttaatttgcatttccctgatgacttatgatgttgagcatcttttcatatgcttatttgccatctgtatatgttctttggtgaggtgtctgtaaaggtctttggctcatttttttgtcttttttttttttaaacattgttgagttttaagagttctttgaatattttgtttgtttttttctgtatgatatctgctacagtctttgtatatttttgataacagttccttctcagatatgttttttgcaaatattttctcccaggctgtggcttatctttccattctgttgacattgtctttcagagggcagaaatttttaatgttaatgaagctcaattattgattctttgttttatggatcatgctttagcattattatctaaaatatcattgccagggtgtggggggcacgcgctggtagtcccagttacttgggaggtggaggctggaggatcacttgagtccaggagtttgaggctgcagtgagctatgatcacaccactactacagcctgggtgataaagtgagaccctgtctct

SEQ ID NO: 214303 - DNA, 286 bp, Homo sapiens
gtgacagagcaaggcaagactctgtctcaaaaaaccaaaaaaacaaaaaaaggaatgttttataatggaatgatatagtacagaaccttttgagattggctttaaagaaaaaaatcaggcagattctcttgagatctacccaaggtgctgagtatatcaacaggttgttctttttaaatctctgagtagtgtttctgccatttgtttagccattcacccatggaagaacatttggattgtttccagattttggctttacaaataaagctgctatgaacattctggt

SEQ ID NO: 214304 - DNA, 408 bp, Homo sapiens
atcctgaacaatttttaagactataaaggagttctcagagcaaaatgtttaacaaccactgatttagagaaatagggagttaaaagagaaacatggagggccaggtgctatggctcagcctgtaatcccagcactttgagaggccgaggtgggtggaccacttgaggtcaggagttccagaccagcctggtcaacatggtgaaaccccgtctttactaaaaatacaaaaattagctgggagtggtggtgggcacctgtaatcccagctactcgggagactgaggcaggagaatcacttgaacctgggaggcggaagttgcagtgagccgagatcatgccactgcactcgagcctgggtgacagagcaagactctgctgcccgccgcaccacgccctactggggcaaaa

SEQ ID NO: 214305 - DNA, 406 bp, Homo sapiens
tatgtagaaactttaatcagaagatcccttaaacagaagaataactacccttagagttgggagaaaaccaagactatattgttaagtagttaacaatgttaaatgttacagagatcaagtaacataagaaatcaaccaagatacattggccaggtgcggtggctcatgcctgtaattccagcactttgggaggccgaggtggacagatcacttgaggtcaggagttcgagaccagcctggccaacatggtgaaaccccgtctctactaaaagtacaaaaattagccgggcatggtggtgtgcaccttaatcccagctactcaggaggctgaggcagtagaatcgcagcctgggcaacaaagtgagactctgtctcaaaaaaaaaaagcaaaagaaaaagaaatcta

SEQ ID NO: 214306 - DNA, 683 bp, Homo sapiens
tggctcatgcctgtaatcccagcactttgggaggccgaggcaggtggatcacgaggtcaggagatcgagaccatcctggctaacacggtgaaaccccgtctctactaaaattacaaaaaaaaattagccaggcatggtggcgggctcctatagtcccagccactcgagaggctgaggcaggagaatggcatgaacccgggaggcagagcttgcagtgagctgaaatcacgccactgcactccagcctgggcgactgagcaagactccgtctcaaaaaaaaaaagaaaaagaaaaagctcttgacttaacaccacacatgtagtgtgccacttcccttgaaaatctgggacagtgccaggaatagtgggtcagaggacctgtgttcaaagctcaatctcataaatcaatccaatgaagtgggacaatccaatagcaggcagcctgagggagaatcattccatgctctcctatcctagctttctaacacaagacagcattccttcactctactatttgtttttcccaaacagataagccctgtcttacaatacaggctgagtattcctaatttgaaaatccaaaactttttgaccaccaatctgacactcaaaagaaaatctcattgaatcatttcagattttgaatttttggattagggatgatgaactgatataatgcaaata

SEQ ID NO: 214307 - DNA, 359 bp, Homo sapiens
agccgggaccccctttctggggcactcacagcatgggccacagcctctgttcctgcccatgtcctacttgggtggtgatacctggcattggggcatctctgcttctggactcaagggcccagggtcgggttctggggtaggggtcagaaaatgtttttggtgaggggccaaatggtaaacgtggctttctacggatgttcagctgcacaggcaactgcagaaccatgcaatgcacacgtgtggctgcacgtcagcgagactgtattttattagtagtagtagtattgtttgagatggagtctcgctgtgttgccccccattgcactatagcctgggcaacagagtgagcccttgtctca

SEQ ID NO: 214308 - DNA, 273 bp, Homo sapiens
agagaatcgagtaatggtagcgcccttcttcagtgaaggtttcttcctggaaacagaaccggaagaagcaagtggtcaaaggtcacattggatcagctacaatgatggacagcagggaagagtctcaatgggtactattgtgtccacgctgggcattacctgtgttgcagccacacagacctgatttaggctgcccttgcaagtagcaagtactaaacaccattattgttttgatgaaaagggtcctgtggattgtttttggtctgcatgtta

SEQ ID NO: 214309 - DNA, 598 bp, Homo sapiens
tattttgtctctttcctaggatcagtttatgtttgtacattctagcatctgcagggttttgacatgtcatttccagttaaggactcgctatgagttgctcatgttacctaatatttaagtagcaaggggattccattattagttgctttacaaatgattcacctagacattcagacacaaacctaggcttacttgttttcttttctcatcaaagcagctggaaaagaaatgaaaagcagcaacagcaagggggagtttaaggattttatgcagacagataagaaaatatagccagctcaaggggtaataaaatattataaaataaatagcaattgtttggcatttgtagagatccaagtgacactactaagtggcattcatatcacactcatatactaaagaaggttcctgtccccctagttttatgtctttgctatatatataattattggtaagttctgtttgccctggaataaagacgttgggaaagatcatgttgttaatagtagctatcacttacagagcagaaacaatgggctatacagaaattattacatttaatccttatgccaaccatgtaataactgctattatcccc

SEQ ID NO: 214310 - DNA, 256 bp, Homo sapiens
tattatccccagttacagatgagaaaactgaagctcagagagtgaaaggacttgcctaaagacacacagctgcccaggatcccaaccatcttatgggtggaggagtcaacctcagctcctcttccaggtggccggccaagctcggatcacacccggcatccctcatccacatcgcctcttccccaccacccacgaccagtaatccagtgtgcatagttgtaaacttgtttctttaaataaacagtcttgagtttca

SEQ ID NO: 214311 - DNA, 651 bp, Homo sapiens
acttttctcctcaaatgtcatttaaatctcattaggtagatctttgtgaaatgatggcactggcaataatgattcctttttagttctccagtcattttggccagtggaagggcctggggaaaagcattagtatttggctgattggtattagtaggggccatgaagaattaataaaaattgtaagacttttttacccttcccccctcaattggatgggcaaactcagatttgataggggttaattatgccagattattttgcttgttttgtcactagctggtaaatgagagttggctttgtccttaaattgaggtatcaagatgttgggactgcagctagggtgggggaatatgaaatgagggtgtgtgtttgagagacatttgggcaaatagaatggcaagttgggtataggaaatgatgctacacgaggagtcacctgccatggctaggacagggctgcttctaatttatgatatttactcattgcagttttgttgtcatttaagcctgaggtctaaaagtttaagtgcctgcccattaaagcaaacaaaaaaaatcatcttatttgaatgattgatttatctgggttctggttaaaatttggttattcatgtatgtatctgaataggatttcagttcgttatccatgtt

SEQ ID NO: 214312 - DNA, 464 bp, Homo sapiens
gtaaataatttctggcattgagccgaatcagaactgctctgacataaaagaaaaactgtaatccatagccccaggcccaacacctgggctgtctcagctgggaacttgtttcaggtcgacttgggtttgagtcgtggccccagaacttcacagttgtgtagtcatggagaagtcagttaacctcagtgaatctcagcatccagtgagaaaatcctcatctcctttatagggatgctggatgtgtgcctagcacagtgcctggcttgcagacagtgtccccaaacagaaccagccctgaataaattgtgtgacacacaggcctcagttcttgaaaaggcttgagagaccaggcatgtggcttatgcctataatcccagcactttgagaggctgaggctggaggatcacttgagctcaggagtttgagactagcctgggcagcacattgagactttgtctctaaaa

SEQ ID NO: 214313 - DNA, 466 bp, Homo sapiens
agcagtttggtgggctacctgaaatccctggagagggattagaagcaggccagttctgatggggagttcatgcttagaggagaggtgatgcacacgataagttccatttgcttgttttaacctagggacaagtatacttggcaaggcatgcgatatagtaggggcactggcagagagatcacagcttttctggcctgaggaaccaggagattgagtgtggggaagccacagaagagaggcaatttggaagggaaagatccaaagagaagattccccagttctctctgcctactttttaggctaacccctgaaccaagcaaggtagttgcctgcttcaaaaacaaaaacaaagcagggtgtgttggcacatgcccgtagtctcagatacttaagaggctgaggcacgagattgcttgagctcaggagttcaagaccagccagggctacgtaagcaagaccttatctg

SEQ ID NO: 214314 - DNA, 353 bp, Homo sapiens
atgtgataattgatccatattttttcaatctgtggatttaaaactagggagattaatagagaagatgctatcttttgtgcattgtgtgttctttgcaagtaatgatagaaaaccaccaagcaaatagatgttctgagcctctaaaagattgcctctcctcagagtctccagtatttttatattactgagctttccttttaatagaaatcctatttgtgatttcaaaaggatgtatagcataaactttggaagccttgtatttgtggactcattcgggctataaagtgacggggaagcatgcacaaagatttgccttagtgaagatggcacgaaagccttgacgagggtttctg

SEQ ID NO: 214315 - DNA, 572 bp, Homo sapiens
atcagtttgtctttacaatattctcctgagggtgggtgacaagcaaacaccatcgtccctgttttacatgggacagaaaggagcaagaaacagaaccctgacaaaatcactttgccatcaatttaatgcatggcttttagtgattcgaaaatagaactcctgatgacttatttctagttcacattcctgccctttgctaaatcaggcagtctccttttgctttaattcatgcatttctaaaatttcacgaagaattctcattaatattaaaatagcagcctactgaaaccaagttttctttctaaaagaagggaaaagaaaatggtgtgcaaacagtcttaatgagttgatcttcaaaacaccactagcaatgacagagaagacctatcattttcaacaggggagagaagacctctctcccaactctcctttattaaatatttggtaagaagcaaataaatagaaacagatggctctagacagcataggagcaggaaagcattgccccatgggacagaatgactcagtctcatggtcagtcctggcccacagcactgactctaacttcaaag

SEQ ID NO: 214316 - DNA, 431 bp, Homo sapiens
aagccaaagaggcgactggaagctcaggctgttcggcggcctcggggcgaccacaggccaggccctggtcctgatccacgaaccaaggcgcctcctctcccccaggaagtgagctactgcgcccctcggagcacccaggcgagcccgggcaccgggagaacgctctacactcggcgcccagccccgggacgccgcccagcgcacggctccggctgagcacccgggcagcggtagctgcggggaagaggggcgtgttccctgagcctcggagccccaaggccgggtccaggcgggacagaggaaggcggcaagcccagcacgctgtccgtgacggcggctctcgttcccaagccccgccggctggcgtggcgacgcgctgtagtccgcgcgcccttgcggggacagcagtcgtgcgcgccttgtgcggccgc

SEQ ID NO: 214317 - DNA, 240 bp, Homo sapiens
agccaagattgtgtcattgtactccagcctgggcaacaggagcaagactccatctcaaaaaaaaaaaaaaaaaaaaggaaaaaaacttagtggcttaaaacaacatttattttgtttgtgaatctgtaatttgtacagggcttggcaggatcagcttgtcctcactcagtatcagttgcggtgagccaagattgagtcattgtactccagcctgggcaacaggagcaagactccatttca

SEQ ID NO: 214318 - DNA, 631 bp, Homo sapiens
agacatggaatcttttcatcacctgaagactccctcattcccctgatagtaactattcttccctagaggtaacctcttttctgatatttgtcaccataaatttttgtttacttattttttgaggtataagatacttgtagtaaagtgcatgaagtgtactttttttttttttttttttttgagatggcgtctcgctctgtcgtccaggctggagtgcagtggtgcgatctcggctcactgcaagctccacttcccaggttcacgtcattctcttgcctcagcctcctgagtagctgggactacaggtgcccgccaacacgcccagctaatgtttttgtatttttagtagagtcagggtttcaccgtgttagccaggatggtctcgatctcctgacctcatgatccacccgccttggcctcccaaagtgctgggattacaggcatgagccaccacaccaggctgaagtgtactattcttaagtatatggcttgatgatttcttttaacctatgaatacacctatataactattctctagaaaaatatatggaatatttaatggcttttataaaaaatagcagctttattgagatataattgacataccatggaatacatttttaaagtatac

SEQ ID NO: 214319 - DNA, 414 bp, Homo sapiens
ccaagttttccttccttttaaaaatgtcttcattctgcttgattgtcttccattcttcccttaaaccgtaatctgttatcatagcagtcaaaccttacggaaaattgcatttgagacacttaggatataaatattaagtataattttgagaaatccttttcattttatattgaagtagtctgtaattaaatgcagtgatatgttttcaggagaaagaatttatgtctaggaaagaaaagttttttttttttttttttttttttttttttaaataaaaggagtaggtttaacattggccaggtgcagtggctcaagcctgtaattccaacactttgggaatcctaggccagaggatcacttgagcccaggagtttgagaccagcctggacaacgaagtgagaccacatccctaca

SEQ ID NO: 214320 - DNA, 225 bp, Homo sapiens
tctctaacatgtactgctcggaggttgggttctgctccggatcagcgatacgctgatccggaagccaagcatttcccaaactcatcagaccctcagatccttttttgtaacacttgctagcattttgggaaatgctgctatgtgtagttgattaatataagtattagaacaaaatattttcatcaggttgctttaattacttgcctgttgcaaatcaaaaggata

SEQ ID NO: 214321 - DNA, 442 bp, Homo sapiens
  misc_feature (285)..(285): n is a, c, g, or t
gctttcttggtttcatggtaagactaaacttttcctgtggaccttgcatttctctatattgtgaatttctctgagtcatgtgtcttactctgtactctgaatattgcttcctagtagcccctgactagcagcagaatgtggacctgatgggctttctgctacctggtgagcatgtgttgcaagttgaccctatgctggcactgggctaataacagccggggtggctgaataccacaattacactctctttgcctgaggcctccataaaacatagtgagactgagnccctgtccccacaaaaaaaaaaaaaaaaaaaaaaatacagctgggtgcagtggctcatgcctgtaatcccagcactttgggaggccgaggtggacggatcacctgaggtcaggagttcgagaccagcctggccaacgtggcgaaacctgtctctatt

SEQ ID NO: 214322 - DNA, 231 bp, Homo sapiens
ctgaacccaccctctgctcttgactgccctttgaagaacctctccattccttcctcctggggcatctcttgggtgggggaggaaatctcagccctgggaggagagtaggggccttttccttgccctcctttgggaactggagaagagcgggagattgtgctggaggcgggagggggcactcgcttggctccatctcaaggaaatgggtctctgactcaaattggattcaga

SEQ ID NO: 214323 - DNA, 399 bp, Homo sapiens
gccgaggtgcgaggatcacctgagcctggaaggttgagactgcagtgagctatcattgtgccaactccagcctggtaacagagtgccttttttcaaaaaaaaaaaaaaaaaaggatttgggaggatatgcatatgttatattcaaatacatgccattttattcatatatcagggacttgagcatcctttgatcttggtctctgccgggtatcctgggaccagccccctgtcgatacagagggaccgctgtctaagaaccgctggtcctatctttgacttctggcggaataggagctccatgtaaaaaggaggagaagctgcagcgggttattagccatttgtgagtcaggtcactgtaaaactttatcaaaagtttaaaagacaaaaagcatcctcata

SEQ ID NO: 214324 - DNA, 263 bp, Homo sapiens
aggaacctgctgcccagctttcctccacaggcttgatgtgtttgagccagaagtatggggcgtttgcggggtcctccacaagtacaaacagggttctgtcccttttcaggggtcccagaggaaaagcactcctatagactctgagcaggggcagctgccacattccgtttgcttcctgagcttgtctaggtgaacagatttcaggtggaaggtaagaaacgggatgaaatgacttgagcgggacagcttgcttccaggcttcc

SEQ ID NO: 214325 - DNA, 537 bp, Homo sapiens
gcgcctggggccggccgcgctctcgggctcgcaggcgctgggtctcggctccggctccggctccgcgccgctggctctgcgtcgctcgcactccagccgggggcaccctcatcccaggctgactgacgtccctggcacccaaatgtcgcggggagtgcggggccagggtgcgccctccctcctcctccagccagtgaaacccgggacagcggcacccagccccagggcggaggccgtctctgctgcgcgcagcgacgcacccaggcccaagggccgggagatccgcggggaacccggagacctgcgtcccagaggggccgagggttgcaccgcgcccgctcccacgggcctcttccgagaggacgcttctccctcgtgtccgcgggaagtcctcggatcctggatgagaaagagccttctctcaccggctcccagaccccgcgctttttaatacctgtccttgcagagcgactggtcattttaggcccgagtcgagcctctcttgattaataaatgaatatggctcgttttgtttta

SEQ ID NO: 214326 - DNA, 481 bp, Homo sapiens
cggtagatattaccacttaaactggaaacctagtgagcctcagttaaaaatccattgttaccctttaccctttctcagaaactgctaagagattttgatctctatattttcttttttctcaatgcttttatggtgctttagctcatttctactagaccatataaacactataattatattaaaaaaatttagacatataaaggtttaaattatagacctgattccacttcttatctagctgttgctttgaacatgtcattttatctctctggacctcagtcttctcatctataaattaggtgactgaactggctgatcctgaatctccttccagctctgactttctttgtctgcagtatggaagttatcacttaatactaacacattaccagatttgacagaattcagcatccatttatgataagaactcttgcaaactagatatagaaggtaactttcttaacctggtaaagagcatgta

SEQ ID NO: 214327 - DNA, 209 bp, Homo sapiens
acatacctagaagaattgctggatctaaagattaccattctacaattctgattagtaccacactaaattacccatcagaaacactgtatcaaactacactctcacagtgtatgagtggtgctatagtttgtttgaatgatggtgccccctccaaaattcatgttgaaacttaaaccccaatgcaacagtcttaagaggtggcctttggg

SEQ ID NO: 214328 - DNA, 327 bp, Homo sapiens
gtggatgggtaggtggatggttacctgggcaggtgaatgagtaaatgggtaggtggatgagtggatgggttggtgggtaggtggatcagtaggtagatgggtagataggtgggtgaatcggtaagtggatgggtagatgggctggccagcgagctggctataccttggagcagtcatccttaaagactatcaagtaggcgtatccatgaattaatgacgaggaaccaagaagatagtaaatgacaaagctaaatgcagtagcaaagctgatacaaggtgacatggagctcaaagaaggagcagatttttaataatatgtctaaagca

SEQ ID NO: 214329 - DNA, 601 bp, Homo sapiens
cgggctccccgagcgggcttcccctctgcccggcgcgatggagcgggtcggtgagcggaacaaaggcgcctgcccgggggagcgggtcttccgctgaagagcgcgggtggcgcgccgcgacggccgcctgcgggccaaggtgggaggctgtgcggccccaggcgcggcgcgctccgccgtgggcgggcggcgatccctgagtccggcacctgtgcgccgctccctctgtgcctcccgggcagccccgcctgccggcctcggagtccgcggcgccggcggctagaggtccagaggcgaaccacttgctggtgcagaagagaaaccctcaaatccctggcctttcgcggagacgcctggacggggccgtgcgccgtggactgagcaggcgtctcggggagcacttctgcagagcgaggacttccatgtgagcgattccgttctccccaccaccaatccgacctcccagccgtctccgccgcccgagcatccttgaggtgggacgagcaggggcttggatccctgccggccgtctggtgtgtgaggcttgcacggcccctggctgccccgcgcctcgccggagcccgagggggcgcaggtccgg

SEQ ID NO: 214330 - DNA, 96 bp, Homo sapiens
tcatgtatcatgtttgaaaatgaagaatctttacccagtctctaaactgggttcctttgacacagttatggaataaaatctttgatgtttccttct

SEQ ID NO: 214331 - DNA, 134 bp, Homo sapiens
gtacactgtgcttatagttgacaatattgtcatacacatttaaaaatttattaaaacggtagaccttatgttatttgttcgtaccaaaataaaaaacaaacaaaccaatttccagatgtttgagcctgaaaaat

SEQ ID NO: 214332 - DNA, 393 bp, Homo sapiens
catcagtggcctggtgcacagtgttaacatgaattattcttttgtatcccagatcaggccttgctctccagtgttgattttgtccatattgaagtcatatttatggctgggtgcagtggctcatgcttgtaatcccagcactttgggaggctgaggtggacggatcacttgaggtcaggagttcgagaccaccctagccaacatggtgaatcccagtctgtcttaaaaatacaaaaatttagccaggtgtagtgatgcgtgcctgtagtctcagctattcaggaggctgagacaggagcaccacctgaacctgggaggtggaggccgcagttagagctgagatcgcaccattgcacttcaacctgggtgacagagcaagacttcatcacaaaa

SEQ ID NO: 214333 - DNA, 512 bp, Homo sapiens
caggtggtatgaggttcaggaggcagcccagcgaatattgctaaggcttaggctctgttctagtagttgcaaacccactgctggtgccaagtcaggcagagaaggaacgctgctgccacacagtgtctgcccctggcatccaggtgtcacatacacacggttatttccaaatgttgtttaatgtgtgcccctagcatcctagcagtttggcagaagaacatacacatttattgaatttcctctggcctagctgcttagtagattccaaatgaataatagaagaaatgttgtggtaaatgtaacgcatgaaatgtgggtgttagaggggtcttagatattatttagcctatcctctgaattgtacagataagagacagatccagaaaggtgaggtgatctgctatagaccatgagttagctgccaagatggaatggaagctttaattgtctgatgcctattttgttgctttttctacttgatagaacttatggatcaaatagtattccataag

SEQ ID NO: 214334 - DNA, 278 bp, Homo sapiens
cttagcacagtcccttgcacattataaagcctcaataaatgctatttggtttttatttaaaagatttaatgaattgttaatttttaaaaaatagcaaacatgggggtaacaaaattttaaaagctcaaatatctgcaagtggcacgaaaataataattcagttactcttcacaaagatatttattgttaaaagcttcttatgtttttcaggggggaacattattcatatgtcagtgtatcaatctaccttctatatatatttttaaaaattactgtac

SEQ ID NO: 214335 - DNA, 378 bp, Homo sapiens
aggtaagccaccacgcccggcctctttgctattatcatgctgcgttgggaggttttcttaaaaggcacacaacaattttgacagtaatttctatagtttcattttttatttttattttttattgtttgagatgtttgaaaaaccaagagaaaaccaatgtaagaagactaggcttttaacttttttttgtttttgttgtttttttttttttttttggggggggggtctcccttttttccccaagctggggtgcaggggcacaatttgggttaattgaaacttcccggtccgggtttaaaggggttttccttgcctaagcctccaaaggggggggatttacatgtccccaccaaaacccccagctaatttttgtatttt

SEQ ID NO: 214336 - DNA, 244 bp, Homo sapiens
taaacagctaccaaatccatgaatagtccaaacaatactgaacagttctgtttctgcaggtggtctggggtcttaaccatcttcttcatcatctgtttctctcttcctgttttcaccttttccgctttcttcctcctcttcatcctcatcttcatcctcatccatcttcatctttatcaagtccaaattcttcttcctcctcactgacttcatctttgtcatcatccccttctgtcgtcttctc

SEQ ID NO: 214337 - DNA, 453 bp, Homo sapiens
attaactgaaaaccatctatcagcagcttatagtttgggcagataatttgatatctattttttcttggaattttatgtaaaagtccatactgcttaatcagattaaccatacaaatgcctagcacagaacagatgatcaatcaatgccaaatgaattaaattttaaaatttgaatctcatatgtgtaaagatgtttattgaagtattgcttgtaatagtagaaatcttgaaaaacccatgtctattagtagtggactggtatagtaaattacagtgtgcccttataatggatggtaagtctattgctcctatgaaagctaatatgtgttactaagtgaaaagaagcaagatgtggaacagcctacatggtatgattatctttttgttattttaaaagtacaagtacgtggttattgtatgctggtgtagacatgataaacgtacttgtttttt

SEQ ID NO: 214338 - DNA, 252 bp, Homo sapiens
gctcggcactcgcctgatttgtgggaggattgcttaagccagggaggtcgaggctgcagtgagccacgactgtaccactggagtccagcttgggcgacagggcaatactgtctcttaaaaaaaaaaaaaaaaaaaaaaaaaaagggggctttttttttttaaaaaaaaaaagaaattttttttgggtttccacccttttggaaaaatttaaggattggccaggggttaatcccttaaatccaaaaaaaaaag

SEQ ID NO: 214339 - DNA, 560 bp, Homo sapiens
ggtaacattgtttatgttcatcgcacaatcatctggaaatataagaggtggagctctgttttggtctggagacctaactcgagcattatgattatacatgagtcagctacattcaaaggccagcattctagtccttagtttaatccttgaaaatcaagtgcttcttttctaacttctactgaaaggaaacttcacctgtcattgtatacattgaagtgttctgaatcttatttgtaatcaatagtcctttgttattttgtgggcctttttttaagtgtttgttttgttaactatgcttaaaagttattaaaacttgatcttgttttgggagttttaccctttaagttcctcctctagcatggtaattctcatgctagataagaaatgtacactgtcagttccctggtaacagctgggatgtcccaatcagaatggtgactttagtttggcatctgatggaatgggtggccatggtgagggagaaccagggaactctggtaaactgaatggaagtagtgaaagaagtagattttttttcccttacgttctcagaactagtt

SEQ ID NO: 214340 - DNA, 483 bp, Homo sapiens
ccaatcaacatccaaccccattaacatccaaccatttttttgttttttagagtaatgaatctaaaaaacaaaaaaatggttaaaatgttatatggctagtgactggtaaaggtgggatttgaatgtgatactgaatttagagcccatactgttattttgcttcaaattaagaaatatgtagtttttggttaccaaatgctgttttttaaataaatcattgtttagttcctattgaagttttcacagatgtaaagtaaaatggagaaaataagcaggatgtagtgaatttctaatgaagctattttttcccacttttttctattttgacaaatactcttcctacttttacaaaatgaatttttaaaactatctgtacttaacagaatatcaactggaaacttcatttgggaccctggataaaagcctcagaagtctgggaactgttgagctaaatgacttgcccagatcacacagttaatatgt

SEQ ID NO: 214341 - DNA, 710 bp, Homo sapiens
gggcagggagctcggagcagagaggccctcagtaaatacaacagtgcctgacgttaccagaagcaatcattgtgcctaagttggaataaactgttcacagtagaagccaatccacccaccccaaaggaattccatctctgctgtttgatctggttttttgttttgttttgtttttgttgttgttattgttgttgttgtttttgagacagtctcgctctgtcgcccaggctggagtgtggtggcgcgatctcggctcactgcaacctccgcctcccgggttcacaccattctcctgcctcagcctcccgagtagctgggactacaggtgcccacgcccggctaatttttttgtatttttttagtagagatggggtttcaccgtgttagccaggatggtctcgatctcctgaccttgtgatctgcccgccttggcctctcaaagtgctgggatttcaggcgtgagccaccacgcccggtcgtctttgatctgttttctcttgctccattgaatagaggctggaccacgcagacggaaagcaatcagagagactcttcattgggtagacaaccacccccgtcaaaagcagaatcttttgcagaggggttggtcttgtctccatcatgtctccctcttcaaagaaacgatggggaaagatcatgaagtaggatcctacaaattttctataaagtacttgtttgaaaatctgaaa

SEQ ID NO: 214342 - DNA, 321 bp, Homo sapiens
aaagttaccttcataaattccattgctatgtgggtaagaagcatcttctgaaaaatgccaaagtacataaagttattattatatattattattacttttcagacagggtcttgctctgttgcccaggctgcagtgcagtgcatgaacacaatttattgcagccttgaccttctgggtgtgagtgatcctcccacctcagcctcccatgtagctggaactacaggcacatgacaccatacctgggtaattttttgattttttttttcttttttttgtagagatggggtcacaccatgttggctaggctggtctcaaactcct

SEQ ID NO: 214343 - DNA, 294 bp, Homo sapiens
gaaaaataatagtactattgatgagacagagtaccatccattcttacattgcagtcacattggatctacactgaattaacaagctgcagccccagccaccgctagagcggtgagggcacaccggatcccagatctgcaggcggctgagcaggtggagcccaacgaagagatgtttcctgctgcaggcaattatgcaaaatgacaagtgattgcttttccttttaaagacaacccctttggaaaaagcttttttcttgaggaccctatggaaatggggggttggtgggaacttca

SEQ ID NO: 214344 - DNA, 238 bp, Homo sapiens
ggggtttctgcaggaagaagggtgtcccctttgactggaaactgatcttactgtatttgagaactgctaggcattcaccgtcatccttatggctgttaaaatcacttgctctgcatgctctgcaaactttatcttgcccatattcagctgctggtttgtggaatgccaaagtcagtagtccaagttgagttagtttctacttagatgagttcaggtaaaacaaagattgggggaagtt

SEQ ID NO: 214345 - DNA, 779 bp, Homo sapiens
cacagtggctcacacctgtaatcccagcactttgggaggccgaggcaggcacatcacttgaggcatggagtttaagaccagcagggccaacatggcaaaaccccatttctaataaaaatacaaaaaattagccaggcatggtgatgcaggcccaaagccccagctacttgggaggctgaggcatcagaatcccttgaacctgggaagcggaggttgcagtgagctgagatcacgccactgcatgccagcctgggcaacagacaagaccctgtatctaccactgctccccgccaaaaaagaaaaagccaggtatagtggcacacgcctgcaatctcagctactctggaggctgagacgggaggattgcttgagccaaggagtttgaagctgtaatgagctatgatcgcaccactgcactacagcctgggtgacagagcgagacctgtctcaaccaaaaactgaaaactaaagtcagagatggaggatgtcaggtttcaagcaccaacttgttgcacccttgctgcttgaaaacagaggtaaagactgagtgtagcttctagcacctgagaacagaccctgattggcagccagccagaaaacagaaaccttagtcctacaaccacaggaactgaaacctgtcgataagaataagctttgaagtggattttccacagagcctctgatagaacttagcctggcaaactacattttagccaatatgataatcttagaagagaatcctgccacattgtgctggatttctgatttacaaaactgaa

SEQ ID NO: 214346 - DNA, 599 bp, Homo sapiens
agttcagttctgggttctgacgctcttaaaggaccccggagcgggagttagttaggaggggtttccttttcagtgtgctcgtcatggttgagctcaggctctgaagccacacaaccccagacttgaatttcctcctttctggtgactgtgggcagaaggcttgaccgttttctgtgcctcagtatccacatctgctaaatggaaacaatcatcgctgtgtcgctggcttttgaaccattttaatgtaaacaaaacggtttttaccaattagttcattactgcaagatattaatgccacctgctctcatcgtacatattccagtgaatctgggatataacattttataatgcaacttgggcccataaaggccttaaaatcaccctgcggccgggcgcggtggctcactcctgtaatcctagcacttggggaggccaaggcagacggatcatgaggtcaggagttcgagacagcctggccaacatagtgaaaccccgtctctactcaaaatacaaaaggcaggagaatcgcgtgaacccgggaggcagaggcttcagtgagccgagatcatgccattgcactccggcccgggcgacagtgc

SEQ ID NO: 214347 - DNA, 687 bp, Homo sapiens
agtcactaagtccagccccactcaaaggggtataagaatgtgtgaacatacgttaaaacctccatgctaattagtaagtatttgagggggaggtgatactttgaggttacggatctgctgcaactcggctcttgcctcatcagaggaaagaattcatccaagaagagtaagacagaaagtgagactgaggcaagttttagcgaaggagtgaaaatttattaaaaggttttacagcaggaaaaacaggaagtaaagtacactcttggaagagggccaaccaggcaatttgagagattgaggtgctcagtgcgacctttgacttggggtttaatgtgctgggatgctctggagtttcacatctcttctcccctgattctttcttgttgagatggagtttcattcttgtcacccaggctggagagcaatggcagtcttggctcactgcagcctctgcctcccgggttcaagcaattctcctgcctcaacctcccgagtagctggtattacaggcacctgccaccacgcccagctagtttttttgtatatttagtagagacggggtttcgccatgttggccaggctggtctcaaactcctgacctcaggtgatccacctgcctcggcctcccaaagtgctgggattacaggcgtgagccaccacgcctggccttccctgattctttcactg

SEQ ID NO: 214348 - DNA, 319 bp, Homo sapiens
gtgctgggacaggggcttccagtggggccccatgaacatttattctgttgctagtgaggtgtttgtctcactggcttttgcaacatataaccagtgcttcccgcctgatgtcctcacttgctgagaatgaggctaactactccaaacagcaaactgaataccatccagcaatcacgttcctttgtatttgcccaaaggaactgaaaacttgggtccacacaaaaacctgcacaagagatatacgcagccttattcaccagtgcccaaactcagacacaaccaaggcgtccttcagcgggcaaacggataaaccatgtca

SEQ ID NO: 214349 - DNA, 536 bp, Homo sapiens
accaacctggccaacatggtgaaacctgtctgtacaaaaattagctgggtgtggtggtgcacgcctgtaatcccagctacttggcagactgagacaggaggcagagtttgcagtgagtcgtgatgatgccactgcactccagcctgggagacagagcaagactctgtctcaaaaaaataaaataaaatggttcctgagtatttttagattcgtagagtactaagcagaatgtacagtaaaacatgcctaatttcctattttctgggcttgctgtggaccacattttaagtcactgtgaaatacagatttgggatgttgaagacagactctaaaatttgcttttatcttcacagtaggtggggttcattcactgtgtgagtaaatcacataactgctttctatgggttatgtcatcgttattcttatccagagataatttggaaaaatgtcctaccagtctcagatgcttctgtgggtctctttttatattatgtggcaatcaaaactgccatcaactgactgattatcttaccaca

SEQ ID NO: 214350 - DNA, 626 bp, Homo sapiens
ggggagtaatcacagatcctcctctgcttataatcctctaattctctagcggttttctgttggagttaaataaactccaaactcctcatctttgcctccaaggctccgctgatctgggcctcaccattctttcatgccccctcccctatcatactctcttgggtccccactctggccatcctggactttttgtatccctcagacatcccaagctgttgcctgccccaggctccttgaatgtctgtttcttcttctctctggaaaactcctgtccagctgctatacgggcttctgccatcttttctctccaatgcatgccagaggcgtggttatgattagcaaaatggatgttgcaagtaactttttcattggattggctagaagtgtcatagagagaccccatcccgctttctttggcatgaacagagtataaaaatctcgcaggggccgggcgtggtggctcatgcctgtaatcccagcactttgggaggctgaggtgggcggatcacgaggtcaggagatcgagaccatcctggctaacacagtgaaaccccatctctactaaaactacaaaaaattagccaagcatggtggcgggcgcctgtagtcccagctactcgggaggc

SEQ ID NO: 214351 - DNA, 309 bp, Homo sapiens
gctaatttatgtatttttagtggtgatgggattttgccatgttggctgggctggtctcgaatccctgacctcaggtgatccacccgcctcggcctcccaaagtgctgggattacaggcatgagccaccacgcccagccaaaaagaatgtcagtttctttccaaacttttgttcttgtacaaatattcttaaatagtactctttttactcaaatagcaagcaccatcagctcaaaggttcatcctagaagtggaaaaatgttgggtcccagatatctgttatgcagttttcccaaagggactttccttaa

SEQ ID NO: 214352 - DNA, 542 bp, Homo sapiens
ggaggaagaaagaaaattagaaatatggtggttcaggctgggggaaatgcctgaaaggaaatgaaaaacttaaattttttatattgaccttctgctaacagtttgtcacacaagcatagaacggatcatgtgccttctctgcagcttctcgtacaactgccaaccatgaaaggggggctgggccaggccccataagaggcactaacaatcatttttaaaggcaaggcccctaaaaacaagtggcccattccttttcaaggctcaaatcttatgtaccggcaaatctgaatttgaaaaggaagatttatgtggatttctgaaatcatgattttccattacccttttccccaggggctataaagaaaaaaaaatttcaagagtcgacatgaattccttcagcatcaagtaacattatgatgatgagtcgagtgttaacaaatcagaaacacatggtcttaattgactgtgaaataaataatgtttcgaaatgaaagggagaaaacacgttcagatgtaaagcattaaaaaggcttcaaaacctc

SEQ ID NO: 214353 - DNA, 756 bp, Homo sapiens
tacaagacattcaggtggcattgagtcacgtcttatcagtgctggtgatttcagaggaagagaacactgccttccaagtctcccaacccttttgtgaacacctggtgtagaagagtaatgtttatgctggctttcttgagtggcttcatgaggattttattatttttactactttttttgctgacttaattggcattttctatgttttatagggataaaaacatctttcatataattctggcctgttttaggggtatcagatatatatatctaaatatgcacgttgttgtttgacaaagaacatttcacacctaattgagcttttcagccgggatactccacctagagtactttgcacatacatgagatctaaggttcataaaccactttggcagtgcctgccacattcacaagtgtccactgaatgtcaatttcttgccttttctttgccctcctccttttgtgaaatgatatttggcttccagggcctgtcagggctgccggtgcaccacacttccctgagattcagcattcctttcctatgagcaaggaactggaacaggcggctgactcttgtctaaatcagatccccaggactcctagcctgtgacttcattgctgaaccccaatgctgcagtactctttggatgcagagaatgttggtgtaaatgccactgaggttcttctgcatccattttatttcatgttcctcagttttatattttttatattttatcagttttaccctgcacagaa

SEQ ID NO: 214354 - DNA, 396 bp, Homo sapiens
cctgcctctgtgaggctcaggaccaggctgtcttgctggcgtttgatttctcacacattggaagttcttcagttatcagcagaggcaagaggcatatttttatgctggggtctttgagtgtcacagcaaattaaatggtggtccttctggtaaaggaagaggctaagtgggaaaatatatgaaaattaaagcaatccactagatgtttttttctttttttttttgcagtaggaacagcatgccgaagtgaacactactgacttcctttaaaatttttcacaatgccttctgttttatctagaaattgagctttaagggaaaatagagtgacagagacaaaaggaaaagtgtaatccctttggcttcttccagtaagctttagaactcagcacccaa

SEQ ID NO: 214355 - DNA, 705 bp, Homo sapiens
aacccagttggtagccatgagacacttgtgaatttgtctttgtccctcctctttcccttgggatagtaaactgtaggtgcattcatgggaaggaatgtacaaagatggcattcctttgtgcaagaagtcctatctccctgccgtctctgtactttgtgtctttagcattgtgcttgtctctctatattgtgatgatctgctgacttctagcctcttcaactagactctaagctccttgagagacatgtggtaatggtctactctgagtccttacccctccgcttgacacagagagggtcttatataaactcttgtaaaacaaatgaatataatcctgtattatctaatttgccttagcttctaagacgtggaatagttggatagttgcatggaataaatatttgcataactaattaagagtgaaggaattaattcacttccaacattttttttcctttcaaagatttattatcagtaggtctcatgtctgttttctaggctactatgctttctctatttacggcagctttaatttggttaaactttatttagattctgttgcgaggtgggcactgtaataaatactgtggagattccaaggaggaaaaagacctgatccctattgtagcactaagaaaggaccttgaatgccaacctatatggaatccggtcctaagaattgctacaaaacgttgtacagggtag

SEQ ID NO: 214356 - DNA, 423 bp, Homo sapiens
tacagtcagaagtcatattgcccttgatcagcccaccattatgcctgttagcccattgtgccttgatttataattctttgtgtccagcctaactttcttcttagtctacaagattctgaattgtctctgccttctccagcacagcctagtatgggacttggaatatagtatgtactcaggaagtgtttattgaatgaatgaatggatgaattaataaaccaacgagctgtctgctatgattggtcgttactaatcacgcagcactccacccttctaggtcattgtcaaggttattgacatgattcacacactcacatacatatctttgattagcataaagtcacatttgaattcaagatattatcataattattatttcttcccaaatgcattagcttctactagtctgctgccttttttttt

SEQ ID NO: 214357 - DNA, 301 bp, Homo sapiens
tctctcaacagtttctggcttacctcagatataacctatgtaaagcatttagcattaaatgtagtataacagattttcattgctgccatcattgatgacatcaacatcatcaacatcatcatcatttctaaacaaataacaaaagtctcagaaacaaatatgaatcaagttagggttctgatgtgttctccttattctatttcttttctgagtgccatttttgtttgtttgttttctatcctaattttctaaatttttcatttgtccccatattaaaaaactgtaaacactctgatggggt

SEQ ID NO: 214358 - DNA, 270 bp, Homo sapiens
ctcccaacctcaggttatccgccagcctcagcctcccaaagtattgggattataggcatgagccaccgtgcccagcctgcatttcatttaactttgctacactgtatatgttgtgtaggtactggacaaatgggtcctaattttataatatctagtatctagatattaaagagtttgtcaatataagacaaaactagagttagtaaactaatatattttgtacactttgtgttaaaattaattaaaaggctatcttccgaaaaggacttt

SEQ ID NO: 214359 - DNA, 465 bp, Homo sapiens
tcaagggtagtacatgactagtaggaaaggataatttactgcatagaatggatgtcttagagcattagggcttaattttttgttttgttttgttttgtttttttgagatggagtctcactctgttgcccaggctggagtgtagtggcacgatctcggctcactgcagccactgcctcctgggttcaagcgattcttctgcctgagcctcccgagtagctgggattacaggcatctgccatcatggctggctaatttttgtatttttatagagatggggtttcaccatattggccaggttggtcttgagctcctgagctcaggtgatccgcccgccttgacctcccaaagtgctgggattacgggcatgagccaccacacctagccagggcttaattttttttttttttttgggaaatggagtctcgctctttgacccaggccagactgcagtggtgctgtctcgg

SEQ ID NO: 214360 - DNA, 405 bp, Homo sapiens
tttgcaggtggaatagaaaaatgctgaattttttctcttctttatcccttctaccccgtgctattaaaatctgtatccagacaattgtactgatttcattgaaacccttcaaaataactctttatagctcacgatttcatgcatttagggcatgtaaaacctcagaggaaacctgtgattaagagccatctcattgcagcggcttctattgtgttctcaaagtgttatttctttcttcaattagagatgagaaagttcattcctgacttacgcacccctgcattgtgtcaactgtcatattgtgttttgtttcctgggccagaaaggcagacatcaccccttgcacagctttgctgtgctgcatctcctgtttccatccctccctcttcagtgtccttcagcaga

SEQ ID NO: 214361 - DNA, 342 bp, Homo sapiens
tgaggttgtaattctcatgtttaatagttgcgcatgtgccaaaaaaaactcctgacattttccatttggctacctttaacagttctttgttgagttgggagggtttcataattaaagtggtgatttttttctattttgaaactcatccttttggcttgctttctctcccctcttcaaaaaaggagcggggagggaatcactactggcataaagcctcaaactgaagtttataaagatcatagctttatgctgccaataatttgtcagtttgggccacctcccaaaggccagatctgacacctgtcctcagggtccacccagttttccaggccgaggccggca

SEQ ID NO: 214362 - DNA, 625 bp, Homo sapiens
aagcaccttgaagggattccaaggaggattacttacaaaacaaaacaaaccaaacctcactgctataaagaattataccccttttcatacacagtaagagttacgtggttgtactgtagttattttagcacagtgcatgacgtagtactgacttaaagtcaaaggaaacaagataaaaatgtaatctgagttttctaacttaaaaagaaaatggtgagggcaattttccctttatagatcttttctagctattaaatgaaaaaataaaatattgttattttataaccctgaagaaatactgtattaagataatgataattggccaggtgcagtggctcacgcctgtaatcccagcactttgggaggccgaggcgggtggatcacctgacgtcaggaatttgagaccagcctggccaacacggcgaaaccctatctctactaaaactacaaaaaattagcggggtgtggtgggcctgtcgtcctagctacttgagaggctgaggctgaagaattgcttgaacctgggaggcagaggttgcagtgagctgagatcgagccattgcacttcagcctgggcaacagagcaagactctatctccaaaaaaaaaaaaaaaaaaaaaaaaaa

SEQ ID NO: 214363 - DNA, 583 bp, Homo sapiens
agaaagagccttactgcagatctcattctttccttcaaagccagtttgcccattcctcttcagaaacctttaagagtggttattgggagagatgataagactccatctgcttaaggagtccctctaacccagaatagtagatgtaaacacctgacatgttgttatagagtgaatgtttgtgttcccctccaatccgtatgttgaaattccaagccccaatgtgttcgcattgggaggtgaggcctttgggaggtaaatagatcatgaaggtgaagtcttcatgaatggattagtgtccttataaaagagaccccagagagctctctcatcctgtttctgccatgtgaggacacagcaagaagttggtcatctgcaacctgaagtggctcctccccagaaactgaatctgctggggtcttaatggtgggcttcccagcctccagaattatgagtgtaaatgtttgttgtttaagctacccagtctagggtagtttgctatactaccccaaactgactaagatacatatgtttgtcatccactcagttgttttcctaaaataaatgaagtcagctccaaaaagaa

SEQ ID NO: 214364 - DNA, 368 bp, Homo sapiens
ttgattcaaagccccgaaatagactgtgctcaaagaggcctacaaggagacagattctaattaaattgtcaaagatcaaaaccaaagtgcattttgaaagccaaaaagaaaagcaacttgtcacaaggaagccattatggactataagcagatttttttttagcagaaaccttgcaggcaaggagagagtaggatgatgtattcaaagtactgggagaaatcttccaaccaagaatactttacctgtaacataccctttaagaatgaaagaaaaataaagactttctcagacaaaaaaaaaaaaaaactgagaaagtcatcaccaccagaaccatgttacaaaaagtgctaaagggagccttcaaata

SEQ ID NO: 214365 - DNA, 908 bp, Homo sapiens
aggcaggcttggtagtctccctgagttgagaagatatagctgggggcccaggaaatccaaagtggctacacttcatggaaaacgagtaccaataattagagagatgccagagaacctcagagatctgcaaggtgccccctctaatattcagttgaatatttgtgcatgagtttaggaaagtcattaaaagcagtgaaatggtggagcagggaggctatctaaaaggcttagtgagaataacctcgtggtgacaaaatctctcagcatttgcttgtttataaaggattttatttctccttcacttatgaagcttagtttggctggatatgaaattctgggttgaaaattcttttctttaagaatgttgaatattggcccccactctcttctggcttgtagagtttctgctgaaagatctgctgttagtctgatgggcttccctttgtgggtaacccgacctttctttctggctgtccttaacattttttccttcatttcaaccttggtgaatctaacaattatgtgtcttggggttgctcttctcgaggagtatctttgtggcattctctgtatttcctgaatttgaatgttggcctgccctggtaggttggggaagttctcctggataatatcctgaagaatgttttccaacttggttccattctccccatcactttcaggtacaccaatcaaacgtagatttggtcttttcacatatttcttggaggctttgtttgtttctttttactctcttttctctaaacattttttctcactttatttcattaatttgatcttcaatcactgataccctttcttccacttcatcgaattggctattgaagcttgtgcatgtgtcacggagttcttgtgccatggttttcagttccatcaggtaatttaaggct

SEQ ID NO: 214366 - DNA, 334 bp, Homo sapiens
tctgtattcttagtagagacagggtttcaccatgttagccaggatggtctcgatctcctgacctcatgatccgcccgcctcagcctcccaaagtgctgggattacaggcgtgaggcaccgcacccggcccacagccctttcattttcaaagcccatgctggaggaaacccctcatgctgagtccctctcacactgtgagtctctatgctcaggaagaacccagtcctttcaaggtctcacctgattaggacagtccaagcaggataaacccagcctaaagtcaactaattgagacccttaattatatccactaactcccttctgtcgtcttctc

SEQ ID NO: 214367 - DNA, 465 bp, Homo sapiens
gtagggatggggtttcattatgttggccaggctggtcttaaattcctgacctcaagtgatccacccaccttggcctcccaaagtgctgggattacaggtgtaagccattgtgcccggccagcattaatttcatattaagttggagtgggtggtgagaggaaatctgcatttattgatcccctatttcagtctaagggttcaccttatgtaatcttcctggaggggtaggtggaagtgaccaggaagaatatgggtgagaagctgttgaattaaaaattcattttgtgcttcataggctagacttgcatctggaaaaacaaaatgatttaattatggaattatagaataattgttaaattgattataattactttaaaaattcttgttattcattctactagctaatatgtaaccatcaaatgaaatcttttacattaaagtagatagaaaaatattttataagta

SEQ ID NO: 214368 - DNA, 1224 bp, Homo sapiens
catggtaagacatttggattttattctgaggttagtgggaagccattagagagttttaaacaggacataatatagtacctggggtagccagcctccaaaacatcctccagtgatcctgggatccttgtattacactctgtgtgtagcccctctcacattgactagggctgacccaataggatgctgcaatgtgacggtatataactttcaaggataggtcataaaagacattgtgactctgccttggtctctcaaatgtctccctctggggaagccagccaccatgttgtgaagatactcaagcagccctatggagaggcccacacactggggaggcactgcggctttctgccgacagccttgtgaatgagacaccttgaaagaggatcctccagccccagccaagctttcaaatggttccaactctgacatgctgacaacttcatgagaggccctgagccagaaccacccaaactcctgacccattagtgtgttatgtaacaaatgtttgttgtttcatgccactaagttttggggcaatttgctacctctagccattgttcccagctggtgtgtagtctgactggcaggtgcccatgctttattagtggtttgatattttgactatcggccctgagtaggaggaatgacacagagaggagatagagttgtgagtgagaggaggccaaatcgtggtgtcagagcgagaagcagcaccctggggagggctgagtcacttgtgctgtctggaggaaggcggagcaaagatctgcagcccagctgactgtggtctcagcttttctagcctccaggctttctcccgggttcctaagtctgtatgtgctcactggaaatgccccatgacttggggtgacatgggtctgaaaggagcatgcaagcagcccccccacattgcagttttgctttctgtggtttcagttacctgcggtcaaccaccatctaaaaatagaaaaaattcaaacttagatgatttccgaagatcttaataatcaggacaaccgtgaacttctcatgcaaccgtcaatgcctgagacaatggagtgaaagctaccagatccttaagagaaaagtgtcccccaggactcttaaagccaccagccctgatgttggccacgggaaaagacaatcaaggaaaatctccgaccttcggtgaaatgcagagactaagggacccctgtgctgcgtgtgatgcgattttgagag

SEQ ID NO: 214369 - DNA, 1133 bp, Homo sapiens
catggtaagacatttggattttattctgaggttagtgggaagccattagagagttttaaacaggacataatatagtacctggggtagccagcctccaaaacatcctccagtgatcctgggatccttgtattacactctgtgtgtagcccctctcacattgactagggctgacccaataggatgctgcaatgtgacggtatataactttcaaggataggtcataaaagacattgtgactctgccttggtctctcaaatgtctccctctggggaagccagccaccatgttgtgaagatactcaagcagccctatggagaggcccacacactggggaggcactgcggctttctgccgacagccttgtgaatgagacaccttgaaagaggatcctccagccccagccaagctttcaaatggttccaactctgacatgctgacaacttcatgagaggccctgagccagaaccacccaaactcctgacccattagtgtgttatgtaacaaatgtttgttgtttcatgccactaagttttggggcaatttgctacctctagccattgttcccagctggtgtgtagtctgactggcaggtgcccatgctttattagtggtttgatattttgactatcggccctgagtaggaggaatgacacagagaggagatagagttgtgagtgagaggaggccaaatcgtggtgtcagagcgagaagcagcaccctggggagggctgagtcacttgtgctgtctggaggaaggcggagcaaagatctgcagcccagctgactgtggtctcagcttttctagcctccaggctttctcccgggttcctaagtctgtatgtgctcactggaaatgccccatgacttggggtgacatggaaaaaattcaaacttagatgatttccgaagatcttaataatcaggacaaccgtgaacttctcatgcaaccgtcaatgcctgagacaatggagtgaaagctaccagatccttaagagaaaagtgtcccccaggactcttaaagccaccagccctgatgttggccacgggaaaagacaatcaaggaaaatctccgaccttcggtgaaatgcagagactaagggacccctgtgctgcgtgtgatgcgattttgagag

SEQ ID NO: 214370 - DNA, 289 bp, Homo sapiens
agaagggtagataggagcctgcagtcgcctctaaaatcctacctaaccatcccatggtcactcgggcccatgccttcctctccttcgctgtttgatttctattctgttgggcccgccttcctctgagctgcattagtgttagtgctcagaaatcaccataatcacgaaaataataataataaatctttaacatactacctaaagggaacctgcaataatcttgaaaaagaaaaagagaaaaattttaaaatcctgctataggagaaaaaaagagaaaaaaataaaaatc

SEQ ID NO: 214371 - DNA, 716 bp, Homo sapiens
tccctagtgataattttgtatatatttttgtatttttaaggttttaatcataaagaaaaagttgtaatggatttcagcttacctgtacatagaaagttagcactgaatgttggcaaataataggtgttgagaaaaggggatctacactttaaaatgataccagctgtagtggtgattaagccattatgaagtgtcagaactggaagtcacttctgagccttagctgatctttctttaaaatgcatactgataaaaacttttacttttattaacatattaataatataaaagcattgtcttgctattctttttaaatgtcatgaatttcatatatgtaatactgaattgtattacttacataatactcattaaatgttttctataaatttatggtgccatttttaaaatagcatctaaaataaaagaatgggtcttttcatttacacaattatttctccatcatttttctttccaatagctttagatagcatatacatagtagttatggacacttgcttattagaactatgaaatgaagtaagtgaaagtgtttagttataggtaacattaaatggcaaaaagaggaaacaggtataaattgaaagcactggatctaaactaaaaaatgaggtctagtttcttcactgttacagatctgggcaagtttcttgaccaataaagcacgacagtcagcacctgtactgctactctcacaa

SEQ ID NO: 214372 - DNA, 470 bp, Homo sapiens
ataagctaattacataggattgacacatataacacaatatactctaggctgggaagtttgtgaccagttcaatccctgactaagctctgtttctgaggacttgttgaatgatgccaatctttgtccttcttggtgtctaattcattcaataattatggttatatcagccattaattatgaggctttattgtatcaagtgttagagaaagtaaaaattagataggcaattatattcagatgctacatcttttggcccaaagcaatttacctaattctttaaatcttctctttactcatgtgtgaaatgagaaaatttatatcttccttataggattgctgaaaggacttaatgaaataacgcatgtaaaacagtacagtaccagacgtatggtaatgaataaataaataattttagattatgatgatgatgaagtgcttgaaaattgaaaataaactatttaacttttgta

SEQ ID NO: 214373 - DNA, 589 bp, Homo sapiens
gtgaagccaggttggtttgactgtgctctctcactcagggtcctgtaatccaggatctagagtttccaagtgtggcttcctaggccttttgggcctgctcttcttccattgccttccccacctgggctccctctatctcaagattagggttcctcccagggccccctggaggccagctttcattttcatcttgagcagccgtggaaaattaaggactcaaccactttaattttggggtcttagtaattatctgacaccacccactcaactctacccactagttattacaataataacaataataatttagagaagcgatggcaatgatcacagcgtttacagaatccgggactgggcggagatagatatagcctcacacttcctttttctatcagtgtggtactagttttgggagtaaggactgttggagtctagtcagttctggcaaggatgccatatatcacatgactgaatgtgcccctaaatgcctgtgtaccttcatttccccctctgtaaaatgtgggaaaaagtcttgcaagacgatgtgctttcagcttcctgaaataaagtcatgataagcaaccttttc

SEQ ID NO: 214374 - DNA, 1404 bp, Homo sapiens
  misc_feature (1173)..(1173): n is a, c, g, or t
  misc_feature (1384)..(1384): n is a, c, g, or t
agcatatccttgcttcattcagagaggtcctcccaggtaagtacataaaatagcacatcctgtctgtctcttctctaaccttgctttatttttcttcaagacatttagcacttcctgacattatgttacataatgacttgtttattgtccttcttcactcgagtataatctctatatggaaaggaacttgcttattttgtttacccttgcatatccagcttttacaacagtatttggcatgtagtaagtggtcagcagatatttgttgaatggatgaatgcttaaatccttccaggtatatttggcactgcccagtatttgggcatctgaaggttggcagagttttaaggagtactgccttttcttggccagaccgcagccagtttcctagacaggaggtctttggtccttttatagggagatgcaggagaagcagcgtcatacaggctgaggtttaggcacagctagtcaagactaagacaagacctaagattgctccaactctgggataaagaatacattagagctgtcctgtgaagccttaaaccagggatgtaggggtagtaagaagattaagataaggctgatataactccaagggggaaatgacataactccaaacctagacccccttttcattctactttcaattcatttgttcattcagtaattgaatgctaagtgttaaatctaggtaaaagaaacacagaggaaaataagacaaataataaccctgctttcatttaactcacattttaaaggggaaggacagtcaatacaaattagtaacttcttacagtgttcagggctagggaagaaaataaaagaaggtactggaatagagaagatgggaagagagaaattgagcacatagactatttatatcctttaatcttcatgtgaattaggtcaaggtttcggatgggtctgtccctacacattttggaaacctggggtatttttgcgggattctgagccaacatagcgacttaatcacagcatacttcttaacacgagttttcccacccttattaacctgggggagtccacccatagaactctctcacactataaatattgttaataccacacgcgtcttcatggggtcatctcccaacttgccacggtcccacactctcgtctattccaactactcgttcctacgggacttcntgcatatactccggcatcggcactcactcctccgcttctcattcagcgcactgtctctctatatctactcactcaacctttgcatatcatcttcacacgttcaacactctctcctcttctctcgtgtcgctcttcctcttcgcctctgactctgtgcgactcctactactcgtctccattcgcgcaccctcgctcgtctctactacacatnctcgcgcgtcggctaccctc

SEQ ID NO: 214375 - DNA, 504 bp, Homo sapiens
aacgctacttagtttgcatgaatgtctaccaaacagcctaactggcaaaagccagtctgcattgtaaagccagtggaccaagatagactaaattttctgtcagaaaaagtctgactttgtttttaaattcagataaagttgttgaatatgtccttatcacaatgatctatcatattttttagttctcattattagacagaaacagagttaagtcacagagccatacttgtgtttgtggtgtgactgaaacaagatcagcccccttcattgaattttacctagatgctctttctttttgctctttggttcttatggaaaagccccttttgtcccttagtttagaacccttatatttttatacccctgagcattgtagcgtggaaagatctgggatgaatgacaggtatgtgttctttctatgaagtgggagaagagtgattgaaaacagaggcagttcaattttaagaaagagaacattagagaaattggctctcttaatactat

SEQ ID NO: 214376 - DNA, 373 bp, Homo sapiens
cagttccccgtgggccgagtgcaccgcctgctccgcaagggtaattatgccgagcgggttggagccggcgcgccagtgtacctggctgcggtgctggagtacctgaccgctgagatcctggagctggctggcaatgcggcccgcgacaacaagaagacccgtatcatcccgcgtcacctccaactggccatccgcaacgacgaggagctcaacaagctgctgggcaaagtcaccatcgcgcagggtggtgtcttgcccaatatccaggccgtgctgctgcctaagaagactgagagccaccataaggccaaataaggagcgaggttgtgaaaactggaaaacaaaggctcttttcagagccattctacactgt

SEQ ID NO: 214377 - DNA, 338 bp, Homo sapiens
caggtacaaatatctggatcgtctgtgagagaaagaactgaaaatgcacagcttccatcgtcctttaaatagctttctggattgaagagcattataattaaaccgcatcaagtgtcactgcagagaagcatgtaaattatgggtctgagtgtgggcaagaaatgttatttgattgcttgacaatcaaaaccagaagatgttcacatatgcataacccagatttgttgtaattatatcagatgcagaagaagtgggaggaataggtgtagctttgaatttaataatcacttgtttatctctctttcaaataaaaaaactgtttataaatactataggaa

SEQ ID NO: 214378 - DNA, 433 bp, Homo sapiens
catagatatgatacatatatcctttacatgtatgatacataactttaaaaatggccaatacatttcatatgtccttcaatgttccaaaaattattatttttgtctatacacttgactgaaaaatcttggctgagtatacaatgtatgagtcatgtattttttctgttagaattttgccagcatttctccactgcattggtcattggaagttgatgtctgaaatgctcccaatttgctttttctccaccacactgttctaagcacagtgttcagtgctggaggcacaaagatggagaagtctcaggtcccttcattgagaagctccccgactagggtgtggttgagccccaaatcattcatctgcctcatggacataattctaacccaatagttgtgaataacttaaagtataataataataaaataaaattac

SEQ ID NO: 214379 - DNA, 169 bp, Homo sapiens
actaatcccattcatgaaagctctgccatcatgagctaatcacctcccaaaggccccatctctgaatactatcacatttaaggttaggtttcaatatgtgaattttgagggaacacggaacattcagaccatagcagcttgtcagaagtcctgatgcctgtggccaatc

SEQ ID NO: 214380 - DNA, 210 bp, Homo sapiens
ttacagagtatgactttgtaactgaaccttaccaaaatcttcccataggatctttttcactcatgctaaatttcattctctccctttccctacatgatgtctcatcatatgactggaaagaacactggaatgactggaatgagaattggaagattttgttctgatccttgctttgtctcaaccaattgttcttcagccccaccatttttg

SEQ ID NO: 214381 - DNA, 418 bp, Homo sapiens
cctagtagctggaagtacaggcgcacgccaccacacccagctaatttttgtatttttagtagagacggggtttcaccattggccaggctggtctcgaactcctgacctcgtgatacgcctgcctcagcctcccaaagtgctgggattacaggcatgagccaccgcgcccggccaaaaattttgtaattttttttttttggtggagggaggatagaagctcagccacctcttgcccagtctgcagcaggtcagccaggaacctcaaccatctctgcagccagagcctgtcttcatggtggacagagccatctcgctttgtcacccaggctcgggtacagtggcacagtctcagctcactgcagcctcaacctcttgggctcaagcgatcctgccacctcagcctcccaagtagctggga

SEQ ID NO: 214382 - DNA, 432 bp, Homo sapiens
atgccacatgggtctgaggtcactgtgcagtgcggcgcttgggcagtgacctggtcctttcactctttcctccatacttccttatctcaaggtaagaaaggaagattgacaactcaggctgtagagtcagagagtcctgggatcaaatcccagcttaaccatataatctgtgtgactttgggtgaatgattgaaacgatctgtgctccgtgtcaccatccacacggtagggatcacagttggtctctgtctctgggaggtctgtgggctttaaatgagacagtagagatgaagtgcttagagctgtgccccgtgcatggccagtgtgcaatgagatggtctcagagtattatggctggagtcaccacttgtattaccaggaagcccagcctctgtgattacaggattccaactatggtgactctgcacctct

SEQ ID NO: 214383 - DNA, 129 bp, Homo sapiens
gcaaatgtattgaaatgagaagtattataaagatagaggaaacacatcatgtttagtggtcttgaaaatgataaacttttacagaaaagaaaataattatgacaacttgggcccttcctggaaatttcc

SEQ ID NO: 214384 - DNA, 424 bp, Homo sapiens
caacccccacttgggcagttctctgttcctggaaggcaaagccctcagccacttcctggaagcagagaaggtgggggcaaagttgcaaggcctggtctccctggttcccgggttgggggaggcatcttggtgagtcagggccggacttgcagcaggccggaggctgggagaataacacagaaacacggagggtgctggggcccagttcttcaggtaggctgtcactgttgcccacccttcccctacagccatccccacagcctcctgcacccagagacagctggggtggaggagaggctggggcctgaatcccacatttgcccccacttagcggctgtgtaaactcgggcaggttgcttcaccctctctaagcctcagtttcctcattgtaaaaccggcaatattgcttaaaaaaaatcatcat

SEQ ID NO: 214385 - DNA, 122 bp, Homo sapiens
cagtgaatactcccccacagtccactaccaagctggtatgtatcatgtcacaagtaacctgaaagactgagaccctctctgacatttagagaaaaaagataataaagttgttggtagagtaa

SEQ ID NO: 214386 - DNA, 822 bp, Homo sapiens
cgatggtgcatgcctataatgccagctacttgggaggctgaggcaggaggatcgtttgagcccaggagttcaaggctgccatgagctatgatcacaccactgcactccagcctgggtgacagagggagaccctgtctctgaaaaaaaaacgtgtatgtgtgtgtaaaccatgtggcagctatgaatgggaaacaaggaacaatatccctagaaggtaacctatagctcaaagtttactcatgcgtagcaagcccgttgccataggatatgaggagaattgaccagtaattcattggaaggtcctatgttaaaggaattccccccttcttctgatgccagggaaaaggaggaaattttactgttacttttggaatctgttctgagtacagtatggtaatgatggtgaactttggtcccagcctcataggcaaataaaaggataacctcattgccacacctgctgtgtgtccagtgtgtctgataaagctggagtattcccccttcccttgttccatggacataagatgagaattgatgggtgctgtacctggtctgcccctgtgggtactagggtaaggcaggggcttcctctttttggtgaagtgaacttttgtggctggtgctaaggcaatgctggagtcctttgccaccagctcctctcttgcagactctgctgcttgggggtatctgtttatttgttttttgccacactgatctggagcacagtgctgaaatgatttttccctttaccatctctcgctttaaaaatgttatgcttgttctcatgctcatactcatatttttaataaagggcatggtagc

SEQ ID NO: 214387 - DNA, 105 bp, Homo sapiens
tatatatatatatatatatatatgtggaaaaaagtatataacagcacttgtcataagagaaaagaatgtattttatgtgattatctgtgtactgaatgtccctag

SEQ ID NO: 214388 - DNA, 465 bp, Homo sapiens
ctcatgtcattggatgactacctttcactcacgccggttctaaacatacaccctctggagaggctgattccaaagggattcaggactcagatgtggcaaccattgctgagaaaaaggctacaatattagaaccagactaccatattagaaccaagtacatattctgcattgagaaaccccagctccttctcatactcagctggtagaattatggcaccaaagagattggagtaagatcaccaggaaaaccaacaatccaagaaaaaaaatctaaaaacagcaacaggtttttggatgtccttcagtgaaatgtccaagcaagaatatccccatgaagctttccagtcaacaaaccttgtacacacacaggattttcacttggctttctaatgtctaactcttcaatacgaactgactgccaaggattatcagacaatgtgaggaaaacctctcgcataaaagacc

SEQ ID NO: 214389 - DNA, 479 bp, Homo sapiens
agctgctgcctggtcataatgcctggaggcttcagccttctgacagcagcaagaggaagttattttggaaccctgctggtcatgagggctggggccttgataccttccagagctggcccaatcatggtctcaagaaagggcttgggaggccctgataaaccaagtattcattccatacttcttagatggggaactaggattgacaaataccaaaatgtaaatcagtgggaaaataacatttacaaaaatttattttacacactaattttttttttttttttttgaggcaaggtcttcctctgtcacccaggctggagtgcagtggtgcgatattggctcatcgcaacccccacctcctgggctcaggcaagcctcctagtagctaggactacaggcatgcaccaccacaccttgttttgtattttttgtagagacagggttttgccatgtcttcaaccaggctcctgcagcttctgggc

SEQ ID NO: 214390 - DNA, 453 bp, Homo sapiens
aaatagaggaaggtgtcatatttctttgtaagtagcagaaaacaaagcagagcctacttaggtagccagcccaccttctggttccatgcatggttcattgtctgttcctccttggggcatttctggtcctagctttaaactaaaaattaggccaggtgcagtggctcatgcgtgtaatcccaacaccttggaaaaccgaggcgggaggatctcttgaggccagcgtgagtaacatagtgagaccctgtctctacaaaaaaaattaaaaatcagccaggcatggtggagggagcctgtagtcccatctacttgggaagctgagacaggatagcagcttgtgcccaggaaattgaggccacagggagcccgtgattgtgcaactgcactccagcctgggtaacagaatgagactgtgtctctaagaaaataaagtaaaaatttgaaaaacctaaa

SEQ ID NO: 214391 - DNA, 330 bp, Homo sapiens
catctgtgatattcctgccaaagatgctaacctgagtctatatgtgaagaaacttcaaacccaaatggagacattgtctaccagataactggctaacaatcttttatagtgtggcaatcatgaaagtcaagaaaaaaactgaagaaccatctcagactgacaaagactagagacatgacaactaaatgcaatgtgtgattgtgaagaaaattctttcgctatgaaaggcatcgttgggacagttggcaaacattgaacggggtctgcagattagataatgaaatgtattaatgttcattaaaaaaaatttttttttgagatggagtctca

SEQ ID NO: 214392 - DNA, 534 bp, Homo sapiens
tccacagaatagactcactttcttcttgttgattttatgtgaatggttctcattacccaaactttatattataattctataatgttcaataaaataaaaacttcttggactgaatatttttaatacccagattgcttgcaagatactccaggctagccaggattttgcagggatatacgtgcagatgcgtcactagggaatgcctaaggaatgaacaagcaggcagcaagggcctgtgggggcagccatatgtgtctctctggaatcagtgaggaagctggaagcagagcagctcagccctctcgctccccctcagtgcttccagagacccctaacacagaagcttcctcctaaagaaatggcccactcagctcttttcctttccacgcttcttcagcttcctcactactgacaatattctggttgaaacattatttcctgaatcctagctctatccttggtgatgagcacacctaggttcaactgcaagataatagtgtagtgttatttggtattccaaggtcaacagtttat

SEQ ID NO: 214393 - DNA, 462 bp, Homo sapiens
cagatcaaacctgttcctggacccagtccagtttctgtcgcaactccaaacccagtttggatcagaaattttctcaaactccaaaacacaaatccatggagctccaaaatctgagagggagcttacgatgatccccagccactctgagagatccatggacacaaaaatgggtcctgcattgtcttcactcagcactcctggggtcgctagaagctccatttcagaacccgcttctgacaccatctgataaaagaaaaacttcagccgaattaaatttaaagaagtttaattgagcaatgaaccattcgtgaatcaggcagtccccagaatcacagcagattcacagagattcctggggtgccgcgtggtcagaacaaatgtatagataaaaaaggtaaagtggcgtacaggaatcagaagtgaggcacaaaagcagtgagattgggccaggcgcggtggctc

SEQ ID NO: 214394 - DNA, 325 bp, Homo sapiens
ttaatctagtagctttcattgacattagtataaaatgcatgcgttttttgtttaaaaatgataacagcagctatcttttgtaccatgctccattattttcaaattaccaacaaatctcatttgagcctcataatgctgagttggttttatttccatttttcggaggaaacatggtcaaagagggaacttttttttgttttgtttttcagtactcataaaggctcagtaatgtaaactggtacaactttcctggaaagcttcagaagtcatgcccttaatccagtaattgtacttgtagtaatccatcctaagaagacaaaagggg

SEQ ID NO: 214395 - DNA, 510 bp, Homo sapiens
cttattcgaatgtcctgttttgtggcttgttcagttttttaagagatgagaaaatgtgcaacataacaggaaaatgttaacagctttttgtgagaaggttaaagagctcttcatcctagaggagggaaggtttcctgtgtagtttctctgcacaagattcttctatataagtggtagggacctggtgttttccagcttctctgggaaaacagacttaaactacctatgaagaatccaagaggccggagcggtggctcatgcctataattccagcactttgggagaatgaggcaggaggattgcttgaggttatgagttcaagaccagcctgggcaacaaagcacaacctcgtctctacacaaaatagaaaaaaatttaataaggcatgggtgctgtgcatctgtagtcccagctactcgggaggctgaggcgggaagatcacctgagcccagaagatcgaggccgctgtgaaccatgatcatgccactgtactccagcatgcatgcgtgt

SEQ ID NO: 214396 - DNA, 444 bp, Homo sapiens
caatttttttttgtgtgtaacactcccaccagccccaacgtgggtttctggaaaaggctgttcctcgatagaattcacttcacatctctattttgtattctgacgattattggagtataaactgtccttcctgaaacaccctaatcaactaacttggctaagttctttcctaaacaaacactgtgcagcttccagttctttttctgcaagaaataccaaattagctgctttgtggtttgctggtgagccctgagaccttcatttcattattaggcagtccccagcctacagagagaactgcccaaaatatctaaaactggctgttgtggaagttcatttcatttcatttctgtgcctgcttccgttgctgatcttgaacataggctgtatatcaaaatgttaccagaggatgaaaaacacatgaataagatgattatgttggca

SEQ ID NO: 214397 - DNA, 175 bp, Homo sapiens
tacaatttgcatttattttgttatgagagtgaagtcagggaatttttcatatatttaagagccatttttacttccttttagtggcctgcctgctcatgtattttggtcatttttttgctgttgtgttgttggcctttttgtattgattttaggaacccttcatattttgaatctt

SEQ ID NO: 214398 - DNA, 311 bp, Homo sapiens
taaaccagaatctcagtatagtactttaggaggtaaaagatcataatattcagttatattgatgaattacagcaactgaaattctcagaaaaaaattaatgaaaatgtgaattgtcaatttgtctaaaatcattcacagagtaaaacataagtgctcaacttgattatattaggaaatagatagaaataaaggtaattgagccagtgtatgtgacctaaaatataatgcccttagtgaccatagggttggtctcatttgtacatagtggtgggccatgatgaactgtgttttgccctttgaatttttcctt

SEQ ID NO: 214399 - DNA, 732 bp, Homo sapiens
caatttatttattcaatctattattattatgttagatatgagaccttgctatgttgcctagatgggtctcaaactcctgagctcaagtaatccttctgtctcagcctcctgagcaggtgggactataggcatgcaccactgcacctgacaatcatttattgatggcagtatgaactcatggacatttgttttatccttaagttataacccaatattatattattttattgctaaattatttcagttttggccattgaagctcttttgtttaatgcccatgtcattttgacatacctctatcattgtgggatttctttttacttttttgcagatatttctttagtttttggcactacaagaggctctagtttcatcatctatcctgccccagcccaagattcaaccatttcttcaagtagcccttgctcctttttactgtacattgtaattaataatcaagttcttggcactaggttcttcagaaatttttttttagtttatatgtttgttgataaggtattgataaagattctgctagtgattaccaatgtaacttttggcaaattatctgaaacatggaaataataatttctacttcataggactgttgtacattttaaatggattcactaggatagtgcacggagtaaaaggaaacaaatagtaactctaaatggtattattacaaattcattggaaataaataaatgtaaatttgcttccaaaagtcaa

SEQ ID NO: 214400 - DNA, 704 bp, Homo sapiens
caatttatttattcaatctattattattatgttagatatgagaccttgctatgttgcctagatgggtctcaaactcctgagctcaagtaatccttctgtctcagcctcctgagcaggtgggactataggcatgcaccactgcacctgacaatcatttattgatggcagtatgaactcatggacatttgttttatccttaagttataacccaatattatattattttattgctaaattatttcagttttggccattgaagctcttttgtttaatgcccatgtcattttgacatacctctatcattgtgggatttctttttacttttttgcagatatttctttagtttttggcactacaagaggctctagtttcatcatctatcctgccccagcccaagattcaaccatttcttcaagtagcccttgctcctttttactgtacattgtaattaataatcaagttcttggcactaggttcttcagaaatttttttttagtttatatgtttgttgataaggtattgataaagattctgctagtgattaccaatgtaacttttggcaaattatctgaaacatggaaataataatttctacttcataggactgttgtacattttaaatggattcactaggatagggcgggtaaggaacatagtactctaatggtttttccattcttggataatatggattggtccaagtt

SEQ ID NO: 214401 - DNA, 723 bp, Homo sapiens
cacccccgtctcctggccggtttccttttctgcagtttgccgcctccaagccgccctgcgcttcctgcccgtgtctgacaaagactctgctcccttactgaacaccacagtgcccgccacgggctgccactcaaggtcacatccgcacgaccaccccctgcagcctacctgccagtgtcatctctggtcacccctccctcccaggatccatctcctcatcgtgcttccgcacctgcggttcattccctgggccaagaatgtccctcctaattctttgttcatccttagagaccctgataaatgtcaccacaggagtggaaccttcccctgccccaccccagacttagtctctccacaacagcttgcacatccccttgtccaacattacacttgtccctacacacagctgcctcctctaccagactctgagctgctggagtgtgcggcctggctcttgttctcctcatcccccaccccacacacaaggcccggcacagagcagccattggcaataaataaaccgcattttaaaaaatgagtaagtggaagaccataagaactgggtagttgctgggtatgcggaaggggctggactgttgagcgttcatctgaggcttcttggaggccacactgggcagggttagatggaaggtcaatagatttggtgcagcgagaggacctcagggaagcaccagagtgacctgtgatgttaatttaacaaac

SEQ ID NO: 214402 - DNA, 895 bp, Homo sapiens
cctagatgcattatctcttttattacatattatctcttttatttctcacaatagccaatgaataaggtggtataattaccattacacaaataagcaaacaaggcctagaaacctgaagcaactttttcaatcagcatcatacacaggattcaaatctagcccagtaaatatttgttatctcttaaactggtcgtgtactttgaaatgaagaaggcataagttcaccaaatataaaacgtaggactaaatgcaattgtgaaggatttaaaaagtagatttgatgcatccttgcccttatgaggtttatagtctagctgtgcttgtagaatataataagggctctgactgaggaactggaagaaagtatggcattttgtaagagggggaatgcctttttcctccttcttggaaaatcatagggtacaataacatttgaactggttctgacaagtagaaatggtaaaaaatcaaaatataaaaataggagtaaacaggaaggtagttgtctgctaagttccacaccttgtactgtccttgatatgaacggtccagtttaactttagtatggaccctgtgtcaggctgttatgagaaataaggctggaaagataaatccattaaacatggtggacctagggaggtacatgtgacaggttaaggtagagtttgaactctattttgtagacagtggaatgcattgaagtttttgaaagaaagagtatacaactagaattataattaactttaaaaccaaatacagtatatattcatattttaatatagtagcgtagacatactagatgttaaatgtaatccttttcttctgtctcatccattctctttttgtctttttctcatccattcctggtgcagtcatacgtagaatagattagaag

SEQ ID NO: 214403 - DNA, 210 bp, Homo sapiens
agtagggctcagtatttttggaaggaagttagaagagtctctgattattagtatcaatgatttttgaccattttatttttaaatacttgtttcaaaatctctggtaaatttctgtgtgaaataatttgtttactttagtatttcttgacagggaatacaggtatcccctataaatggcaagctgctatagttatccttagtataacacat

SEQ ID NO: 214404 - DNA, 380 bp, Homo sapiens
acagaaaaaaagctaagggcccatccagataaaatgcagtctgagcagagtgtactatattacctagtatatgatttagtgcctaagcgcaaacctgaaaaaaaattttttttttacttccaagtgacctcatccacaaacctcaaatatttagaatgctaaacatgtgaaaaacatctggccttttaaataaactagtatagtgccatgatagcattcatttacttctagatacccagttgtcctctattttaagtgtgtataaaaatcatttgagagaatcttaaaaatgaaaattactatacccagagagtttgatttagtaggtgtggagtcaggcctactatggtggttaaaatacgtccacaatttaatgctcc

SEQ ID NO: 214405 - DNA, 375 bp, Homo sapiens
agtgcctgtgtgtatgccagtgcctgtgtgcgctcagagagtgtatgcacgtgagttttcccagtgtagatacagcagctgagttcagtgagtgctggggctggcttgctgctgctctggaaaaccagttctgcgcatctcttcccagctccgcattcagtgacggggagttggtggatggcaattgggcacagtagagtattcacgcagaaaccagcccaggccatgcaccaggcctcttttcctcggagaggcaatgataggtcctttactggcacatagtggctgcatgtgcttctgtgtagatgtgggtgtctctgagtacacaggtgtgagcacactctgtccctgagggtgtatacacgaggcgccgca

SEQ ID NO: 214406 - DNA, 1621 bp, Homo sapiens
tgaaacatcagcgagttcacactggtgagcggccttatgaatgcaatgaatgtgggaagttatttagccagagctccagcctcaatagccatcggagacttcacactggtgaacggccttaccagtgcagtgaatgtgggaaattctttaaccaaagctccagcctcaataaccaccggagacttcacaccggcgagcggccttatgagtgcagcgaatgtgggaaaaccttcaggcagaggtccaatctgaggcagcacctgaaagttcacaaaccagacaggccttacgaatgcagcgaatgtgggaaagccttcaaccaaaggcctaccctcattcggcatcagaagattcacatcagagaaaggagcatggagaatgtgctccttccctgttcacagcacacaccagagataagctctgagaacagaccttatcagggcgctgtcaactacaagttgaaacttgttcatccaagtacccaccctggggaggttccctaggaatgctagctgtgttggaagctttctggagacaagttacattctcttactgtagagtttatcagcgttttttcactgctggggttgtgatagaagccatgtcagcaccacacactgcagctctccaaagagtgtgtccaccactccactgtgctcagggaaggcagacctctcctctctctttccaatccctaaagggaattaggagtagtctgaagccttgggaagatgtcattcccgccctgtatggctggtttagccatggacatgaccagcttttggctgtgaagacctgagcagggttttgccaacagcttgttctagagaaggtttccctttttctgggacattgttggtctcatgttatgcctgtgaaggatttgtccagccttcatgttactctacacaacaacttatctcctgtgtattgccctggttcatgtgatgataatggccttatgataaagccgcctttagtcttccaaaaaaaaaaaaaaaaaaaaagaaaaaaaacagaacaaaccacgcgaggcggactctatctaggtctccgggcgggcgagcgacaaccagggggtgatctggaacaaggcggctcgctgggggtcaaacagacgtggtggtccgcaggaccccacacgctgactgtgcacaacacggggggaacaaactacggggaggggtcccccaacagaagggggcgggtggcatagtacggttctcggaaacaaaccgggggctcaccgcgcgctatgaaggacccgccgggcaaaaacgaaggaccgacagcgaagcgcggccgagaggacccagccgaacccgccggccgaggcaccggagccaggccaccatggtggttcacaacagtcaccgtccggacacacactggctccgtcctggtggagcacttgacccccccaccgcccgccgccgcggccagagcagacggtggagagttcaaacctcacaaccccaatcatgggcgagacggatctcacatctccggagcgcgcacgccccggaccatggatcgcccagcgcgcagcggcccgacaacgcggagaagtgcaccaccatacaacagccacaacacatcaccagcgccacgcccccaacac

SEQ ID NO: 214407 - DNA, 2273 bp, Homo sapiens
tgaaacatcagcgagttcacactggtgagcggccttatgaatgcaatgaatgtgggaagttatttagccagagctccagcctcaatagccatcggagacttcacactggtgaacggccttaccagtgcagtgaatgtgggaaattctttaaccaaagctccagcctcaataaccaccggagacttcacaccggcgagcggccttatgagtgcagcgaatgtgggaaaaccttcaggcagaggtccaatctgaggcagcacctgaaagttcacaaaccagacaggccttacgaatgcagcgaatgtgggaaagccttcaaccaaaggcctaccctcattcggcatcagaagattcacatcagagaaaggagcatggagaatgtgctccttccctgttcacagcacacaccagagataagctctgagaacagaccttatcagggcgctgtcaactacaagttgaaacttgttcatccaagtacccaccctggggaggttccctaggaatgctagctgtgttggaagctttctggagacaagttacattctcttactgtagagtttatcagcgttttttcactgctggggttgtgatagaagccatgtcagcaccacacactgcagctctccaaagagtgtgtccaccactccactgtgctcagggaaggcagacctctcctctctctttccaatccctaaagggaattaggagtagtctgaagccttgggaagatgtcattcccgccctgtatggctggtttagccatggacatgaccagcttttggctgtgaagacctgagcagggttttgccaacagcttgttctagagaaggtttccctttttctgggacattgttggtctcatgttatgcctgtgaaggatttgtccagccttcatgttactctacacaacaacttatctcctgtgtattgccctggttcatgtgatgataatggccttatgataaagccgcctttagtcttccatgttctgatcactgtgtggggtggttcaagagcagagttaagatctaccaaactgaaggggtctccagattatcttggaggggacaggaggatggcagagaaacaactgtcaatccagatttgacctcatttgcattgccaccaaggcctcctaggaaaaattgtaggaatttatgggtataatattgtggtctgaatggcgtgaatttttatcccgaggagggggcagttgtgacaacctccagtgcatgtgggaacagcatgaattgggtcccttattcccagggggtgccccatattccccaatactgtaaagcagatgctgtttagcacctgccaaggagccatatgccctgaagttcagcattaggcaggtatctcttaactgtaagacataccaggcccagctgggaccataatttgtacagaaacactggatgtgattaatagggagtaggcgagattatagcaaaccagcagaaatggaactctgctaaatgtgcatccgtgaatgctcccttgaatgtggctgtgcaggattcagggtttgcagaaattctcaggacctcagacctctgtcctatgactaatgttactggcagagcaaataatctaaaggttttggttttgtggattaccatctccgtgctgtgcatctgaaggccagtgctgtgctggcaggaaaatagggactgagaaaaagcagatcctatactatagggactgtagtatctatgacgtagccagccattctttgctcccaaggcaagaagaaagagatgacagagtcaatatagggttgccaaatcggattttctaaaatgagtaggaagttggatttttatgtgcaacagtttcttttaatgctttgttgatatgtgattgtcatgcaataattattcatatttggtaagttttgtacatatattatgtacactcagggaaccaataccataatcatgataatgaacgtatccatcacctgcaaagctacctcatgcccctttacattccctccttgccttccctaggaaaccgttgatttacattttttactttagatttgtttgccttttctagaattaacacaattggaatcataaagtatttatactctcaaaaaaaaaaaaaaaaaaaagaaaataataaaaaaaaaaaaaattttatcacaattatactatttttctccactctacttttatactttattaatttttaccattattccactatttcctctatttgcccattctccctattccactatcttacactctctgctcccc

SEQ ID NO: 214408 - DNA, 333 bp, Homo sapiens
gtatctgtgaaacagaatttatttgatgcctaggtttctccctcacccgacgaagaccaaatgctgctgatccgtaagtaacttcgcaaggtaaactgaggggcctggcagcatctgggcctcccttaaaggtcgaaatcaagtgcgctcgccctccttctgtccgccttttccctttaaggtcctcgaggctgcttcgctgcagaaagtaactccgcgtcgccgccgcggaaagtggggcaactttgcctatcagcagaaaccttttgatccatctgaggcgacaaaccagaccaaacgcccgcccaagctgttccgagcctccggggggag

SEQ ID NO: 214409 - DNA, 441 bp, Homo sapiens
atataaatatagtaaaatagtgaatcttttagaccaacagcttacaactaaaaatgatgaagatgaactgcttattattctggttttctcttctgtatatgggaaagagtttttcctcctgtactatgggttacaaagtcagagttatggcgttttgttaccatggatgaaaaaccttgggaacaagtggggtagctcatgtttgcttttatgactccaaggaaaaaccagaaggtagtggattggagcttctttgtaagcacagatgtaaagtgcttgccacgactgtgaaaataattttaacaaatatggtagccacgctactgaattagtggttcatcatttatagaaatacataaagcaatgtcttatagcttatttattcaccgatgtctaagtttggagtgtttgatcacatcaggctcatgtattgactaatca

SEQ ID NO: 214410 - DNA, 411 bp, Homo sapiens
tcacttgagcccaggaaggtgagaccagccgaggcaacataatgagacaatatctccaaaaacaaagaaacaaacatataatctaagttatggtgctttatacatagggtactgaaaaactccctcagtgttgggtatctctgaaataaagaattagtataaacatctattgttttctatcttttgatattaaaagatagaattccaagcagccaatagaatactgaagtatcttttaatgaactaataaggattgatctttaaaatatatggtgaagtggctgggtgccgtggctcacgcctgtaatcctagcactctgggaggctgaggcaggcagatcgcttgagctcaggagttcaagaccagcctggacaacatggtgaaaccacatccctaccaaaaaaaaaaaa

SEQ ID NO: 214411 - DNA, 782 bp, Homo sapiens
aagaactgcaaatattctgtgaggaggattatttttccccctttccttttctattttcttaaagaatctttatttatctttaaaaagacagggtctcactatgttgcccagggtggtctcaaactcctggtctcaagtgatcctcctgccttggcctcccccaaagtgctgggattacaggtgtgagccaccatgcctggccatttttccccttaatggatataaacaaacagcaacaaaaaaacatagcttttacttgactatcaaaatcatagtggcctgcaatagctgcctccccactttacattaatgactgatagggaggccaaaaacgatgttgaatttactcactgcatacaacttccccaaagacagcagggctagcagtctaaaacattttttctgatcaattagtatctcttttcttttttgccaaggcatactaaaaacaaattggaaaaaagcactgaaatcttcactggggcatccaagatgttagctggaatgccatgccctaaagatgtgtcctggattccaaaagcaaacaatggcaaagagtattccccctgttcaaaaactccaaacgtggctgggcgcagtggctcatgactgtaatcccaacactctgggtggctgaggcgggaggatcacctgaggtcaggagttcgagaccagcctgaccaacatggtgaaaccccgtctctacgaaaaatacaaaaaatagctgggcatagtggcaggcgcctatcatctcagctactcgggaggctggggcaggagaa

SEQ ID NO: 214412 - DNA, 635 bp, Homo sapiens
caataaccctggagtcatccctaactgttctctttctcacaccccgcatcccatccatcggaaatcccatgagctccgctttcaccaggcccactgccacacctgatccaagcacccatcatgtctctccatctcttgcttcctggctgtaagggcctcactggtttccctgccacccaggctcagcactgccagcatggcctctttaaacctaattcaaatggcatcactgctctgctcaaaatccccacaagaactccgcatttccaaggcctcacgctgtgctctccctgtgacctcaccaactccacacccctctccatgtctgtacccacggtgctctcaccacaagggtcttctggcttcactgggaatatcccaagtatatggtcctcctaccttaaagtcctttgcagtggctgttctctctatctggaacattcttcacccagacagcctcatggcaaactccctcatctccatcaaatcctccaactcctggccaggcgccgtggctcacgcctgtaatcctagcacattgggaggccgaggcgggcgtatcacgaggtcaggagatagagaccatcctggctaacatggtgaaatcccgtctctactaaaaatacaaaaaatta

SEQ ID NO: 214413 - DNA, 334 bp, Homo sapiens
tacaaaacaaacgaacatgaacttcaaggtatggagagtgtaaatcactgcaaactctcccaagcctccaaatgctacaaagctacttagccaaggaccaaagaaaaactcgataggtgattattcttattaaataaacattatcctgcctttgcattgcttcctagttgacagagcattttcacatatattactgccatcgaatccccatgacagcccatacaggaagcagggctagtaccacgcatatctccattttggatggaaccattttttaaaatacagacacacacgcacacccccacacggagagagagagagagagagagagaga

SEQ ID NO: 214414 - DNA, 477 bp, Homo sapiens
cagtgcctggcattcaaaaaatgcattcagaaaaatttggtattcaaaaaatgcttgatgaattgactgactgcctgaatgaataaataaattggtggattaatgactgaatggagtacagaagactgtggtcccagaagaccttaacattgagcttgctgcagactgaatgtttgcctcctctcaaaattaatatgttgaaacctaatccttaatgtgatagtattaggatgtggggcctttggaaagtgattaggttatgaaggtggagccctcgtgaatgggagtagtatccttataaaagataccccagagaggtcccttgtcccttccaacatgtgaggctacagtgaaaagatggccatctgtaaaccaggaagtgagtcctcaccagataccacatctgttgtgctttgatcttggatttccctgtccccagaactgtggtaaataaatttctgttgtttgtaagccacc

SEQ ID NO: 214415 - DNA, 332 bp, Homo sapiens
ggcaaatagctaacatgtgtagagaccagctgtgagccatctcccttactcctcatggcacaggagcagccctaggaaacagaaagacaacaggatccgttgagaagcaattgatttgggtacaaaaagcccatccttttgacaacgaagctatatttcatatacaaacacaggcatgggtatatctaggcatgctgtgtgtatttgttgtcagtacagttgtccctctgtatcattaggggattggttccagaacgtccacatatgccaaaatccaagcatactcaagtcctgcaggggccctgcagaatccaagtacaggaaaagccggc

SEQ ID NO: 214416 - DNA, 355 bp, Homo sapiens
atgttgggggtgaataggcatgagaactccttatgttgcttaaaaaaggcaacttcacgtgttctgtgtttggtgacctgatgccattcagtaaaggggagagagagggaggtgtgagaggatacacaacatcaagccttcaccacagacaatccaggtttaagaaaaactacaaaagaagttgaagacctggaaatggacctaattaaaaatactctcaccgccgctttgttccctccaggtctacctaccctttgcccatttgaagactcagacttacgttatggtttgtaagaaaaaattgtgagacctggatagtgcaaagttacactcaagagatggacttagaaaataa

SEQ ID NO: 214417 - DNA, 595 bp, Homo sapiens
ccacaacaagtcaacagctatttatgttgacaccatctgaattaactggcctcaaagctaacctgacattttgcgatctgccatctgtctaggaaggaagtttattctgacaaagacaaagactaaaaggtgtttgtgcatcagcttatctcttctaaggaccttaataagaaggtcaactttgtggtgcttcaaacttttcttactagcaagatctgaggcatgttggagcataaatatttctactaggatatgagccctttaaactatagtggtttattctttttactaggatggatttttaaccttccagtggaatgtataaaggctaagtcacttttcctaagcaaagttttaagatgatttttagaacaggtttaggtttacagcaaaattgagagaaaggcacagagatatcccatatactcctgcccccatatacacacagtctccctactatgctgtagccatatttacagcaacttttccggaaatgtaggattagaagttaggctttctgtattttttcctttaatttgtttttagatttttttaatatgtgaagacattgcttttcttctgttagatatgttag

SEQ ID NO: 214418 - DNA, 548 bp, Homo sapiens
tagtcctcttcacctcagtttcccagctgggaaagctcaagcccaggcattgtaggtccctgtggctttacgtacacctgaaagtggcagggacgggtcagcagagaccctgatcctaccattaggttctgaatgggaaaaggaactacagaagcatctccaccaaagctcttcttgccaaagtttacttctgtattgtttaggccttggaggtaaaggataaaattgtccagacagctaattattttcttcaggtggctgagtagctgggaccacaggcatgtgccaccacgcccggctagttttttgcattcagtagacatggggtttcaccatgttggtcaggctggcctcaaactcctggcctcaagtgatccacctgccttggcctcccaaagtgctgggattacaggtgtgagccaccacactcagccagcccccttactttccttggagaccatatactgtggcttgtgccaaagtggtacagcatggatttccagctcccctatctacttgctgatgggagcaagatgcggaactctatg

SEQ ID NO: 214419 - DNA, 431 bp, Homo sapiens
tctatatcgaagagcctcaaggctgatgtttttatcatttggccttttaaagtgagtttttttgtcacttaacatgcataatgtgtaaagaggtggactattactgctgtgcattagtgggtgtatcagtccactagtctatcacaggaagtgtacaatatactgtacaagctgttttttccaaacagttttaggctgtttgccttttgaaagagagtacaatagtgtacaatttctaattttgaatattatgctaatcaagtgtcttagcccttaccatgtgccaacactgtgaacaacctcacaatgtgtgactattatcccacttttacaaatgtggctgtggctcacagggttagtgacctgccaagggtcacccaagattctgaaccaggtgagggactctggatccctctttataaatactttat

SEQ ID NO: 214420 - DNA, 152 bp, Homo sapiens
acaatcttaggttgccacattgatttcaacattctgaaatgcatttatatgtctcattaactattttcttgttaatgtttctgagtcagaaagacatcttaatgataatatagaatgtattatagtacagattccaaaatcctaggatactc

SEQ ID NO: 214421 - DNA, 272 bp, Homo sapiens
tatcttctaaaagaagattatctacatattgatatgaaaaaatgcattttggtatcacagttatttactataaatattcattaaataatacttttaaatgtgtaaccttccaggaattggtaatttgggaaattgtcatagacatgtttcctatttatttcccttttatataattgtgttttctctgaaatcagatgcattatttgaattttgctggaaaagggaatagcagttaaattgataaattaacaaaccaaataacttttagttaa

SEQ ID NO: 214422 - DNA, 335 bp, Homo sapiens
accttgcctctactaaaaatacaaaaaaaattagccaatgtggtaacttgcacctgtaggccgaggtactcaggaagttgaggtgggaggatcacctgagctcaggaatttgaggccgtagtaagctatgatcacaccactgcaccccagcctgggcagcagcatagctagaccccatctccaccaaaaatttaagaatcagctaggctgtggtgatgtgcacctgtaattctcgctacttggaaggcttgagcccaggagtttgaagctgcagtgagctatgttcgtgccactatactccaacctgagagacagagtgagaccctgtcttaaaa

SEQ ID NO: 214423 - DNA, 441 bp, Homo sapiens
ccccgcccaccggcgggtgcagctgagggcgcggccgaaggtgcccgacgccgcccacgagctcgactccacgctcggctactaggaccttctgcacttgcaccgagcaagcagcgaaatggctgtggcttcgtaccggtgactcgcgtcttggagattttaacactcctcaacgtccccaagggtgagggggtccaagggtggcgactatcccaaaaggcggggactcttcgggcctccctgccccgtcgtccctccttcctcggccttgccccggagctgtcctgggtttctgtctcctcccggagggagcgcttacggggtggggtggacctagggctgtcgcgcctgccgtgtggtcctggagaatgaggcttaccaaaggctcaagacagcgtccccatggagtgacatggttaaagtgttgaaagaaaagaactg

SEQ ID NO: 214424 - DNA, 396 bp, Homo sapiens
gcaagtctggcttaccaatctatcttgtccagcttttctctttctggctggcaagtaagtcagatggcctgcatactgcaggcccaaatgcctgcagttcatgggtgaaatgggaggcctcgtatgacctcatctccaaggtgctttctacaaacgtttaccaaatgcatatcaaggataaccaagctgctaaaaaaaatttatttcacatcatagtacacaagcatcatttatagtttggctttgagaacttttctggtattacatttatggaaaatgtataaaagaaataagttttggttatatttttatatttagaaagtaaaaatttgcttaaattgatcactgttctttttttatttgattgtcatttcaataaaaaatatttgaaagaaa

SEQ ID NO: 214425 - DNA, 759 bp, Homo sapiens
ggcgggcagatcacttgaggccagggattcgagaccagcctggctaacgtggcataacccctaaatctactaaaaaatagaaaacttagccaggcgtggtggtgcacacctgtaatcccagctactcgggaggctgaggcagaagaatcgcttgaacccagtagggtggaggttgcagtgagccaagatcacaccaccgcactccaacctgggtgacagagcgagactctgtctcaaaaaataaaaataaaaaaatagtggttcacttatactgcctacttaaattttgataaatgaattccattttacatgacttgttattccatatatctgtaaaatatcataggtcatttagtatttttctgaaacattacaccacgctataggaccctaatatacaccatgccataggaccctaatacactcagtgtagaggacagtgtcaggcctgtctcccagcattgctgtcatgaaagggttccattataggtaaaacttaatttgatgcattcagttgaaccataagaaattgccattattacttgtctgaaatggtcaaatatcagcattctttgtggacttaatagtttattaaatctaacattaagtctaatatttttgtttatgggtggcagggtaagaagattctttgtagaaagaggtatataaagataagtttgattttgttctagctttggttcatgtgcaagctgaggcttcccacaggaaaggcaagaaatctcattatctttttaatag

SEQ ID NO: 214426 - DNA, 333 bp, Homo sapiens
gctggagaagatgcagcttgaggccatgctagaggctcaggactttgatgtatagtggtaagaagattttagccagttcaagaggggaaataatccacattattttgtgggaatgtgttaacaaaagacagcacaagggttagaaaaggctgaacaaatcagaccttaatcacaaagggacaggcacaaaaagacaaagcaacaaattaatgagatggaccatgcttcattcttcctggtatacatggtatgcagcacagtgcctggtaatgttttattcatcttggtataaatggtatgtagacctcaataaatattccaaagaatgatagc

SEQ ID NO: 214427 - DNA, 443 bp, Homo sapiens
cccgtggggtatggggcttctaagccaagatggaccctatactctctgaagtgcttcttgtctgtttgcacctgagctgccacttggagttccagagaggaggccctggacagcatgtgggctgctgtaaagacccccacagaggagggatgcctgaagctatcctcctggccatggtggttcctggcagtttgtttgtgagtagactcccagaagcagtgacctacagtggtcttgtgagtcagtgttttgctgaactgaaggaggcccctggtagacatgagagtcatgagagggtaggtttgctctccatacttgctggggccgacgtgacatgttgtcttcccgccaagtttcctcacacatgctggtctgactcttcaaacataagtttgcagggagttgtttctctgtcactggaagatattcagagcccggtaata

SEQ ID NO: 214428 - DNA, 510 bp, Homo sapiens
cacaaaagtggaaacaatccaaatattcctcagtagatgaatggataaaatgtggtatattcatacaatggaatactattctgccataacaggaatgaagttctgatacatgctaaaatgtggacgtaccttgaaaacattatgctaaattaaagaagtcagacactaaaggccacatattgtatggttccttttacatgaaatgttcagaacaggcaaatctagagaagcagaaagtagattagtggttatcaagggctggggttggaggcattggggagtgattggtaatgatatgggatttcttttgggaatgaatgaaaatattctaaaattggtggtatttatgtaattttatgaatatgttaaaaaccactgaattgtatactttaagagagtgaattttatgttatatctcaataaagctgtgataaaacaacccattctacacaaaacaaaatatttgataagtgaatgaatggatctcttcacattatatgtacttgaaag

SEQ ID NO: 214429 - DNA, 448 bp, Homo sapiens
ccctacttttgaggttttgggactcggactggcttcctggctcctcagcttgcagacagcttattgtgggacttcactttgtgattgtgtgagccaattctcctaataaactccccttcatatatacatatatcctattagttgtgtccctttagtgaactctaatataaggatgatgatatggaaacataaatacacaaatataggccagaagtagagcaaatttctaatagtaaataacaatgaaaagtcagagacagataattaaaaaagcagtaactacaaaggaaatgaaatcagtgtgtcgaagagatatccagcttttatgttcattgcagcactgttcaaaatagctaagataaggattcaacgtctatgtctatcaacagatgaatggataaagaaaatgtggtacatacacacaatggaatactactcaaccttaaaa

SEQ ID NO: 214430 - DNA, 561 bp, Homo sapiens
agtagagatggggttttgccatgttggccaggctggtcttgaactcctgacctcaggtgatccacccgcctcggcctcccaaagtgctgggattacaggcgtgagccactgcacccggccccacacctgtctttactctccaccaccctgactccataagcctcccctctaccatgttgggaacctgcccttgagttggctttgcacacagacaccatcttaggtattcccacagcccccagggcttggtcactcattagccatgtcagtctctccatcctaagttcttgatttgtgtagatatggggacacaagaactagagaggtgatgttacctgctcagtgtcacacagcacatctaagcatcaatccccaaatccccagaatgccagatggctccagctcttcctcaagggaatgctttttctttctcttctttctgaaagcttccctctggcttccctttggctttcaatgggttgtccccatgccaggggcacctgcgtggttgttgtggttttgtgtttcccttccctttggcttttttttttccttgttttt

SEQ ID NO: 214431 - DNA, 401 bp, Homo sapiens
  misc_feature (113)..(113): n is a, c, g, or t
aatgtttcaggttttcactcaaaggagttgcccattggagcatttcagatttgggatttttggatttgggatgctcacctgctaagtacaatgtaaatattccaaaatttggngaaaaaaatctgaaatccagaacacttctgatcctgtgcattttggataagggatactcatcctgtcaagtatcttccttgataagtagactcatttgtctaatgactctacataattgtatcatttgaaaatatggatttattggtgatattatgtaactgttcattatgctgcccattgtgattcctgtaaagttacatgttggtatgacatagaacaatatctttttaaattttatttgattttattatttatttttttgagacggaatctcgctctgtcgccca

SEQ ID NO: 214432 - DNA, 348 bp, Homo sapiens
ctcatctttatccaactagaaacatgttaaaagaacttgtgcaggaaaagagatagaaggggtcaaatgaagccagatgtgagagttagcaatagcaatcaaattgatttaaggattaaatgtcaaagccaattcaaaaagaaaattaaaaaaaaatttttcctaggcctgagtataaaaatatagaatgcccactgtcacaaagtaatgaagttatgaatattccaaaattaagtaagctattacattggataagaaacccacagctgacaattcggttcctcttagttggctttccttgtttttttttttttttttttttttttgttacagtactgcctgaaaaat

SEQ ID NO: 214433 - DNA, 271 bp, Homo sapiens
ttatatacaatgctagtataaagatgaaaatgatgatattattaatactaataatagcaattactatttattaatctttgttctattctagacactgttctaatcactttacgtacattttcttgcttacaatacaaattcatgatatcgaaacagtgcttttcccattttacagatgaataaatttaggtttcgatgggttaagtaagttaaaatgaagaagttgggattcaatcttaagcttgttgacttcaattcccaattgtacaat

SEQ ID NO: 214434 - DNA, 109 bp, Homo sapiens
ctttctcttccaagtgggtacagccaaaggacagccctccagagctggccgtggtcagggctggacatgcccagccgtatttctaaacttacccccttctggaattcac

SEQ ID NO: 214435 - DNA, 126 bp, Homo sapiens
ggtagttacaaaaaaaaacaaacccagtccccctcagctgttaggcaccttcccaagccctgtgatttcactgggcggagaaattaatttggagccctggagagcgggaggggattgtaaaatcat

SEQ ID NO: 214436 - DNA, 467 bp, Homo sapiens
gatacacttcctattggcttgcatttcactttcttgagtgatgttcttactcagagaactctgaaacataggtgtttgtttttttaatttttgtactcccaaaccactcacacaatgcatttatacatgtaacattttcctctaaagctgggataatttttaatcattgtataccattgtaaaaaacaaaagagttaaaattgcatattgttggctgggcgcaatggctcatgcctgtaatcccagcagtttgggaggccgaggtgggtggatcacgaggtcaaaggatcaagaccatcctggccaacatggtgaaatcccatctctattaaaaatacaaaaattagctgggtgtggtggtgtgtgcctgtagtcccagctacttgggaggctgaggcaggagaactgcttgaacccgggaggtggaggttgcagtgtgccaagattgggccactgcactccagtcc

SEQ ID NO: 214437 - DNA, 390 bp, Homo sapiens
ggattcttattatttgtatagacttcatcgtgggtaaaatctatgattgtatttgatatgcacaacaacctatgaaatagatgtgtggtttcattcctgacattctaaagggaggaagttgaagcacaaaggagtaatatgacttacacagagtcacattagctcaggagttggcaaactgtagcctacaggctgtagtttttgtaagtaaagtttgactggagtatagccacagccatttatttatatattatccatggctgcttttgactacaacagctgggttaaatagttgagacagagactacaaataaacaatcactatatggcccttttagaagaagctgctaacccctgcattagcttgttagcaacagaatcaggatcagt

SEQ ID NO: 214438 - DNA, 525 bp, Homo sapiens
ttttttttagtagagactgggtttcaccgtgttagccaggatggtctcaatctcctgaccttgtgatccgcccaccttggccttccaaagtgctgagattacaggcgtgagccaccgtgcccggcctaagattcttggataagtcccttatttcattaagggctgcaaaatgatgatttttatgttctgtcaatgtaaagaataattttctcattaattagggctttctggtcactctgaaacacaatgtctacagaacaggcaggataaatgtttagtgtttcttaagtactaattttcagagtaagcaggtgatacctagttactccaattgttcaatataaggtcttttgtaggtggggagggtaggcttcccccttgccccacccctcttttttttttttttttgtatccctgtgaatttttcaggtttggcatatttaatgtgtttcattaattttattgtttttgatgcccaaaatgtcctgtcattggtaatgagagccccttcatgttgtctgatac

SEQ ID NO: 214439 - DNA, 291 bp, Homo sapiens
gcgtggtcgcggccgaggtactctttggcatgaagtatttttataaaataagcaaagtcattactataaaaatccctgaaatgaaacctatgtagaaattgtaataatgaagataacaaagagaggaatcactgcttacatagccatttatttagtgcttcccatctactatgcattattcagtgtgtattacatttcgtttttcatcatcacaataattttgcaagatatatacatacatataaaacataatattgtgtctgtatttattatagatgataaaacagagtt

SEQ ID NO: 214440 - DNA, 562 bp, Homo sapiens
ctatcaatttggtgttacagtaggctaaatacatttttttagacatgcagtacctcagagtttttcatcattccccttctcagaaagtttctggaaatatttgcaaaaatgagagggaaaggcaggaaaggggaagacaggtgacagtgcagtgaaagaggcttccaggctgacagctgtgtactaggcatagagaagagccactgcaggagcaggtcagatgctgtaggagcgacttcttcaggaaaattggtttaacagaaaacctgaggtgcctgaatacattcagaggagatcgagactactggggagatcataggatgaatttgtactgataacattgaaaaactaaacaaaggaatagacagttgtttagttgcattgctgtatcatgtatgttttaattattaacaaaattttgaatctaacaatagcgtttagatttgataatgctgggtggtacatgagtgttcatatcttttttacacgtttgaaatgtttcataaaaatattttcaaataatcacaaataatatatcactcccctgcttaactctataata

SEQ ID NO: 214441 - DNA, 662 bp, Homo sapiens
tcagtaaggcctcccaccctccagcctcccatccactctgttttaagaccccccactccactcaccagatatgtcatttgcagacaccacttccctctcttgggccttagtttccttttctgagaaatttgaggctgaactcaggggctcatgcctataatcccagcacttcaggaggccaaccaaagggggaagattcgttaaggccaagagttcaagaccagctatgggaaacatagcaagaccctgtcactaaaaaaaaatttaaaaattagctgggcacggtggctcatgcctgtattcccggctacttgggagattgaggcagaggatggcttgagccaggagtttgaggctgcagtaagcaccactgcaccccagcctgggtgacagagcaagactctatctctaaaaaataaaaagcaaataaaataaaaagcaaatccctcatggaactcctatcagtcatcagtaaatgagattgcaagaattgtaaaactgaaagtctgagcatggcctggcgcggtggctcacgcctataatcccagcactttgggaggccaaggcgggcagatcacctgaggtcaggagctcgaggccagcctggccctctcaggatgtgtgatctctatttcatgagaccgatctgcttctggcagctg

SEQ ID NO: 214442 - DNA, 497 bp, Homo sapiens
ccaggtcatttttttccccttgggagggcctcacatcttggccagtccctggtcacgagaggatccttgactcactcaactcttctgcagggaagtgtcctctttaggagactttgcagaggggactggtccatgggtgccctcgctggtggggcatcgtctttctctgacccaggaactcctgggggccttccctagggctcctaattcttcccatggcttttcacaccaccagccatgggggaggaaccatgagcttgtagccagctgcgctgtccttctggctttcccagtgaaaccatctcttctgccctccagtgtctctgatgccacagtacagctctgaggcacaggggggtgccacgaccctgaggtttatttaaaaaatctccaaatagtgcactccagctctctctactttgcttaatgtggaaaagtgttatttccctagaaggctctgtctctcccctgcaaataaagcctttttacccatctca

SEQ ID NO: 214443 - DNA, 487 bp, Homo sapiens
tcttttctacatttgtggagattttctaggatggcaggagattttttttaaattttttttctcgacaatatcaatttatttaggtcccttacttttactagccacccccttcccacttgcttctaatggcaaattagaatggtaacttgccccttgctcacctcatgcttggctttgggaaccggtgagaaactgcaatccattggcggtaggtacctgcaaccacaccgagctaattttttgtatatttagtggagacagggtttcaccatgttgaccaggctggtcttgaacttctgacctcaggtgatccacccgcctcggcctcccaaagtgctgggattacaggcgtgagccactgtgctcagcctccactattccatcttaacttctctcagagtgagcaaataagaggtcttcctgccgaatctgcccctatctccttctgtttggtaaacatagtagctgctgctttggttttttactc

SEQ ID NO: 214444 - DNA, 141 bp, Homo sapiens
tgcaaaacctgcagggagcccgcggtggctggagatacagggtgggcgggagagagagactggagagggaagtcctggaaatgaagccaagggggcagagctttaacccaggggctttaataaaccagttctgatgcttgt

SEQ ID NO: 214445 - DNA, 419 bp, Homo sapiens
gttacctgaacatttcttagaattctatttttattaaaaaaaagcttttgagtatattgctctgtatagttttcttagtggttgctctaggtattacaatatacatacaacaaactggtatcaatgttctactactgttttttcctctagagatggggtctcactgtgttgctcaggctggtctcaaactctgggctcaagtgatcctgccgtcttcagcctcctgagtagctgggactacagatgcacaccgccacacccagctatgttttactactttgagtgacctactggaaccttacttccatttaggatcctttattttctccctactttaatttttttttttaaacacagagtctcactctgtcgtccaggttggagtgtagtggcacaatctcggctcactgcaacctctg

SEQ ID NO: 214446 - DNA, 499 bp, Homo sapiens
ctccataacactacctatcctaaatgcagggttaatgccgaacctactgtgcaagaaatgatttactgatgaggtttcaaagaaaaccacatcaatttggatgtctgttaccttgaagtgatcattttaagagtagtagcttcttccctaggtataaaaagactattttcttcttttggtgtatttcatcctgtgttgagcaatcatttgtgaaatgaaaaagcaaaaaaactccccccactttaggatttataaatgggaagatggaggtgaagactggcctaattcataacccagtatgcattatctcatgcattgtgttgaccttggtgaaaatctttttcaaataccagcattctatatgtagaactaaagtgtttaaaactagaaacatgaattgttgttttgttaattttatgtttgtgttcagaaagcaatacccaggatccctttaatttttgtttgacttaaataaaaccatttaaattatttttgtgat

SEQ ID NO: 214447 - DNA, 784 bp, Homo sapiens
aaaatctgtataacgaataaattcaatagaataatgtcaagtacatgtagtgaataggtgctcattaaatgatatctcttcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccatgtagccccctatacccaaaccaatctttaaacccaaccaacttaatcattccgcccaaatttaaacccaattggccaaatccccccaaagggaagccaaataaaaatcaacggcccgcctttaaaaaacgtcgaaactgaaaaaccctggggttacccaaactaaaccccctggaaaaaaatcccctttccccaattgtgctaaattccaaaaagcccccaacggacccccttcccaaaagatgacaaaacctaatggcaaaggaaatttaaaccttaaatattagtaaaaatccggaaaaattttggtaaaaactaatttttaacccaaaacccaaatcgcaaatccctttaaaacaaaaggattcccccgaaaaagttcgaattttttccaaatttggacacaaattccttttaaaagaacgggcccttcaaaccaaaaggccaaaaaccctttttaagggcaaggcccacattcaaaaccatacccttaataaaattttttggtccaaaggccccaaaaaccactaaaacgcaaccctaaaaggacccccccattaaaaatcttcgcgcaaaaaccgacaaccttgaaaagtacgggccc

SEQ ID NO: 214448 - DNA, 220 bp, Homo sapiens
gatctttccagagagacttttaaaaaaattctgtaaccctaaaaatgatgtttgctactttttgatttgttgcaatataaacaggtaatatttacagacaatataagtaaatactgagttccttttcatactatgaactacgttattgctatgttgacctgttgagttcactgtatactttatgaagccatattctcaacaatatatcatgatatcaatg

SEQ ID NO: 214449 - DNA, 449 bp, Homo sapiens
ggtttctatcatgtttttctttacaatgaacatgtactgttttataaatttgtttaaaaagtaatcaagacaaactaagaaaggacaccaacgaagcgggactccctgcaagtctcctgggaccagccagggtgggccagcttagtgggaggattctccttggtggcggtgactggggtctcccttgtctgagctgcattctttcaagaacacacttattgcagtcagctgcccaggacttgtggagtgggtcatctggctgctcctgtgaccttccatggttttctttctgagaagcagcattttacttgctggatacctactctggaaatttgtctctgaatatgaatagcatccttctaagacctgagagtgagaacctcgcagactgcagaacactaagccacgtgatgagaatcatctgaagaatgaagccgtgctgtatttac

SEQ ID NO: 214450 - DNA, 727 bp, Homo sapiens
gcatgtttgtatcatgtttatttaaatgtgaattcatgttctaatatttctatgaccttccattgctgcaaagcagattaaagtgtaacaaaaatatcagctctttaaataaactggaaattaatctaattttgtggaagaactttaagacaagtctatgaggatggcgaaaacaatggtccacatatatagtttcttgatcctaaataaaatggtacctttgggccctttgtttagtctggcaattttctgactactatggctttttaaacagactcacacctaagtgaaacacagttgtcaaatgatttatggatctgtgattaaaggattcacttttaatgaatactattaaaacggagtaacaaaccttgctctactttaagttgaatgatagattcctctatattcaaaaaaaagcaattaactgccataattagggaaaactgtttaaagcatactgcatttacttggccacagcgccatctcatggtaattttttaaagtgctaccgtagccaaattgaactaagtcactgtactgctttcagcaaagggtgctcctcccatttgtgcatcaatgagacatatttataaagtgctaaattattctgtgccatatgtaacaaatacagtgaagattattttatgaacttattttaatcaaggcgatgctaaaagttttcaagaaaggataaataactgtaaataaagtagactcaaaaatg

SEQ ID NO: 214451 - DNA, 384 bp, Homo sapiens
cttaccttcccccccaccccccataacaacttgataaaattggagacaggagaattttaagtttgagaagatgaaggtggggaccagaattggtgacagtgacagaaaaggatagatgaatccttttctgtcgtatcaccgaaggagacctaggatttgataagggaggaggaagaataaaaaataactcaggtttggctgtgtgtggtggctcatgcctataatcccagcactttgggatgctgaggtgggcggatcacctgaggtcaggagttcaagactagcctggccaacatgatgaaaccccatctccactaaaaatacaaaaagtacccgggcacagtggtgcatgcctgtaatcccagctactcgggaggctgaggc

SEQ ID NO: 214452 - DNA, 315 bp, Homo sapiens
gccttctctccaggccctgaactttctcaagtcgacctcaccaggcccagctcatgcttctttgcagcctctccaggcccagctcctgcatctgtggtgacccctccaggcacagcctctgcctcccgtcggcctctacagtcccaacatctgcctcacagcagattcttcaggcccagcatctgcctcactgtggaccccccaagccaagctcccaacctttcagcagcttctacacacccagctcctgccacccagtggcctctttaggccaagctcatgcttcacaagggtctttccaggcccaatttttgt

SEQ ID NO: 214453 - DNA, 415 bp, Homo sapiens
catgatgccgtcagggaaaagctactttttgagagcaatgattttttttttgcaggtaaacgtatttatctgaagctggaagaacactttcagacataatgggagcattccctcatggagcatgagggtggcctaaatgaccttgtaagtgattgttgacacgaggagtctgtgacccagaatatggttttataaatttcccaccgcagggcactgatgaacgacacccagcaaaacctggacacgtgatctccaaaacatgggaaatttacgcttggagtgatttatgcccaggaaaattaggactagcaatcatttgatgctggttcttggaggaccttaaaggatttaaacactgaaaaatgaatgcatcatacaggtcactgcctcaatatattacagccctgaaaattac

SEQ ID NO: 214454 - DNA, 465 bp, Homo sapiens
ggggctctggctctctgcatcctcagcagagggtttgtgagatgggcagctacatcctatgttctgctgggctttcagtcttttcacgctgggcccttttccacctgtcttggatgaggaggcgctgtttcctattcctttgcaattccagtgaaaaatgagcctgctcagactgtcagcttcacggcttctgaaggatatgccgcagcctttttgtgacaagaaatagcttctttgtagttgctgataaatggtctgttcatctgctctgttgatgagccaggttgagggatccattattttcatagactccggggtaagtggcagccttaggaaggggagcagtggcgcaggggaacatggaggggactgcagggaagcgcgatgcagccgcagggactgtggcccctctctgcgttcaagagccagcagcggggcgcagagggagcaacaacctcaccactt

SEQ ID NO: 214455 - DNA, 540 bp, Homo sapiens
ttaaattattcatttaaatcaatttgaaaatatactccaaagctagagataactttatgtggtggaaagaggaaaagctttggagtactctaggccaagtaaggattctattatttacctgaattattgtctaaaccaactagagtgtctatcatttatctacattaacttgaatatttaggaattttatcattttctttcattgttgccttggacaaattccttcatttcttctttagagaaacactaagtcattatttctaacagatcaccagtgatggaccagaataccagaactgaagcagggagttacatgttatatgaatttcataaaatggcagaaaaagacatgcaagctaaattgccaaaatcaagtgagaggctttaaaattgcatgtttaatcagggctgaagttccctaacgttattcttattcaggatttttcctatgtattagtgtctatagatggagcagactgggccaaagctttaaaatcttagtgctttcctagcaggcagactcagaatttaaaaaaaaaa

SEQ ID NO: 214456 - DNA, 449 bp, Homo sapiens
actccaagcaagacaaactcaatgagatccacacaaagacacattataatcaaactgctgatagacaaagacagagaaaaatcttgaaatcagcaagagagaagggatttatcacatacaagccatcctcaataagattaacaacctatttttatgagaaactatggaggtcaaaagggagtggaataaaatatttaaaatacagaaagggaaaaaatgccaacaaggaatttatatacagcaaaatacttcaaaaatgaagaggaaattaagacactgccagataaaagttcactgacagacttgctctacaagaaatgttaaaggaattcttcaggctgaaataaaatgatactaaacagtaacttaaagccatacaatgaaataaaagtcactgataaggtaactacgtcgacgcggccgcgaatttagtagtagtaggcggccgc

SEQ ID NO: 214457 - DNA, 243 bp, Homo sapiens
gactaacttctctcatcctttagaattgagctgaaggatttttctcctctagaaaacaaaagctaactagcatttactaaacacacactatattctaatcactgtgcaaaacacttcgcatgcattgtcttgcctaatactctaaattcagtgatgaggtaggtattgttatgtttctacagatgggggaggccaagatgtaactcatgggaggtcatatataaatagtaaatagtagaaatg

SEQ ID NO: 214458 - DNA, 340 bp, Homo sapiens
gaggcaggcccagctcacccaacttggaagggaaccgcgcaggccactgaacttgttaaccccctggagggaaggcttgcggttccatgggtgttttgtttgtttgttttgttttgagatggagtcccactctgtcgcccaggctggagtgcagtggcacagtctcggctccctgcagcgtccgtctcccaggatcaagggattctcgtgcctcagcttctcaagtagctgggattacaggcacgcgccaccatgcatgcctaatttttgtattcttagtagagatgggtttcgccatgttggccaggctggtctcgaacttctgacctcaagtgatcca

SEQ ID NO: 214459 - DNA, 381 bp, Homo sapiens
attgcagttttcagggaagaagtagagaaagaagcaaacacaagtcacaacatctcagaagtgccaaggtcactccaacacagcaggaaaatgaaatatattagactcctgataacctaggagcaaattctatcttctgactagactacataaagattggatatatcacagttatcctgtcatgaaactactgttcttttatccagtaatagtattttaatgaggctctccagcatctctcttcatgaaacattaattaaaagattccaacaattaattaggtatcttatgtcactaaatggaaaactgtctgtctaaaacttgcaggattcctaggctcttaggaccatatttaaacaaggagcatgtaatccttcacag

SEQ ID NO: 214460 - DNA, 463 bp, Homo sapiens
gagatttgattgatgtttgtaaagtgctttgatatctttcatagagtgttcaataagagcaaaatatgtcatcagaacttagtctaaagcaaactagtcccaaaccgtcttgagtagatactaagcggttttgtgtctttgttataagttgtacttatattttcgagagaaagtttttcatgttctgattttcttttaagtgtcagctgtatgtttggggtctttacctgttaacttgagttccaacatgctttgtagatggtcagtcacctacagaggacaatttttctagccaaggagttaaatccaccttaaaatgcttcttgccaaggacaatgcctttgcaaatatttgagatgtttattctcagttgtgatttattactgaatctgtgtcttcatagcgactccttgggaggtgcaggaggaggcagagccagaaagcaagtccctgcaatcagttc

SEQ ID NO: 214461 - DNA, 597 bp, Homo sapiens
ctgttgcccaggctgcagtgcagtggctcaatcacagctcgctgcaacctctgccttccgggcttgagatcccactcagctctgacaggggtgggaccatgtgtgtgtgctgtgacactcggctaagttttttagtttggtagagatggggtctcagtatgttgcccaggctggtcttgaactcctgggctcaagcgatcctcctgcctcagcctcccaaactgctgggattataagcgtgagccaccatgcctggcctgcatgcaggtttttatgtggacataagttttcaattcagttggataaatattcaggagcaaaactgctagattgcatggtaagaatctatctatctatctatatctatatctatattttttgagacagagtctcgcactgttgcccgggctggagtgcaatgttgcgatctcggctcactgcaacctccgcctcctggcctcccgagtagctgggattataggtgcctgccaccatgccaggctaattttttgcatttttagtagagacggggtttcactatgttggctaggcttgtcttgatctcctgacctcgtgatccacctgcctcagcctccc

SEQ ID NO: 214462 - DNA, 147 bp, Homo sapiens
tctgcaatgcccatgtgaacaaataccagtgtgcccattgagtcataatcttcttccattcctcaaagtgctggctcagttggtgtggctaggcttctatctcagttctcctatatatcatctgtcttagccagttggactgccaca

SEQ ID NO: 214463 - DNA, 555 bp, Homo sapiens
agtttgtgagggtaaagggtagcagtacatatactgctgttgaaagtttacatttctgatgacttttcaaatagacaattttttggtaagtatcacactgtaaaaatgtatgtgcccttcacccatcaattccattatactaaaatatctctaggaaatagagatacatgcaatttgtttttctcagcactgcttaaaatagcaatgtatttggaaaaccccttataatggattttataaattttataaatttatcaataaatttcagtgcatccataggatgggacaatatgggacctttgcagatgtcagtagatacagatgtatgttgaggtgtgaagatgtactctgaaaaaaagttggtttgattatacatacacacaaacaatctatggtgtttgtaagccaaatatgtgtacaaaatgtaacatttcttcttttctggcaggtgtattgtgatattttctcttatctgtgatgtataaatgatcagtatgtttaaaacttctagtaaatgttttttattaatgaaattatccttggaaaaagaagaaa

SEQ ID NO: 214464 - DNA, 127 bp, Homo sapiens
aatactgattgagatataaagagaggaggtaaaaataatcagcacaagaaatattaaagacatcaagtaattccttctgatggtagtactgccaactactctctgccaataaacttgaaaacttagg

SEQ ID NO: 214465 - DNA, 444 bp, Homo sapiens
cccccaaccaggaaacaacccaaatggtcataaacagtaaaatagataaataattggtggtatattcatacaacagagtacattctaccacactaagaatgaacaatctgcttccaaatgcagtaaaatatatgaaccttacaaatgtgctaagtgaaaaaagggagatgtacaattgcgggactccatttatgtgaagtacagaaacagacaaaagtcattgatgctattcaaagtcaggatagtggttacccttgagagagagctgatgactaggagagaacaccaatcggcttctggggagctggtagtgttgtttcttgagctgggtactggtgtgttcagtttgtgaaaattcattgagctgtactattgatatatgcatctctgtgtatgtaaattatgcttcaataaaaagctttaaaatgctgtgtatatataaat

SEQ ID NO: 214466 - DNA, 88 bp, Homo sapiens
attattctctcacttaattatctggggacttgcttcactgttaatcaaatgaaagcttttgttttaaacaataaaatctcttaagcac

SEQ ID NO: 214467 - DNA, 169 bp, Homo sapiens
gcgttggggtcgctctagaggtcccaagctccaaaagagctaacataaacagtgatcttttgggatagaaaatatcttccagtttctgataacttttgcaaagatttttccaccatcatccataagttctggagtttgaataagcaaactgtatgttctttgggagcaa

SEQ ID NO: 214468 - DNA, 600 bp, Homo sapiens
ggttccatccaaccccccagtccccgtttttaaacccgacgctagacctgatacgatcggctcggacccattcattgcggtggccatctcgtcctggtgagggtattttttttttccccaaccctctgtggtggatactgaaagaccatattaggataactgtacagtatagagaaggcagtggcaagttttctctgtcatataccagagtgggcttgggcatggtggcatactcctgtggtctcagctaatcaggaggctgaggaaggaggatcgcttgggcccgggagttggagactgtggtgtgctgtgatcacaccaccacacttcaatctgggcaacagagcaagagaccctatctctaaaaaaaagtaagtatttcggacactgtgggccatacggtctctggtgcagtttctcaacatggctgttgggtgaacacaaccacgcacagaacgcaaaccaatacacgtggctgtgggcccagaaaatgttatttatggacacaaaaattggaatttcatataactgttttgtgtcatgaaaatgatttccctttttattttattttcttctcaagtattaaatatgtcaaaagcc

SEQ ID NO: 214469 - DNA, 544 bp, Homo sapiens
agtcactaatgagcctatataatgtaggggctgtgggtaatcttttgactgcttcccaaaaagcatagattaattcaaggctcagcctcagctttagctctttatttctttattctgtcacttaaatcaaatctcaattattgttttccagtacacttaatggttcagtataggttaacaatatccagtacataatttactgttaattattaagagctgattgttcatctacaggtagatttaagaccacaaaatcaaagaaattttatagacatcatagctttgtttatttatgggaaatttttattgtctatgaagtttgtcactgtttacatagacttaaatgttagcacataaatgcataatagtgtgttgtacatgttactgcttattttaaatgtagaactgaagaatgttttatcagtaggccatatatcctgaaccataaatgggaacacatgagctaatacatggtgtcatgatggatggaacagcatatttttatcagaatattttaaataaaaaaaaatctgttcaccataaa

SEQ ID NO: 214470 - DNA, 443 bp, Homo sapiens
aggataataagtaattagaggatcacacagggactagaccaggcctgctgattttccagcccccgcccttggatgtcttggattggaataccataatggtcctagttagataaaattattgatttttttaaaaatgtaattgatttaaaatagattgttggctgggagtggtggctcatgcctgtaatcccagaactttgagaggccaaggcaggtggatcacctgaggtcaggagtttgagaccagcctggccaacatggcaaaatcccatctctactaaaaatacaaaaattagccgggcatggtggtgcgtgcctgtatctcagctactcgggaggctgaagcaggagaatcacttcaacccaggaggcggagattgcagtgagccaagattgtgccactgcactccagcctgggcaacaagggtgaaaactttgtctca

SEQ ID NO: 214471 - DNA, 660 bp, Homo sapiens
gaaacactggagcagcggcgctctgttcttgtgttattttgtgctgggccccaattccccttccactcttcaaatcatctaggacagaactgatgtctgatttatgctttccccctgtagatcttggcatcattcatgtctattatttattaaatggatactgagaaaatatccatctcatttttaaaaagtaatgacatgaaagattcacatacactgtgagtcagtgaagagctcaggggagaagcagatttataaaggataaagttaatgcgtgctggagtgaggcgactgcccaataataatgtaacaaccttaggatatgtaacaggaaggaatttttatgaaattcatttccagaattcaaagaagacagtttgtagactgagtaaaaattataagcttcagtggttaacagtgtagctttctaaactggtttctgttacagtatatttacttgaagcaattgggggggtactttcttaaaacagtgttttgccttctcttaaaacactattccttctagactgtgtttttgctgctgaatttaaggtgactttcatttttctaaaaaagttacaccaaaagcacactgcaccttcttcattaaggtgaaatcatatgcctttagcttgaggacagtctctttgaaactgctta

SEQ ID NO: 214472 - DNA, 253 bp, Homo sapiens
agaaacatgacaactacttgcactgtgggatcctgggccagaaaaaggactttagtgaaaatactgatgaaatttgaataatatgtgtaggttactagttaatagtattgtatcattgttaatttcctggttttggtcattgtactatggttatataagattctaatattaggagtagctgggtgaaagccattttgcaacttttttgtaaatctaaaactgtttcaggcgaggtgcagtgactcacgcctgt

SEQ ID NO: 214473 - DNA, 441 bp, Homo sapiens
taacatatctgaatgaattcatcaatcgtctgccttataaaaaatcagtggatttattcagtgataaaaaccagtaaattttaatttagtaactactgattttgcatgctttttgcatatcaaatgtaagttgtcaggaccctattaatatgaatattttatctaaatgttacccatttaaaaattataaatatttgtcttactcatacctgcattttactaaactcattatctatagtataaaactattacgtataatctctctttcccactgaactatctgcagagatcaaaggacccattattcaggccagatgttttcatgttttttaaaattaatcttgtttgtataaagtatatttagcttattttttgacaagtccctgatattccagacttaatgggtaccaccactaaatctgaataattgatggaaatgta

SEQ ID NO: 214474 - DNA, 318 bp, Homo sapiens
tcttgaactcctgacttcaggtgatccgcccgcctcggcctcccagtgtgctgggattacaggcatgagcacccggcctgaacctctatttttacatttcttttctattttacgtttcttttcagttcttgatgcttatcatcagttcttgatgctcttagctgctaactggactgtggtatcccatgtcttcaggaagagagagtctgcttattaggagatgcttataagatatagaaatataaaaatagaggttcaggccgggtgctcatgcctgtaatcccagcacactgggaggccgaggcgggcggatcacct

SEQ ID NO: 214475 - DNA, 740 bp, Homo sapiens
agcaaatgcaaaatcatcttagaagtcagagggaaatgcctatgcagttaagagcagaatagtgctgctactattattcctaagattcttgaccttatagaagattttatatttaatcggtttctctggagcccttgttattttgctagataagagaatttgaatatgtgtcccctattctcctgctatttggtagaagagatgaactggaataagtggcacagatacgcaataagaaagtgcaaagtcagttgagagtttctgtcttggactgttaggcaagttccgtgaaggagacatttatttcatcagggttgttgaaggctaacatgtctcatttattttagaagtagacaagagggccaggtgcagtggctcacacctgtaatctcagcgttttaggaggctgaggcaggaagattgcttgagcccaggaatttgagaccaacctgagcaacatagtgagacactgtctgtaatttttaaagaaatagaaaattttaaaaattaaaaaaaaatttttttaagtagacaagggcggtccaattttaccaaacagtttaagggaagaggaggtaggaaaacctaatttcagaggtgacttacaatcccattagagggaaattcaagtgtttgaggtctggagggtaaagaagacgtggttagaaaggatacagttgtcaagctgaggagagaacctaagcagtcggaggccattggagatactggaacaacaaaag

SEQ ID NO: 214476 - DNA, 230 bp, Homo sapiens
  misc_feature (160)..(160): n is a, c, g, or t
agaatagcttgagccagaaggtcgaggctgcagcaagccatgactgcaagaccatgtcccaaaaaaagaaagaggctgggtgtggtggctcatgcttgtaataccagcagtttgggaggccgaggtgggcggactgcttgaggccaggagttgggaggtngcggtgagccaagatcatgccactgtactccagcctgggggatggagcgagacttcgtcaaaaaaaaaaa

SEQ ID NO: 214477 - DNA, 981 bp, Homo sapiens
tgaaataagtgctttggaaaaaaattaagtgggtttaaacggatagagaatgacaggggtttctatgctaaatggagtagttggaggaggccttcttgagaaggaatttttgagcagagagggctaaatgaaatgagacaagggcctatgggagtttctgggggaccaacaggcacatggttggcatgttccagaactgcaaggaggtcagtgtggctggagtccagaagcatggggaggttggagaggtatctggggggccaattaggtgggatgttgtaggcaggataaaggactcttgaatttcttctgcacatgatggcaagattggagcatgaatccctctgccacatgtgtgaggagtagattataggggtcagaagagacactgcactgaggggctgagtagggagtgaccatgctggctaagaccaccctcctagctatgctggttgggcatcatctatgactttttcttctccttcatttgctacattcgtgcatacatgcccaactgggggttttgtttttataatgcaccttacagccatcagaagcaggttgagcgtcccaggatacagactctaggacagagattagtgtgggagaggtttattgggagtgctcttgagacagtagtttgtcaaagagaaggaaagaaagcacaactgggcagagaaagaagttcaactacaatgtggtgagttctgaggctgagatggcccttcagagctgtcctgagctgtggtgagaggtaggggcctttatatccccagtgatgatcagtcattgatgccaccatcccaggaagaggtcatgaccttggccgaaggccctcttttggcagcattcccagtgacttggataatctgatcattattactgaaggggaggtctgggcaccatatcgcaacaccctggtaccacatcacccatttttacacttgttactgaaactgccttgatttaatttctcattct

SEQ ID NO: 214478 - DNA, 808 bp, Homo sapiens
gcttaacttttccctttggcatagtgagtttggggtccccaaattttcttttcttttcatagtttctttttttacatgaaaataagcttcatgaaggtagagacattgtgttttctttcattgtattatcagagcttagaaaagcatagtagatactcaataaatattgtttaacacatgaatttgacacttagcacataggcttttatcgttaattgtcttttcatgaatgatgcaaaaatgtagaatgctctttagggtaagatctcttttacaattctctctattatactttatagcacccaatccattggtttgcataataagcacacaatgcagatttgttgatatgtttttctattgacatgaatctgaaaataacatgaattgataactgatttaagtttcatttttaagtaaaagtgtggaaagcagaataatggaccctgaaagatatatgtgtcctactcctccgaacctgttaatatactactttgcatggcaaaagggattttgcatctgtgattcaggttaagaagcttgtaatgggaagattattctggattatccaggtaaatcctatctaatttcatgagtcttttaaagcagagaaccttttccagctgcagagaaccaaagatggtagtgtgagaagtaagtttgatgttgctggctttgaaggtggaggaggagggccatgaaccaaggaatgtagatggcttctagaagccagagaaggcaagaaaatggattctcccctatagccttcagaaaggaatgcagccctgatgacgatgccttgatttta

SEQ ID NO: 214479 - DNA, 638 bp, Homo sapiens
aaagaaacggcatggggcgtttctcaatgctttatcactgacctcacagttttctgtttgtttaaaacaactacaacagcaaaatatatggccagcattgtgtgattggaggcagtgtgatacccatattatcttgcacgcgtaacatctagaaggccccattaattaacaattcagtatgtcttcttttctccaaagttggggaaagttggaaagctgatgagcctaaagtgacaccagatgactctattgctttctcttctttacttgtttaagttttatgaggagttaattcttaaacctcccctctcttcaagccccagccttcccagaaataaatcacaccagcccagggtggagttatgctgctctgatggcctatgggctggagctcctgactcctctggtggatatattacagtgactaagtgtggggagcagacaggagctgcctcttcgtctcctgtttcaaagaccaaaggatctggggttggagacacaatggatcaaaggacctgcaggtctgaacaggggcaagagaaagagaggccaaagaaaagaggattccctgggaagtgggacctggctctagcatgatatgtgttaggtatctgccacatacccaggacagtctcatt

SEQ ID NO: 214480 - DNA, 570 bp, Homo sapiens
aggggaataacctcagagtatgacataagatatccactaaataaaaaatactggttgggtatggtggctcacgcctccaatcccaacattttgggaggctgagtggggaggaccatttgaggccaggagatcaagaccagcttgggcaacataaaaaggccctatctctatttcacaaacacacacacacacacacacacacacacacacacaaagaaaaaaaaaattaaagaaaaaatactttaggaaattctaaactacttgtgcagagatggacttaagagtctattccagggtttaaagaagaggcacctaatatttaaaataattcaaatactccaaaggcctttctagccttctagaactctattctgcacagtatttgtttatcctagtgcctgattaaggttttgatttttacataaaacaaagtcccagggagttcagaggcctattcataaaaagaaaagccaagaagcatcaatattaataaagcttaaccaaagagatattgaaaaacctttgtaaaattaaaaacaatgactaattcaatccaaacaactaggtcat

SEQ ID NO: 214481 - DNA, 596 bp, Homo sapiens
catgattttttggcaggtgtctatcctgggtgctccccgtgcctcacagcagagtcagcaggtccccgccagcctgagcatgagaggaagaggtcagcctccttgggccaggctctgaggaggtgtggagtagaggccccgtggttgaggagccatagagaagtgctctagccacgcccattgtgaaggccacatttgagggtgtggctttctcctagagatctgagcacagtaacagcgctcagtcacagagaggcaggagagaggttctgttcctcctgggttttggtgcccccatggctgtaagattggcctattatactctttggagtactgcatttcttcttactctcaaagcatccttgttaagaagtgggtatgaccaccatgttttttaggttagaaaaacaaggcccacagaggccaagagcgctacccacattgaaagaatgaagggcagggccagactgcacctttattagagtctttgccctgtcgggatggggacccaatttaggggccagcatgtgtctagcagtggaataggggtgcagggagggtggggcaagagccccatgtgtcctggaagctgaggg

SEQ ID NO: 214482 - DNA, 465 bp, Homo sapiens
  misc_feature (125)..(125): n is a, c, g, or t
ctgcctcagcctcccaaagcactgggattacaggtatgagccaccacgcccagcctagcagccatggttttcagtgtatctgaaccccctatcttgtcctagaatctcatggctcctccctggangattttttgaggaggctgaaggagacaggacagttctcgaggtgtcgtgtggccctatgtccatgtggaaggggtgggctggtggctatctagagagtaggcaacaacatccagccttctcccactacccgtcccgtttcaggcttgggacagaatggaaacgtcaagcaggtcaggtgcagtgggtggctcatgcctgtaatcccagcactttgggaggctgaagtgggtggatcacgaggtcaggagctcaagaccagcctggccaagatggtgaaaccctgtctctactaaaaaatacaaaaaaaattagccggatgtggtggagggtgcctgtaat

SEQ ID NO: 214483 - DNA, 337 bp, Homo sapiens
gccctgaatgctttggggagctcaccaggaaaaatccaagaaaaggccgctggccccagagcggcaaaccttccagtgtgctctttcaacaggtgatgtgggcgggggggcggattgggaggggtggggtggaaatagaggaggaaaagtgaaggaagcatgtttctttcaaggtgcctctgaagagtcaattctgagccagatcttagaatccatgagttaaagaaatgaggaattgcaaaaaatgtgtgaaaagattgaaggcagtggctcagtcaatgaaagaagaggtcaaaaagaagagcggccagacttacaggaaaactgccaacccaga

SEQ ID NO: 214484 - DNA, 259 bp, Homo sapiens
aaatcactggtatactgtgatgtgtgcataattgtgtgtgtgtgtgtgtgtgtgtgtgtgtaagccttcttgtatatccatcattaaatgttaacaaatattttgtctaatccacatattttgacaagatagcataacataataatatgatattttatccatataaagtttcagtttctgaaatacagatgaaaactactatcttgatgtaaatttgagtagaaattcctccatattgagctcttggaaggcttccttc

SEQ ID NO: 214485 - DNA, 241 bp, Homo sapiens
ctgctttttctagatgtgtcttgtctgtgacctatccaaacttcctgatctagattttctggatatactctgctgctttccaagggtgatttagccaatctctaactcggaaggagtggaaagaccatgatcaaagaggaaaatccagccctgaatttactccccagtttgccctacctcggttttcaaaggttacatccagctctgcttaccacttagaaatacttcaagctgcaagtaa

SEQ ID NO: 214486 - DNA, 525 bp, Homo sapiens
gggagactgaaaaccaagaagaactgagaactggctgcaactttcaatgtgttccccaactttcacacagaccaaattggtagagggatggagacctcatcagatgaccccagtgcgctttccactgaaccatatgtcaaagacactggagaaacgtgaggccatgaagtgatactggattccagttgagtgacatgttattttgtgtgcttccaagctatattgttgcggcagtgtggcttagtaggaacacaggtttgcatcagacagaatggggttttaatcccagctctctctcttactatttgtgtgaatttgacaagttatgcaacttctctgtatcttagtcaatccttgtaaaattccagtgaagtaggcattattactgtcctcatgttctaaaatgcagtggcatggagactttttaatctgtaaaatcttttttttgggtgaggactaaaaattataattgctattaaggatataccacatggtaggtgcttaataaatagttttttaagtttg

SEQ ID NO: 214487 - DNA, 724 bp, Homo sapiens
acagacagtggccaaggccgggaatcaattttttttctaatcgttataatgaaaggatgctgaacattgtatgtgaggtactgcttatgttaattagcttgacttagccattccacagtatatacaggcacacctcactttattgtgctttgctttattgcacttttcagctattgcatttttttaaacaaattgaaggtttatgcgaccctgcgtcaaacaagtctatcagcaccatctttccaatagcatgcgatctctttatgtctctctatcacattttggtaattctcacaatatttcagactttttcattactggtattatgaaacatagtgatctaagcaacagattttcaatgtagatgaaacagccatctcttggaaaaagatgtcatctaggactttcatagctagagagaagtcaatgcctggcttcaaagcttcaaaggacaggctgactttcttgttaggggccaatgcagctggtgactttaagttgaagccaaaattcatttaccattccaaaagtcttagagtccttaataattatgctaaatctactctgcctgtgctctatacatggaacaacgaagcttggatgacagcacaatattttaagccaactgttgagagctactactcagaaacgattcctctcgaaccattactgcttattgacaatccacctggtcacccgagctttcatggagatgtcccaggag

SEQ ID NO: 214488 - DNA, 147 bp, Homo sapiens
tggccctttgcagggaggacacaaaggtggggctgaaggtgagaggaaaagatcaagcgtaaaccccacagggagagggggaggagagggaggcaggcctgtgcctttaaaagaattttcatttaaaggctcttctctcttccacca

SEQ ID NO: 214489 - DNA, 422 bp, Homo sapiens
tcatttatcattaataatcacatttcgattttcatttccctaatgctgatgattaataatcatagtcattagggaaatgaaaataaaaaccacagtaagatacctcttcatacccacagggatggtgaagttggtgaagatttggagaaagaaaaagcaaaatggtacagctgctttggaaaacaatttgtcagtctctcaaaatggtaaaagtaaagttgccatgtgtcctagcagttctattcctaagttatacccaagagaactgaaagcatatgttcatacacaaacttgtatacagtgtttatagcagcattatttataattgccaaaaagtggaaacaactcaaatgttcatcggctgatgaatggataaataaaatgtggcatatccataggatggaatattattcagcaagaaa

SEQ ID NO: 214490 - DNA, 339 bp, Homo sapiens
gctgccaagtgtcatccagatttctctttggtattgacttcccccagcccctgggcatactgccatagagacagcccaccattttcagtcctctttgggaattgcctccttccaaggacagccatatcccacgactgctcaatgtcgaggggtaaatgtatgaccctcttcccccaacttgggacaacttgaaggaccatctcatctttagagtaccctatagggtttgccaagaacatttttgggactgcgtcaccactcagcttctccctctgcccagtctggcctcctccctctccctcctattggtgtcaattccaagacatccttataaatgtc

SEQ ID NO: 214491 - DNA, 452 bp, Homo sapiens
caaaagtggtgtcaatatcatgatcgaaaaagggagaaagagcctgattgggatatatttaagaaacaatgagaggagaggaattgaagacagagagtatggacaactattctaagatgttttgttgaaaagtagagcaaaaaatgggatgacagctggcatcagaagaaaagcaaggaaattctttttcttagatcagaaaaacaacagcatatttgtatgctgatggtaataatttactagcatcaaaattaatgacatggtcatgatatagtgaactgcaacaggaaaatccccaggtacacagcgaagagggaatataatacacaaatttaaaaattatttggatctctgaaacatctgttttgatattaacctttcattcctgcaatagttattttaagcatgttctcattttctcttgttcagtgttgccaggttattataaagtg

SEQ ID NO: 214492 - DNA, 433 bp, Homo sapiens
caagtcccctgagttccccggtcattggattaattcagtcctgctctgagaatgggcaggaaaggggagggctggacagtcggtggtcagccaggagtggagggagatggaaaaactcggagaggagagtgacctgggaacatcatggacaggatggccagccagtcccctggcatcaggggatttacaagggctcatgttggccatgctcaaagaccacaggacagtgggcactcactcccattactacccctaatacctggttgaaaagaggaagaggaagcgaatcaagtaagtgaaagtctcattgcaattggagaggtggagacctcagagtgatcaatgagatagggaagatgcacaaggagggggaatctgaatatctctatgtaaaagaatgatgttgaacttttacatacacgatatacaaagt

SEQ ID NO: 214493 - DNA, 482 bp, Homo sapiens
taccagataataggctttcagggtatgacttaccatgaccccatgctctgtaccaatacaaaaaaactctgcagttaagataaaaaatgttttttaaaaaattatagtaaattatatatgccataaatttactatcttaaccactcttaagctgacagttcactagtgttaagtacattcccattgttgtacacccatcaccacccttttcatcttcccaaactgaaaccctgtgcccattaaacagtaacttcctatgtctatgtctgttcatgctgctatagcaaaatacccaagactgggtaatttataaagagaaacttattgctcacagttctggaggctggggaatcgaagatcaaggcactagccgatttggtgtctggtgaaggctcactctgcttccaagacggtgccttgctgctgtatctttgggaggggaggaatgctgcaccctcacgggcagaagagatgaaagggcc

SEQ ID NO: 214494 - DNA, 429 bp, Homo sapiens
ctctgttccaggtgctctgctaggtgttgaattaaatgcatcatctcattttaccttcttaacaaccctatgagggaggtggattctttcctagttatagatgaagaaatcaagctgtagtgaggttaatgacttgcccagttcccagagcatgtctgtggtagtgatgtcactcaaactaagtcagctggatctcagttgcctttgcctctgttttgatgttttatcagaagaggctgtgggacctcctgccccagaactaccaggataacttgtcaaagatctagagtcacaggattacccagtgaatattatttgcaaaatctgcagaggccctaagaatttgcatttttaacaagcgccccaaggacacttgcataaactaggtctgagaactactccatgaaactagcactagagtgtgtggtg

SEQ ID NO: 214495 - DNA, 361 bp, Homo sapiens
aaaacaacaaagaacacctcaagcttttttaagggctattatttctttcgctccccagtgggggaaaaaaatggattccactgtcctgtgtacaaaaacaaggaggatgctcatacaagaatgtggctagcagcattttctgtgtttcctctttctctcacaggtgtagacactgccttttctgagtcttcatcatcccccagcatctcctgggcacctgctgggactcatccccgccccagccactggagagacagagatgagcctggtcgaggaaatcgacttggttaaggctggcgtgggaccacatgccaagtccctgactcccagtcagaaccccaaaacccatttgaggtgatcc

SEQ ID NO: 214496 - DNA, 660 bp, Homo sapiens
ggtcagataaaaaatgtctgcatacatgtaaaagctagcatcagaggtcaaatcacatcataatcagcatatacacatctacaatttctccagtaaaataaaatagtaaaaatcagtgcaacattcccaactggtaaatctgtttctgatgggatataattctgaaactgctgtcagtgtatactggggctgaacaaataagtaaacggatgttatatagtgggaacaaggttcctcacttttgaagatattatagataagcaagaaaggaaggcattctaaaaatgaatgctgtggtactgaattaaagtcagagatgtcaatataagttcctggttataatagatgaagaaatacggaatcagttgtagatacgtccatatacaaaagttggtgtgcatacatgtattatctagctctgtttgccaagaaggactagaatttatgacaccccagtagcaatgaacatacccagtgcccagattttggtttctatataggattctccagtaaaaagtacaagagctccttggataaatggctgattctgcggctagggcatggaaaatacaagatgaatctgaaacatcctatagtagcagaaagaaagtggtcaaagaacaaaaggataagggcatgtcacagggacatataaaccaa

SEQ ID NO: 214497 - DNA, 717 bp, Homo sapiens
ctggcaaccaaagcgattgtgaccacaacactcttctagatacccatgactttcatttatactaacatctagaaaaatagaaaatacattttataagacacaattcggtatcaactatatgagtcaaataataaagatttgccaactagagttaaattaaatatctgccatttaaaaatatttaaaatgcaaataataactgagaactggttaagaagaattgaaaatagagttgggctgaagactaaaatggctacctatttccatcaggttagtttaatattaaaatgtacattttcattcttaccaatgctggatgaaaactgaaagcaataaaaatgaataacattttaagtttctcatacaaagactacaaaacaaaagcaagactatgagtaattaaattcttctatgagaactttaaaaatttataatgaaacacaaatgggtaactgaaaaatgggatacagttttaatttttcccaagttatatgtctttatttttgcatattttaaaatctactatatctgtatatactaccaattaaatgtcagtaacaaacgattacaattcaccatgagaagataatttatttgacattttaggttttaattcaagtcagcaaattaaaaacctttcttgattacatatgcttaaaccctaagcttgcttagcaatatacctttcaaattactactcttgttttgttttgagat

SEQ ID NO: 214498 - DNA, 551 bp, Homo sapiens
cagaatctataacactttggctgttggtgtagaatagaacccctaaaggaatacttttaaaatactaaatgaatgctaaataaaatttagggaaggggttcttccagcatggtgtccatttgcttaataagggaataaggcagagagaggattgtgcctttgttctattaaggctgttcatcattaagattattattctctcctactaattcctgagttgtttgtagcactttataaacttgagccccagagaatgtgtgatttaataaggacacaaataataatttttaaaaatagaggctgggcatggtggctcatgtgtgtaatcctagcactttgggaggccaaggctggacagtcgcttgaggcccagagttcaaagccagcctggacaacataggaagaccccatctcaacaaataattttgaaagttagccagtgtggtggtacgcacctatagtcccagttactagggtggctgaggtgggaggatcacttgagccctgagcccaggagggtgaggctacagtgagccatgatggcaccaaaa

SEQ ID NO: 214499 - DNA, 463 bp, Homo sapiens
tgagatacacgttgcacactgtgaaacaaaggtacggaggtgaaggagagaagacatctcagaggcgcctactcaccactgtccttgcccctgtaactccctctattccatgttgaaaccagaaacatgaagctccgttgctttgcatagcagaaatagattcacattacatttttttctgattggttccctccaggagaaggaaagtttttgaaatatttctccccaatgaataccgccctcagacacaaatttgttttcattcttttagtcatctccggccccaataaaagtcagaattgtaacctatactccttcaggttcatcagccaataaaggatcctgccttgtcccttatagcaattggaagagaacctcctattttgcagtgccatttgtaattctaatagtagcagtggcttaggtttgctgatgaatgaatttgaataaatgcttctgacac

SEQ ID NO: 214500 - DNA, 531 bp, Homo sapiens
atgaacttgatgcacataaatctaagatattacacacacacctgcacatatatatctatgtatataggcacacatatatttgtatttattgatatagaaatatgagtagatttctgctaggtttatcatctactttccatttttttctttttctttttaaaataatttccaattttattatagactcagggggtccaagtgcaggtttgttacatgggtatattatgtgatgctaagaatttgggtatggatggccctgttgcccaggagagagcatagtacctgatgggtagtttttcggtccattcccctcttcccttctaccctctccagtagtccccagtgtctgtagtacctgtttttatgttcacctgtactcaatgtttagctctcatttataaatgagaacatgtagtatttggttttctgtccctctgttaattcacttaggatgatggtctccagatgaatccatgttgctgtaaaggacatcatttcattctttttcatggctgtatagtatgccatggt

SEQ ID NO: 214501 - DNA, 474 bp, Homo sapiens
agataaggttattttggaatgttaatatatgcaaaggcttagaacatgttctatcacactgtacatgcgtaataaatattagctattgcaatgatgaggttgattgttgatgatgacacaacaaattatacagcttttcttcactctagagatctttgagtttagaagataaataaaaacggccaggcgctgtggctcacacctgtaatcccagcactttgggaagccgaggcgggcggatcacgaggtcaggagatcgagaccatcctcgctaacacggtaaaagcccgtctctactaaaaatacaaaaaattagccgggcgcgttggcgggcgcctgtggtcccagctactccggaggctgaggcaggagaatggcgtgaatccgggaggcggagcttgcattaagcccagatcgcgccactgcactccagcctgggcaaaagagtgagactccgtctcaaaaaaaaaaaaa

SEQ ID NO: 214502 - DNA, 500 bp, Homo sapiens
caggaagtagagttaaaaatttttctaatagaaaaaggcttatagaatgatataaagaaagaattttttgtccagttgtataatgtgtttgtattttaagttaggtgttaattacaagagtcaaaaagttaaataaatttaaaagtttataaagtaaaaaagttacagtaagttaaggttaatttattgttgaggaaagaaatattttttgaatgtattatagccctaaatgtgcagtatgtataaaacctacagcagtgtatggtcatgtcctggccttcccattcacttcccactcgctcaccggagtcaccagagcagcctgcgtgtgcagtgtgtgtaaagcctacagcaacacggtcatgtcctggccttcccactgactcttcactcactcatggactcaccggagcagcctgcgtgtgcagtgtgtataaagcctacagcagtatacggtcgtgtcctggccttcccactgactcttcattcactcatggact

SEQ ID NO: 214503 - DNA, 459 bp, Homo sapiens
ccaggtcaagcaccctggtagtgagggagagagagaggagaggctgtagagaagagacgtagctggttggaaatggaaggcagtcttaggctgcaagttgtggaggatggctccccaagtcccttatggtcattgatcaaaggcttctaatttaggcagcaaaacatttgcccaaacgaatgtcaactaactgggtgattcttaggattgttacagctgaaccggggttccagacaaccatgggattaggattatcttcatcaaaactggagcgaagggaccaagatggatttgggtcaagttccaacccctggaactagctatccaggcttaccccgtcttgtcattagccttgcattaataagaccctacattttattcaagttttgggatcccatttatcatattaagcagttttgctgtacctggctagtacttacgaagaaatataaattcaaa

SEQ ID NO: 214504 - DNA, 341 bp, Homo sapiens
gtgaacgcccgactgcaagctggtacaaactctatttttaatacatctttctgttattaacccttgctttaatggtaacttttagtcttctaccttttagaagctacggcttctgtaaaactgcttctgcactgccagtgcttggccacatcacaacatggtcagcatttggtgacaaggagtttattaccaaagtccccaggagcgttgcttttagttaggttagtccatttgaaataaagaactgtccctctcaccccttctcattcttaccaattaggttgtactgaggttttttattttggtttcttaggtggaaggaattaaaataggttttggtg

SEQ ID NO: 214505 - DNA, 388 bp, Homo sapiens
  misc_feature (1)..(1): n is a, c, g, or t
  misc_feature (19)..(19): n is a, c, g, or t
ncgacctactactactaanattctgtgtctctgcgtctgcttgtgcaggtctctacctggaatgtcctccttgacttgaccttctcaactcgggcatccaatctcccttccaccatcagcagctctagagagcgttctctggcctactccttttttttttttttttttttttttgagacagagcctcaatctgttgcccaggctggagtgcagtgatatgatctcagctcactgcagccttcgcctctcaggttcaagtgattctcttgcctcagcctcccaagtagctggtattacaggtgcctgctaccacacccagctaatttttgtatttttagcggagatggggtttcgccattggccaggctggtcttgaacttttgacttc

SEQ ID NO: 214506 - DNA, 418 bp, Homo sapiens
aaaaatataaattttctgcagaaaatttacaagaatctacaaaaaaattaaaaataagaaaatttacaaataaatgtttccaataatcagtcacctccatttctttatactagaaataactgaaaaatgaaatttaattaaaaagcaaaatcatttataataacatctaaaagggtccactacctaggatcacatatatagaaacattgcaaggctttttccttaaggaccataaaacattggtgagaaaaattaatatcaaaataactaaatagatatactctgtatattgactgaaagacacaatattgataaaatgccaatctccctcaaatcaacataatctctatccaaatcccagcctgttattttgtgcaaattgacagttttattctaaaatgtacatagaaatgcaagg

SEQ ID NO: 214507 - DNA, 444 bp, Homo sapiens
aaaaaactgttatgtaaacatcaaaaaattcaattattgttttaatcacagtatttttatctttttagaataagtacatacaaatagtgaccattaaaatagtcattgctttattggaaaccaactttgttttttttgtgcacccactcctctctcacccttggccaaaatcaaacaaaacttactgctccttctaaaatctagaaagaatactgcctatttttgtattttgtatatgcttaaggaaggaagagtctggaagtttcttcattggcttcttacattccaactttgctagtcacaaggcctttgtaaaagagactgtggaaactacttgtttgcaagacatttcccaaatttactgtgcttggcctgtgacacttaatttcatggaatgggattcataaagatgatcttaacctttcattccttaagaatttatcg

SEQ ID NO: 214508 - DNA, 404 bp, Homo sapiens
aaaccccactcccacactacccctgtcttcccataggttgtccctgggtcctgttagaatctcagagagacatgggactacgagttatccaaattcaggaatagtcagaacaagtgagtgaaacacacctttgcctgcctgtgaagggccagcttctgcacgggcaccagagacacaaagataaatgctcccaatgacctgatttactaaggaaggagagagacaggaactcactgcttaagggctacgtttattcattcctctatccagcaaattcttcaggactccagctgtgtgcccagcattatgcaagagctgggactttaattttcagtaagacctgctttttcctttaaggagtttgaatctaagaaggaagcaggcagcactggagcaattacccc

SEQ ID NO: 214509 - DNA, 280 bp, Homo sapiens
ctcctgttctgggaactcactcgcaagcacagtttcctgacctgaccttaagagctggttccctatgggtgacacagtggtgccaagtgtcccacaggtgatgttgatttggtcaggaggtgtggttggtgaaacagcctctgagggttccaccgcgggcggcccctccacctggctctttcaggggcctgggggccaaggcacttggggctccagaacaaaagaagagaccctggtgcttgtgattggcgtgagataaaaataacaaaagaaccgctga

SEQ ID NO: 214510 - DNA, 658 bp, Homo sapiens
gaagatggaagcaaccctggtgtccattgacatttgaatggataaacaaaacatccagccatacaatgaatgttatacagccttcagaaggaaggaaattgtgacacatgctacaacatggataaaccgtaaagacatgatactaaattagtcagtcacagaagcacaaatacaaccttgtatggttccacttctgaggtacttaggtagtcaaattcatagagacagaaagtagaatggtggtcgcgtggggcagggagatgggaaaatggggacttggtgtttagtgggtacagtgtttcagtttggagagatgaaaaagttctggacgtggatggtagtaagggttgcagaataatgtgtatgtgcttaatgccacagaactgttcatgtaaaaatggttgaaatggtaaattttatgttgtgatactttaccacataagaaaagtaaaacaaaaatagtgcttggtacctagtactagtaccttctaaatgttagctctcttaataattgtattattgtttaatattattattgcagtctcttggttcatttgttcaatacatattcattgagcacctactatgtgccaggtactattatagacactgaggaaataaagataacttgagttagtgtgggatcatgaaaaaggag

SEQ ID NO: 214511 - DNA, 141 bp, Homo sapiens
agtccttccccttctcagactgtccccgccctcctcccacttactcttctttcctcagaaccctcttctttctctttccctcttacacacatacaccagtctcctcacttcccagtttcccacactcactcttctgtctcc

SEQ ID NO: 214512 - DNA, 658 bp, Homo sapiens
taatggaagtgatacttaacgttactctcatgtgaccatacaaccagatggttctacctttctataaaaacatgtttgtagagctcattgggagttacatatatttgtgtatctatgatgtacctgcctgctaaagctcatcaacactaatgaagaattagtaccaattactctagtaaatgctagtaactgcatttattttagatcaaaatttgaactaaacaaatacaaattcaaattctaggtttttatatttcctttaggaagtgtgaattccaatgaaaactatttatttcctgagaaataaatagaagatgggtagtggttactatttttcagacaaatgtattcaatgcagactgtgaaactgactgtgtctgtgagtggaactagacttagttagtgacagtcagatttccagaacactgaacctgtgaaacaaagatttttttggatcctgctatagggctagaattataatacaacaagcataggtatttaacagcagataaccattttaagaacaaccaaaatttcccacctgaatatttccccttggtaagattattgtcataaatgcccaaatgaatctactaaaaatattatttaaatgtccatatgttttagatcctatattgagtccatagaaattacaaca

SEQ ID NO: 214513 - DNA, 568 bp, Homo sapiens
  misc_feature (562)..(562): n is a, c, g, or t
taccagacaccaaacttgttagctcctcgatcttggatttcctggtgtctagaactgtgaggaataaatatctattgtttataaattaaaaaaaaaaaaaaaaaaaaaaaaaaaaaaaaaaaaaaaaaaaaaaaaaaaaaattgaatgaaaaataaaaaaaaaaaaaataaaaaaataaaaaaaaaggaggagtaaacaaaaaaaaaaaaaaaaaaagaaaaataagctctttgggggggccttgaacaaaccaatgttaagacccagaaaacataaggggagggcaaaaaatatgggcttccaggaaaaaaaacctttaaaaagaagatttttaaaaaagcaggggaataccaaaaaaaggccaacgggtaaaaaacccccacgttaaacaaaaaaaaaagggctaaaaaaaaccccattttgaaaggggggggaaaaatgaaagggacccaccccaacgccccctctaaaaagaaacaacccccagagaggaagaaaaaaatccccggtttaaactaataaaaaaaaccgcgaaaaatttttttaaaaaaaaacaattcnaccccc

SEQ ID NO: 214514 - DNA, 520 bp, Homo sapiens
ctataccatgcatttagctgcctagtgagaatatccagtaggttatcctatagttactatgaagttaacacagcccaaaaacctacttctccttgtgtttttttccaactcaatgaatgacatcactgcactcagaccagaaatctagaagtcagtcatgactcttcattctatttcgcccttcacaaagagttagctgccagctctgttatttctgccccttctttacccttcttccaatttttattatcttcttatttatcctctatgtgtcacaagaccagtctttctgggaggcatgttttatcctatccctctgcgtaggaataaccataattatcttactaattccatcccagaaaagcctgtgatccctgaggccagaattgactctttgggcctaaatagcagctataaacatcttcagtaacttgccaggctctagcatgtggcatggaattttggcatctagctaaaattcctcaacccatagttaagctactcctctttctcctaaaaa

SEQ ID NO: 214515 - DNA, 571 bp, Homo sapiens
ctcacgcctgtaatcccagcactttgggaggccgaggcgggcggatcacaaggtcaggagatcgagaccatcccggctaaaacggtgaaaccccgtctctactaaaaatacaaaaaattagccgggcgtagtggcaggcgcctgtagtcccagctacttgggaggctgaggcaggagaatggcgtgaacccgggaggtggagcttgcagtgagccgagatcccgccactgcactccagcctgggcgacagagcgagactccgtctcaaaaaaaaaaaaaaaaaaaattagccgggcatggtggtgggtgcctgtagtcccagctactcgggaggctgaggcaggagaatggcatgaacctgggaggcagagcttgcagtgagccgagatcgcgccactgccctccagcctgggcgacagaatgagactgtctcaaaaaaaagaagaagaagaagaaaatcatactgcaggaagtcaggtatgtttcctttttgagaactcaggcagacccttgaccccctctgacctcacctcccacttttctgcctctggcttctcttcagccttttcag

SEQ ID NO: 214516 - DNA, 630 bp, Homo sapiens
  misc_feature (174)..(174): n is a, c, g, or t
ctgagtagctgggactacaggcgcccgccaccacacccggctaattttttttgtattttttagtagagacggggtttcactgtgttagccaggatggtctcgatctcctgaccttgtgatccacccgcctcggcctcccaaagtgctgggattacaggcttgagccaccgcgcnctggccggcctagctaatttttaagttttttgtagagattaagtttcaccatgttgccgaggctggtcttgaactctgggcctcaagcaatcctcgcactttggcctgccaaagttttgggattacaggcatgagccactgtgcccagctgtgaattaaacttagttatgtgtacccagggctctgggcagcctgctcggtcacatccttggtttggttatcttgaccacgcattggatttgtgttatttaaaaaaaaaaaaagttatttttttttaaaggcaagcaagcaaaaacaaaacgtttattaaggttttcgactgatgacatctatttatagcacatacattgtgaagatctgtggtttcctttagattaagaaagatattgtataaaatcatctccccacataaatgtttccaccacctactcatttgtctgcaagccaggagtctgt

SEQ ID NO: 214517 - DNA, 560 bp, Homo sapiens
taaaatgaatatgtattagtttaggaataaaatttaaaatgtaggaatgctataaaagaagaaaaaattttaactgggctaaagcaaacccagtatgtcatcctattacatcagcttcttcatctttggatgaagaggttggtgactgtttcttctaatgtgagaatagctccaaattgctaaattgttcagaatttgacaagatgaaagaggaaagaaaaaggaaatcttgaaaacatttactgtttccttgttcaatggataacacatggattcctgattgggagatttttcctcttgctttgatctgaaggcagaaggaaatatattcattattgtttaaaagaatacattttaacctaactttaaaacattcatgatatatttgtgaaccataatcttattaccccaacctagaagttattttgatcactaaacttccttttcaatatcttcatatatgtgtctttacatactttaaataaaaaatatataattgtataacgttttattattttatttaatatttatcacttctaataaatatatgtaaatatgta

SEQ ID NO: 214518 - DNA, 283 bp, Homo sapiens
atatgttcaaactgctaaatgaaactatggacagagagctaaaaagaataatgtgtgaacaaagatttcaataaggagaataatgtgtgaacagagatttcaataaagagatggaaatgacaaaagaaaaaacacaaaacaaaacaattctggagctgaaaactacattaccaaactgaaaacttctctagaaagtttcaatactagaaatattgattaggcagaataaagaattatagaactagaaaatcggtcaattgaaatgatcaagtatgaagaacag

SEQ ID NO: 214519 - DNA, 350 bp, Homo sapiens
aaattgtcttttatgggaacgaatttgttaaaggtagaaaaaaaactggtagtgtatgtatgttttatagattagacactaccaaaattatttaacatttagaataattaacttgctttcaggatgacagatgacttaagaaactgatgaagggttaattaaggatattgatttttagggcagaactacaaaattatcaaatcacttaacactgtaaatatgttcctgtttcaggttttcaaagtaaataccttaatcaaatttggccctcgtctttctggcttttcttccccctcgcttctgtcttttgttccccttctcgccctgccacgttattttaaactggcatg

SEQ ID NO: 214520 - DNA, 559 bp, Homo sapiens
tctagacatctatgaagctggcttttgctactaagttttctgggaaccagaggaatcagatttatagttgatgactcaaatagcagataaagataaaagatatataacattaataataccttagagtaataaattcttaagaaatcctaatagctttttttaaattaaactttttaattttgagataaaagttgtagattcatatacagttgtaagagttcccatgtaaccgttaccctatttctcctaatgctagcatttgtcacactacagtacagttccacaaccatgccattgacattgataacagttgaagacacagggcatttccaacactgcagtgatccctcatgttcttctgtagccgggctcacttgatatggcttccaccctctccttacccttgggcaaccacaaatctgtttttcctttctataattttcattcatcgtgcattcatgtacagtttttgtgtgtttgtgtgagcataaggtttttgtcttttggggaaacagggtccaactctgttgtccaggctggagtgcaatggctcggtctt

SEQ ID NO: 214521 - DNA, 553 bp, Homo sapiens
caagggcacctatttctgcgcctgctgagctccatggagtcaccaactcacagagactttgctgtatttttacagtggcttctattgtttatcagagaagcaactttctgcattgttgatatggaaatcttctgagattgttttaactaagatctctcaaacaaaatggaagggaggaaattttattattgtcccatttgggtagtagccagaaagtaactaaatattattcacatattagtttaaccaaatactttgtcagaggaggagggaaggttaggagaattagctttaaagaatttgtatccacacattttgtatagtaactgtgaattaaatctaccgtgtatttctcatcattaaaaagaccccattgattcttgtagtcatggaactgtaatagcagtggcaggatcatgcatgtgctcttgactacagttctgcaaaagttaccattggaggaaacttggtagaggacacatgtgatgtccttgtattacctcataatggcatgtacatttatagttatctcaaaataaaaagcctaataaaa

SEQ ID NO: 214522 - DNA, 655 bp, Homo sapiens
cgcagtggcctgtaatctcagcactttgggaggccgaggcaggcggatcacgaggtcaggaggtcgagaccatcctggctaacatggtaaaaccccatctctactaaaaattaaaaataaaaaaaattagccaggcgtggtggcggatgcctgtagtcccagctacttgggagactgaggcaggagaatcgcttgaacccaggaggcaggggagcttgcagtgagcagagatcgtgccactgcaatccagcctgggtgacagagcgagactccgtctcaaaaaacaaacaaacaaaaaaaacagaaaaaggaaagggaagagaaaatcaacaaaaccaaaattgatttaatgaaaatatcaaactaatggacaaaccaagaaaacagaagacctgaattactaataccagaaatgaaacagaagataataatggtcaaccttacagaaacaggattataagggagtctcatagacaattagccaacaaactggataaatgaaacaaaatggacaaactcctagaaacacataacctactaaaaatgaatcatgaagaaacagaaaatataaatagacctataactagtaaggagattgaatcagtaatcaaaaacctcccagaattcttaagaattaaacctcttcccaagacat

SEQ ID NO: 214523 - DNA, 477 bp, Homo sapiens
ctattagaaaagacccacaaactggctgaaaagttctcaaacttactagacctggcttccccccacacaaagattttcttgtgatcataaacattagagtgaccccccccccaaagaaaaaaaagattgttaagggacacagatcaaggggaaggcaaggttctgctttttctgagcagaaagatcagatatgcaggtgcagcattcattttaagtgactggagcaggttgtatcagtttattaattggtctcgttgaactgaagtactttccaggatttcagaaagtgcagtttcagcttgttggtaccgagaattgaaatttgcattgactgtggcagtgtaagaaatttttctgagaaggtagttgtagataagtaattacataagagtgaaataataaggtgaaccagtctgaagtaatagttctgaacaagtctgccaacatttgagacatgtataccattatctcagcaga

SEQ ID NO: 214524 - DNA, 877 bp, Homo sapiens
cctcgtctgcacggatgagtggccaactcaggagccaaggctgttgcttcccagtctggtggtgaatcttccatattctgaaagagctagagtcccagactgcaccgaagcttcatgagacctctcctcatctgtgcacgtttgagtggctgactctggagcccaggctgttgcttcccagtctggtggtgaatcctccatggtctggttgagtccttttcaactagtttttgtgttgttttttgaaacctcaagtcactgactccttcagcagtggtttaaggaagtatcttaatttttaaatcacatgttgaccatgcagccaattgttggcccgtagagtgaacaaaaccagaccacaagattgagggcttggagctggagaaagggaaaagaaaaagcagactgtgactctctggggaaagaactgaaagatgacactaggaattctcaaagcgagaggaaaaggaaaggccctttttcggaaatgacctctgataaacacaccctccagggttacacctgccactgtgtcttccacggacagacaagctgcactttagcagtcctgaatacctagagacttccttaacagagagtggggaatctcgtcatcttgcatggggatgggagctcgaagggagaacctcagccttccagaaggttatataaaaccagttgagaatttccctaagaatggagcagtggacaaacaattgttattgtaatccaaatacatgagtctacctacataatggagaaatgctaacttacagaagggtcaggttggtgtttgaatggttttaatttccttttataaaattacaggaattatacaattacattgattaattgtaatcagttttgagtctagcta

SEQ ID NO: 214525 - DNA, 421 bp, Homo sapiens
gcattagacaacttttttcagtttgttctgttttaatttataaatctataaaatagagttaacctaccttcatagggttattgtgaacattaaataatttaattttgtaaagtacttagaaatgccatgtgacatatagtaattaatatttgctgctatttttttaactgttactattattctttattattctgttatgatttacttgatttgttaacttaaacttatatatgttagctttcttatataagtcacctgttttatatattatacattcatatctctttatcacatttcgtacatcagatttagatttaaacatttcacctagaaaatggtttttttgtgtgtgttatgatgccagtgcctgcttgtcaacagttttatttgagcagctataaacatggtgatgtttgtgcaa

SEQ ID NO: 214526 - DNA, 398 bp, Homo sapiens
ggattacagttgcatgccaccacacccagctaatttttgtatttttagtagagactgggtttcatcatattggtaaggctgctctcaaactcctgacctcaggtgatccacccgcctcggcctcccaaagtgctgggattacaggcgtgagccactgtgcccagcaaggaatcttttttagggtgatagaaatcttctaaaaattatactgtgttgatgatcacacaattctgcacattaactgaaaatcactgaattgtatgctgaaaatgagtgacttttgtggaatgtaaattatacctcaaaagaatgttattcctttttttttctgaaatggagtttttcactcttgttacccaggctggagtgcaatggcatggtcttggctcactgcaacc

SEQ ID NO: 214527 - DNA, 613 bp, Homo sapiens
acattatagactatgatgattataatctctttgggctttcctgatctgtgatttctgaataaaataattttaagagtcttactgtccccgaaaacaatgaagctattccatataatcaagaacatataattttgttcctataaatactcagagattttcattgataaattaaccatctatcctttaaataatgttactaaaaaaagtagcaggtttagtctgtgttgaaggttatgaaacaatgactggaaagtgaaagatgggagtcaaaatgaccatttgctgctacttaaggactttcagcacagtggagggacgagaacgcggctttagagtcaggagacctggtttgaatccctgccttgccgctcactgaccatgggcaagtttacttagtgtcaggattttgtttctttctctggaaatgcacttgtgagttgagaaatgaaatgaaaggatgtattagactgtgaatttcatgtgggcaagaacctggctaccctccattgtcccctgtcacagtgtagacacatggtgcttccatagtgagtagaatatccattgttatttattttaaaatatggcaactattctccatgaaggtgttagagaa

SEQ ID NO: 214528 - DNA, 426 bp, Homo sapiens
tagagcactttggccttatgcttgcttttagctttctcatgtgccctaggtattgggaggacgagaagcaaacagccattgggaggatctatacaagcaagcagttttgtgctgctaaatttggattttgggggaaagacaactatctttgtttactaagataccaaggatgctcagttattcattcattaattccattatatgaagcctactgtgtgacaagtcctggagatacaaagatgaaaggtgaaggccctggtctcaaaggagctttttttccttaagattttataaatagatactcatggcattataggatatggtgaaaaacagtgtgctaatttgttgtcaataaagtgaactcaggatctaagccaggtgtgcatgtgtgtgtgagtatatgtgtggataaggccaagtctctgc

SEQ ID NO: 214529 - DNA, 427 bp, Homo sapiens
tgagcccaggaggtcaaggctgcagtgagtgcacagcctgggcaacggaatgtgaccttgtctcaaaaaaaaaaaaatcactgcattattttaataaaaacatgtatcttattggctgggtgcagtggctcatgcctgtaatcccagcactttgggaggccgaggtgggaggattgcttgagctcaggaattcaaggccagcctggttaatatagtgagacatctatactacaattcaaaacaacaataaaaaaattagctgggcatggtggcacacacctatagtcttagctactcagagggctgaggcggaaggaatgcttgagcccagaaggtcaaggctaaagtgagccctgatggtgccattgcacttcacagagtgaagagtgggtgacagagtgagaccctgtctcaaaaaaaagaaaaa

SEQ ID NO: 214530 - DNA, 447 bp, Homo sapiens
ggggcccggggaggacagctgctttctactcgaattttaaggaaacttactcgtatccagtttccacaagccaaattgaaattgtgtcttgaaaaacagtttttgtgcccactcgtgcttcttaacgtgactcctgtttggagaatttgcagaaccatctggctccagagtcttcagctatttacagagcagacccatagagtaataaattactctctgcctattattgtatttccctttttcctccctaaacgttcttttcatttttcggctcctgaacccgaggtgtgggttacatttctgtgggtgcacacattgccatgagtgccgctgcctagtgcttctgtcattgaagtctggtctccaagccactgtcccaagccagcatgactctagcttcctggaattccattcatctcttcgggatgggacgtcagccgcctcgct

SEQ ID NO: 214531 - DNA, 512 bp, Homo sapiens
catggtggctcacagttgtagtcccagctactaaggaggccaaggtggaggactgcttgagcccaggaggttgaggctgcagtgagctgtgatggcaccacggcactccagcctgggtgacagagcgaaactctgtctcaaaacaacagcaacaacagttacatcagcaaaaaaccaacagaaaatcatgcctctggggtcccttcccaccctggatgcagatgaggtgttcctgggtgcccagacagattagttcagccgcagagtaaagagctgcctccaggatcctccctttctaggcaaagacagacaccgcctcgccatccacttgcagttaagaatcaggtcggctaattagccgggagtggtggcggcgggcgcctgtagccccagctactcgggaggctgaggcaggagaatggcatgaacctgggaggtggagtttgcagtgagccgaaatcgagccactgcactccagcctgggtgacagagccagactctgtctccagaaa

SEQ ID NO: 214532 - DNA, 355 bp, Homo sapiens
cagctcacttaacaacagaaatgatagaaggcagatgacaatgaaattatttctttaaaatgtcaaagaaaagtgcagtcatgcatcacttaactatgggataggtttttttgagaaagcattgttgggtgattttgtcattgtgcaaacattatggagtgtccttacataggctactacacacctaggctatatgttatagcctgttgctcataggctacaaacctgtgcagcgtgttcttgtactgaatacggtaggtaatcggaacacaatggtaaatatttgtgtgtctaaacacatggaaacatagaaaaggtacagtaaaaatacagtattataatcttatgggaccac

SEQ ID NO: 214533 - DNA, 591 bp, Homo sapiens
gtgagtgggtgtgtgtgtgagagtggatgtggatgtgtggcagtgaacaggagagatctcagcctcttcatcttccatagaaaaagcccttaactaacgtctaaattgaaaacttaaggatcaagcagcagcagcagtacatcgtctagaaatacgaaggtgaattcttgtcattacatattgcatgtgaccactggacttgtaaaaattgtacatagtaagattgacacaaacacaaattaaagagaagctgcattttggaccatctcccattcacgtcccagggggagcaggaggctctcggaggccccgctgacacagtccccagcccaacgccagttgagacctgccgggggtaccaacagtgactcctagacagagccatgcgtcagtgcctccacaccacgaggcttcactttctcagtcctggaatgacttcctccgaccccgcagattctgtgcgggaagctgaacagtccctgtgaggaatgtttgcgaggattagagccggtcacacaaacgcattcctacaaataccatcttccatttctcagaaggaagaggcagctgtaacaaggcaaactgagccac

SEQ ID NO: 214534 - DNA, 380 bp, Homo sapiens
taagtaaattagcatgtcccccacatatatatgtcacagatattttctccagttgtttttaatctttgttctttatcttatagaagacacttttaagtgaccacatttgtgccttctaggttttctgtcctgcttagaaataccttttaccctcccaggttataataatattcaccaatgttttcttcaaattatgagtatgatttcattgtttccaaggcacatatttaggcagctaacttgggaggcagagcagaggagaaattcatgagggactgtcctagaggcaaggagactagttagcaggtatttcagtacagtttctggggaggagacagagaggtcatgaactaagccagtggaaatagcaaggaagagta

SEQ ID NO: 214535 - DNA, 465 bp, Homo sapiens
aattaataatattcagcaaacattttaaaatccaagtagaaaaagattgctttattttaatatctttatttaaaaatttgatgtgttaattatagttaataactccccttcattcaatagctaactttaaattattgtgttaaaaattttgtgttaaatttgtgtaagctttttgttacaaagctacagtaatcaaaacaatatagtactgatataaacatagatatacagaacaatggagtagaacaaagaacccagatataaacccttacatatgtggtcaaatgattatatttttgcaactaaaaagcttacataaaatttaatgcaacacaaaatttactatcttaaccattttcgttgtacagttcagtggtacatcacattgtacattcacattgttatgcagccatcaccaccatccatctctaaaactcttttcatcttgcaaaattgaaattctac

SEQ ID NO: 214536 - DNA, 410 bp, Homo sapiens
gatttgcacagaaattagaggaatagtaacttgctttttaaatgtcaaatttgtttttaattagtatctttgcacttccctagagcgtaatgatcctaagggttaaaaatcgattattgtagtcaattgatatatatttgttttttgtctgttgtcttcccctctccccacatctgttaacaaaatatatttcacagtcacacttttccccaaactaatttacggactgtcttcttttgcctttcttttgagtttaaggcatcatcttacatgaaaatttctataggccaggcatagtggtgcccacctgcaatcccagctactcaggaagtggaggtatgaggattacctgagcccaggagttcaagtccagcctagacaacatagcaagaccctgtctcaagtattaa

SEQ ID NO: 214537 - DNA, 166 bp, Homo sapiens
cttggctgggggtaggaggcattcggcaaacatttttgtgacagctcctgtgctaagtgctgaggccgtgaagataagtatgtccttgccttgggggaatttgcagttttctgggtgagacgatgatgtgatatttcaggtgttaagatccagccctatatgacgg

SEQ ID NO: 214538 - DNA, 475 bp, Homo sapiens
tgtggtggctcacgcctgtaatcccagcactttgggagactgaggctggtggatcacttgaggtcaggagttcgagaccagcctggccatcatgatgaaaccccatctctactaaaaatacagaaattagctgggtatggtggcaggtgcctgtaatcccagctactggggcggctgaagcagaagaattgcttgaactcgggaggccgaggttgcagtgagctgagattgcgtcactgcactgcagcctgggcaacagagcaagactctgtctcaaaaaagaaaaaacaaaagaacaactcctcaaaatcttcctaagattttatccccaggcaaatgcaaagacatgttcttgattttatattaaaaactcttgtgcaccattctaacgtattgtgcacacacttcattcttgtaatttaaaatgttgaactctgaagttttgtcatagtaatagctaaagggtatgtgttta

SEQ ID NO: 214539 - DNA, 312 bp, Homo sapiens
ctgagatcccaccaccgcactccagcctgggtgacagcgagactccatctcaaaaaaaaaaaaaaattgactatgacactgtcaaaagtcttaccgagggtagtggtttaaagtacatacaaaactctttgatatgccttccttcaaaaggtagagcccaatcctctccctttacatgtgggctggacttagtaacttagtccagaatcagtggaaataacagtatatgacttctgacactaggtcataaaaggcattgtggcttttccttgcctcctctgttaaattgtttgctctggggaaagctagctg

SEQ ID NO: 214540 - DNA, 497 bp, Homo sapiens
ggagggtcaaatgtggagaaatgaggggactcctttattctatttacagcatcccagtagctgaggagcacaaagacagctgtgatgcaaaggaaacatgatgggctttaaaatgagaagggctgagttcagattctacctgtgccatgtattaactgtgtgaccttaggcaagttgattaactgctctgggcctcagtctttccaccctgaaaagggcaataataacacccacctcacaggatcaaatggccaatgtgtttaagtacctcttgcaaattacacggtcctaaactattgtcatcagaagcaagtgaaaaatctccagctgctggattctctacggaaatattttgacccccagccaagttactttctgccaagctgcaggagctgatgaaataaattcctgttttaatatcagccttgtttaatactagagacaattaggagattaaatctgcaacaaaaagaaaaatagataatatatcaccctgg

SEQ ID NO: 214541 - DNA, 475 bp, Homo sapiens
tgttatttgttgcctgtctctctgactgcagaatatccaccctatagaggggagggactcggtttcatttactgttctatccctagcacctaggacagttccttgcacatggtaagtgccgggtaaatacctgctaagtgaataaaagaaactctctgagaaattctcctctagctggtagggtgctagagaactttgcttcctcattgctttcatgtactgccggcattgtctttctttctttctttcaaatagagatggggcccaagcgctgcggctcacacctgtaatcccagcactttgggaggccaaggctggcagatcacctgaagtcaggagttcaagaccagcctggtcaacatggtgaaacccctgtctctaataaaaatacaaaaattagctgggtgtgttggcaggcgcctgtaatcccagctacttgggaggctgaggcaggagaatcgcttgaacctgggag

SEQ ID NO: 214542 - DNA, 114 bp, Homo sapiens
cttgggaggctgaggtgggaggattgccaggagcctaggaggcagacattgcagtgagctgagctctcgccactgcactccaggctgggagtggacaaagggagaccttgtctc

SEQ ID NO: 214543 - DNA, 359 bp, Homo sapiens
caagtgccgcagtacttgggcccacgcttcgcagcgtggaatcagcggcggggcgcggcggcacgaggaagctgtgcaaagccgaaggggcagcctcagaccaggaaccttacccgtctggcgggtcttatggccgagtcaccgtggcggcgcggcagctcgggcccggttcttccgggcgggccggggtggtcacctctgcaaagcagggtttctgggccgtgatcgagtcttgctcacgggcatgtcgggaaacgcctgctgcgctccctgcctgaaaatccactcttgaaaatgcactcccttaggttaaaacgctgcctttcctaaggaccttctttaaaagtaaatcctaacat

SEQ ID NO: 214544 - DNA, 407 bp, Homo sapiens
ggctagtgaggaactcaggggccctgagcgcgatttccagctgaaccagaaagctttgtcgccatcttcccagtttccaagtgcagaaatcttgaggcacattcggtagctcctttttgatcctgtccctcacccaccttcacacacacacacgcagtccatgaggaagttcatttggcctctcagccttgctttgtccatctgagaacaccaccagacctcgaggtcttttcccggccttgcagccctgcaggtgctggcaggcttgctctagcatatctatctttcggaagggacagagggagccaccctgcctctactaggcccttgcataggcgtgtcctcccacagttcttgccacctagagctcccaaccctgcacctcactccaggcatcgattacattg

SEQ ID NO: 214545 - DNA, 531 bp, Homo sapiens
cagtggtgcctctacccccaaagcctggtaatttttgcatctgagtttaagtgactggttgcatgcattttgctgtgagtgctacttatgccatgagggaagccagatatagctgcattcttgatgtctgtctgatatcagtcttgcagccagaaatttttgagctctctttggtaaaggagagaaaatccacaaagcatgcttcctccacctctgtttccctacttcagttttttccctccccagctccccaaaccatactcattcatggaaattatttttctgctgtcactggaaaataatacaactctgatacttcaggcatgagatgactctgattgtttttcagtgttcttgccttagacaaaattaaatcaccggcagtgtgtcgcatccagccaacatcaaagctcttgtctgggttctatgagagccttgcaagtttctgaatcagtcagaaattatcgcggagctgagactaatcaatgaggaagttccattttatttttcaaatataatttctcttgtagc

SEQ ID NO: 214546 - DNA, 698 bp, Homo sapiens
accgttcgacatgaggtttgggatggggacaaggattcacaccatatcagtgtcttatgcatagtaaaacattttatgaatgattgtctctatgtgctgtagctgtatatcctccagtatggtagccacaggccacttgtggctaaatttaagtgaaatgaaagattcagttccttgggcacactagccacgttttccaggcctgacagccatgtgctgctgatggctgccttattggaccacacagatagtgaaaggtttctgtcacggctgagaggttctgttggccagtgcttgttcagctaaggttaaaatattaaccacctacacttcctttgtatctaaacccatttccttggttcttttccaatacttatttcctgggtagccctttgtgttacagggaaattgtgaattttcatattaaaggcaactcacctgggatatggcttgctgaaagggaagaggcagacgctgtagtatatagtcagtgctcaatgaagggaaaggggcttcacttccccaacagagtggccctccaaaagggtctcactttgtagcccaggctggtctcaaactcctaggctcaaatggtcctccaatcttggcctcccaaagtgctgggactacaggcgtttgccaccacatccagctgctgctccatctttaaagttgtcttgcccacactttgtgtgtgt

SEQ ID NO: 214547 - DNA, 100 bp, Homo sapiens
ctcttctttctttttccttcctccctccctgtctccctccctctctgcctccctccctccctccctcttccttccttccttccttccttcctcccttctt

SEQ ID NO: 214548 - DNA, 406 bp, Homo sapiens
agctttgatatgcaaatgctggctattagaaattgtccacccaatatggcaactcctgccttcttcttcctgtcccggtgtgtgccacgtgtcatggctgcctccggataacaccatgtgttcagaacatcatggcaacctgcatttgcatattaaagggctaaggtgggtggaccaggtgttttgcaggctacataaatgacacacctggtcaaaccaatcccctgggccctatgcaaaccagacactgccccctgcagcatcccaatataagcaaccacttttctgccacacaccaagtttctgtttgttctaatcccccctccctctgtctctgtatgggggagctgttttcttcttccttccttcttgcctaataaactctccactccttaaaaccattaca

SEQ ID NO: 214549 - DNA, 436 bp, Homo sapiens
cctggcagcccaacttgagacacaaaactcctgaaaagaaaagtaaccaaaccagaatttgcactagggaagtttgaaagaagttgatccattttgagaagagagttacagaaaacaaataaggaacccattgacgtcctagtaggctgagctcgacgtcacttcttccacagagtatacacgtcaagaacttaaaaagcattaacttctgccagatatgaaattattgtctttctggtggagaaaaggagccacagagaggttctaggtaaaacatggactttttttttttttaatgtggattatctgctagaataaaatttagtagatgtctataaattttctacattactagaatgctgttcaatcagatattgttcaaaataaatcatactgctgctgagaaatatttttctcaggagacaacctaaccaaa

SEQ ID NO: 214550 - DNA, 329 bp, Homo sapiens
aaatgggggagagtgattccagcattatttttatccctaccactaatgcttggctcaattcagctgcatgacgtggtggagaaagagctaaattatgagaaaaaagatagaaaggacaattatattttcttccccttcaatatttgtactgggccttacagtaacctgaaattcctgattcttagtcaacctgaaatttacaagtaagttgggtcattaatcttaaccatgatgctcaccaatatggatgcaccttgaggaaatcctagcattttgtgcttagagttggactctgaagaaaatagccattccctcgtgctgcgacagtt

SEQ ID NO: 214551 - DNA, 402 bp, Homo sapiens
agtgacgcttggaagatgttagtttctctgcccttccctctgcaagtgtcacctccccttgatcctttctgctctgtactcatttgggatacttggaaggactgtggtcagagcactgtgctgcctagttttagctttgctgatgtggtcaggaaaaatcaacattccacatagggtatggccagaaaagaaacatcccattgccactaaatccaaagtgatggcatggtgctccttgaataatctttccgtagatatccaggatggatggaagaccaggcagggcaacttggctgtcttcggaaaatttctggtttaattggtttttcctcagtgttaaataacagagcctgcttaaaggtccagtgaggactaatggctttacttccattgaacggcttc

SEQ ID NO: 214552 - DNA, 827 bp, Homo sapiens
taagggaatgaggaaggcttgggaatcgagggagtgggggtgttgtgcagaatccattccttattcaatgtctgcaccgggtgttatgtaattttagtggcacatgggtgcaaagcctagactgggcttctcccctcctttgtttatataacttttgggtgagttttgcaaggttgtctcttttttttcctcctccctaacctgatggaggttggtgctttggaaaaagcaaagcgacctgggctagtaatcttttggagaggtgtcatcattgtctcctttctggtcattatgtaggcatgtatgactttgtatgtgtactgttagagctcaaggaagacattaaggatacacagtttgttgactgcactgagcggttatttttaacatttctgcgttaccaatatcgaatttcaaacttccatttcaaaggacttaaaatttacacctggttgtgtgccttgcttgtctgaacagaatgcttgcataaataatgagattgttgcttgggcgttgagtagcagaaaatttctatccaaccaccaaagactcagaaaccattgagaaccctaataataatttaaaaagccatacccaatgttatgtgtgtgtatacttacatattcacattcaaatattttcagtagtattttccatctgttatcaggggggccacaaccagaagcttgttggccagcattggagttttaggcttccaggctacctctagcacactggtgaagtgttaagaggcgtggcagatttgaatcctagttgctgcattgttatgcaaaatgagacacactttttctttgaggaatctaatt

SEQ ID NO: 214553 - DNA, 509 bp, Homo sapiens
tcaagcacacccacctttgcttttagttaatcagtcacatacttgacacagagcttgggcctggaaacccaaagaagtgcctgcctcagtgtggagagtctggatggacactgctcagccaactgaccagaattgacggatgaaaggcaagaagttgctctgctggagggtgactcctggaagggcctgcctagatagaggacatccaggagcaggtcctttttgtctaggggacaggagacaaacctggaagttaaaatgatttcctatctcaacacacggtgcagagaaagcagatttggggcatccagtgcccactccttctgtattgcagagaactgtccatcagactccacagcagcctttagctttggagggcctgggccttactgggtgtcagcagcctgttgtctatctgtctatcctgctatctatcatgtatcactctctcatctcctgtgtttccatccaggtctgcacgaataccaatactctatgctttgtacttt

SEQ ID NO: 214554 - DNA, 1104 bp, Homo sapiens
ttaaacgatgaacgtttctatgggcctcctaagtcatcttatgcctaaaaataaatttatcagcactagatattagatttgaaataagtcattgttcattattgatggttgtcagtttctccttcctttttgggcatgcataaagacacacttggtgctgattccatgtgatttatggaatgtcattttcacaatgatctttctagaatttgtgtgtaaggttgtgatatccatgtacagctgtaactatatatacttgtctgttagcattcagtggaccattatcattactatcatcacattacctgggcttcaactgggcccaagtactctatatactacctgtaataggtttttccttgaaatatccttatctttcactctacagctaaactgataacaaggtcagtttctttatgtcattttattcccatacctaaaattgcatctatttgtgagctttctgcctttttgtaacgctcagtgcaccaaaagcgtctgtttttagtgcagtcacataatatataagtgtgggatacccttctgcagcttcagtgagacaaatcactttttaaaaaacattccattttattggcatcactagatgtttttaggaccctgtccttttcacttttctgtaggctttcttttttttttaaatggaagatgattattttgtttgttcttgatttcctgttattgaaaacagcatcttccttcttgcaatggccactaatagcacacaatgcgttttctttgattgtagcagaaaatgcaaatgataattgtatgttgggctcgatgaggccttgaacatagctgagtcctaatcagatgtatatactctgatgattacaaataggtacatgttgggtttctgtgatgtttcaaaaatacaattatataattatgatgtaaactctttaagaattcaattataaaagcaataatcaggtaacctctatttggagctgctacatccaatattgtgactgaaaattaactaaagagagataatttttcaaatgatgtataatttgcaatattttcccttgcaactttagcaaatacacatattccaagtaaaactttatttagtcccat

SEQ ID NO: 214555 - DNA, 515 bp, Homo sapiens
atcagtctgaactcttggagttgtatgacattgctggccactatattataattatcatcatcattatccttgttattactatcaatttttaaaaaggccatggcaccccagaaggtacagatcctctgaatgctaagattgtgtttttacagttgtctagtataggacaggcttctcatgtggaaaagaggattcagtgtggtatcaaaaaattgattggaaggcttcctctcttactctctcatacatagacattcacaaacaccatctttgtttagtaaactgtggagactcttccaaaagaaaatagacactaatttttggagaatccattcagctttcacaggcctctaaatagcacaggtgttagaattactaaggataacgattacattaaccaggagcaaaactaaaaatacatcgttctactttcatacttggaaatatcggccttttgatattacaaaaaggccaattttgccaggtccttcgaaatttcaaagaaagattcagta

SEQ ID NO: 214556 - DNA, 197 bp, Homo sapiens
gacagagcgagactccatctcaaaacaaacaaacaaaaaaaacccacatcttttgattcttaaaggacagtgactatttgcacaactcagtatggaaaataaggttttgcccagcgtgccattttttatcacgtgggtgcctttacactcctttttctacgatgctttctccaagttcccttggaatattctctcat

SEQ ID NO: 214557 - DNA, 168 bp, Homo sapiens
ctttctctcactccttctttccctcccttctttctctctctcctttctttctctttctttctctctctctttctcactccttccttccctcccttctttctctctctcttctttctctttctctctttctctctccttccttccctccctcccttctttctctctctc

SEQ ID NO: 214558 - DNA, 897 bp, Homo sapiens
tgcagagaacaagtcctttctagcagtggctcaggactactgttttgaaaagtctaattactttgcttctctgaccttgattgctacctttaaaagaagctttaaagcctgtttggtctcctaaacttgccaagccctgctgcctgggtctagtcagtaatcttgccctgcacagacctcttactgtctgaccacaggccttagctaaccccatttgtgtcacaccccactgctatgcctcctttggaaaggcctatctaagaagtagctccttatataaatggaaggacactaaagactcctgatggagtaaacacagaggagataaggaatcaagggtggagggattggtcttggacatggtaaatgtagagatagagactatctagtcagaaaggttaaacttgatagtcttcattctacaaagtaggatgcaaattcttttcaaagaggaactgtgaattgtatagtatgtgaattatctttcaataaagctatttttaaacagcagagaatgtaagagatggactagaattaggaaagtattgggtttaaaagtcacattcatattacgatggcaattcctggttatggatctctttaatgatgtttctatacagagtgaatgtagtagtctgtatgtttctctcttcctttttaattgaaatattagattgctccaaaggtttccatacaacctgttcaactttctagcagtcattccagaaagggaacaaatgaagtgtaaccatatatttactaatcaacaaatgcaaacatgatggctatattaaatattcaaatgcataaataatatttatattatatgtgttaggctgtacataacagactaggcaactagcagtggcttaaataaaaaatatttattattaaata

SEQ ID NO: 214559 - DNA, 412 bp, Homo sapiens
tggctttgtaattttatatttctttctaggctgatacattgagtttatttagttagaagtgtatttccacagactgattatctgtttttttaaatgcttcttcacagttgtataccacttaaggtatgtagctttgtagccaatctaaattggaattgggtttttgttattgtcgtttggtacattggtcactttataaatgtttaactttttgttttgagttaattatagatttgcatgcagttttaagaaataatagagagaggccgggtgtggtggcttatgcctgtgattccagttacttgggaggctgaggcaggaggattgcttgaagcccagagttcaaagatgtagtgagctgtgatggtgccacagcactccagcctgggtgacagtgagaccccagctctac

SEQ ID NO: 214560 - DNA, 523 bp, Homo sapiens
aaggctttgctcttgaggagccagctggggaaaccactggtaggcatgcctgggagccaggctttgtcctagcgcaggatggggggtcatagagggctgaggactgcgtgaggatgagcagtcaggaagtagagccatgtgcacctgggacaatcaggatcttgccacagcaggagggtcagagaagcaagtcccaggtagatgtggggtgagggaatgggatggatatcaaacaagggtgctgctgactttgaccagcctgctccagaaacctcactaccctcctgtcgcctctgaagtccaggcacctcagtccaccactgaagagtttttcaggatctggcctctgcctcctctcccatgtgtttgttctccacaacttttgcccctcaattctagctcctagccaagtggctgttcctcacttcagattcagatgtccatcctcagctccaagtttccacagaggtggctcggccaggctgctgtgctcagtgttagctctcagcacaggtggtgagcc

SEQ ID NO: 214561 - DNA, 369 bp, Homo sapiens
tcatgcaaagagagcctgacgaggcagaggaaagatcatggcaggacttctgtcttggtggacagatgtaggatgtggataccaaagaattgagtagatctgtcacaaagcaatggaagatgacatttgatatgggtgggccaactgcgaataaaaagaagatgttcacttgggagatagaaaagagaagttctagtcatgacttttccaatttacttgctatataaccttgaataagtaccctctctgaattcctgtctccttacctgtggaatgaagacaaaaattcctaaggctctagcaagattgtcaaacaaaggcctatatgtgtgagttgcaaataaaaggaaagcaccttctgaaaaaaaa

SEQ ID NO: 214562 - DNA, 360 bp, Homo sapiens
tgagatcatttaaactccaaattttaaataagaaccacttattgatcatgtatgttctttttgtttattcaacaaatatttactgggcacctcctatgtgccaaacactgtgctaagtactttacatgcattgtcctgtttaataccattaatccccaagacagatactcccctcattttacagctgcaattgcacagccagcaggtggcagaaccaagatttaaactcatatttctctgatttcaaagcccatgtctttaaccagtaaacttaaatggctttcctaacacttgaatacttagtcttttaaattttagcatattcttagtctgggcaacatggtgagaccctgtctctac

SEQ ID NO: 214563 - DNA, 372 bp, Homo sapiens
  misc_feature (110)..(110): n is a, c, g, or t
  misc_feature (113)..(113): n is a, c, g, or t
  misc_feature (117)..(118): n is a, c, g, or t
  misc_feature (123)..(123): n is a, c, g, or t
  misc_feature (125)..(125): n is a, c, g, or t
  misc_feature (127)..(128): n is a, c, g, or t
  misc_feature (130)..(130): n is a, c, g, or t
  misc_feature (152)..(152): n is a, c, g, or t
  misc_feature (159)..(160): n is a, c, g, or t
  misc_feature (162)..(162): n is a, c, g, or t
  misc_feature (165)..(165): n is a, c, g, or t
  misc_feature (172)..(172): n is a, c, g, or t
  misc_feature (178)..(178): n is a, c, g, or t
  misc_feature (180)..(180): n is a, c, g, or t
tctattcggaatcagacatgaggcaaactcaatgttacacccatagagacaaagtatgataaccgcccatctgctaggtcaattattacttgcggcgtaactcagcaaanttngcgnntatgnantnntntgcctcagactcatggatatcnaccccgnntncgntatcttnctcatngngtatctctgtatgaaagaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggc

SEQ ID NO: 214564 - DNA, 293 bp, Homo sapiens
taattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggc

SEQ ID NO: 214565 - DNA, 555 bp, Homo sapiens
gccctgtcgcccaggctggagtgcagtgatgtgatcatggcgtactgtagccctgaattcctgggttcaagcgaccctactacctcagcttcccaagtagctgggactacaggcaagcaccatcatgcctggctaatttttaaatttttttgtagagatagggtctccctgtgttgctcaggctggctttgaaattctggcctcaggtgatccttcactttggcctcccaaagtgttaggattggaagcatgagacactgtacccggccttctttatatgatcctcaaatgagtttttggggagcaaaagtgtgggagggtagggaagagaaaggttattttcttctatttcaagtttgtggttaaatggagacactagaagaggtgtcagtagttcaactcgaaaatggtataagtgccagttattgggttaatgtgtttataatgtcctcttacagtaaaattatgtgtagaatatacatatgtaactaacctgcacattgtgcacatgtaccctaaaacttaaagtataataataaaaaaataaaaaataaa

SEQ ID NO: 214566 - DNA, 714 bp, Homo sapiens
cgtggtgggttcacgcctgtaatcccagcactttgggaggccgaggcaggcagatcacctgaggtcaggagtttgagaccagcctgaccaggagaaaccctgtctctactaaaaatacaaaattagccgggcgtggtggtacatgcctataatcccagctactcaggaggctgaggcaggaaaaccgcttgaatccaggaggtggaggttgaggtgagccgagatcacgccactgtactccagcctgggcaacaagagcgaaactctgtctcaaaataaataaataaataaaaatttaaaaaattgaaaaagtgggaaaattatttaaagttctaatttatttctgtacatttccaagctcctctcactgccctacagcataaacaaagtcagaatctcagtaatttataagaagaaaaataatagtggacaatatctgaaaaaatggactgaatgagaatcattttgaagcaaaggtcttggacaaactgcaaaggtttggcagatgcctagcaaattagtgaataaccaccatgacctctccaggtgtaactaaatcctggaagtgtataaacatagaaacagtcctttatgacaaaaaaagatgagttacttttgaaaagtacagaaataaagctgtcagcttcacagtgccatatggatgctcttttccagattaaccaaattacttaacatcagaccaaaattaaacca

SEQ ID NO: 214567 - DNA, 253 bp, Homo sapiens
ctgaatctataacaccatcacacaatgtctgcaaactggtgctcaaaaataaaagaagccaaacttagagattaagtgaagcatgctgcactttgaacacaatgagcaaaacagacttcaaaacaagtactttcaaggagtgcttgtacaagtctaatcattttaaatccacatcaacatctttctaaaggcaacacaatcagcacttgactattttcctcttcctaaaaaaacaaaaaattaactataatta

SEQ ID NO: 214568 - DNA, 364 bp, Homo sapiens
agcccagggggcatgaacaaaactcaagcagaagcactgctgtccacagaggtttctggctggcaaagcaacaccctaaggatcctatgacaataggtatatatgtataggcagaaacatagtatatattggttttagtactatccatggtttcaggcagccaccaggggcttggaatgtgtccctgtagataagggaggaggattttaatagctgaaaacttctccaatcttggggaagataggggcatttgggtacatgaggcttaaatgtgcccaaataggtttgacttaaagaggacttcactgagacacattataatcaaattgtcaaacatcaaagataattttgaaagcagtaagag

SEQ ID NO: 214569 - DNA, 773 bp, Homo sapiens
ggtctcaaactcttgacctcaagttctccacccgccttggcctcccaaagtgctgggattactagcatgaaccactgcgcccagcctcgtatctgtgtcctttctttctgggaccggaagaggtttcaggttcccagtggaaattccctgcccctcaccttgaatcagcctttggccaaagagccttggagaatgatatttaatatttaaaaaccaggaactgagaactgagtgtgctcattgctatggggatatcattgctcctgggctccttgggtgcagagacccagggaaatagatgtttctgtgtatgctttcacactgtccctccctctcaagcccaactccacaggatgcttcctcaccttcctcttgccatctagtatcacgcttctgtagtgagaatctgctgcctacagcaacaacatattgacacatccattctcttctataggacacaaaaaaaggtttcagaaatttttacgttggtgctgccacatccacagcacgtcctaatcctacgggaaacaatccttgcttatcagaggtgcatatctaaattcaatagcttaccaatatcttcttgggagtaggccaaaaggaaacagaaaacccacattaaaaaaaaagtttcttttcgctaaacgttttcctgaagccgaatctgaagtggggaggacgtcagtcgtcctcgtcattctcgttgaagtcatcgtcctcctcgtcgtcctccccgacgtaggacaccggagtctccagcctggccgcgtgta

SEQ ID NO: 214570 - DNA, 857 bp, Homo sapiens
tatacgtgtggaacagaataatcacaccatctcactgtatcatagcacagattactcattggtaacagagagaagggagcttcaacagggagccatctggtgaatacaccttctccatccttggcctcccaaagtgctgggattactagcatgaaccactgcgcccagcctcgtatctgtgtcctttctttctgggaccggaagaggtttcaggttcccagtggaaattccctgcccctcaccttgaatcagcctttggccaaagagccttggagaatgatatttaatatttaaaaaccaggaactgagaactgagtgtgctcattgctatggggatatcattgctcctgggctccttgggtgcagagacccagggaaatagatgtttctgtgtatgctttcacactgtccctccctctcaagcccaactccacaggatgcttcctcaccttcctcttgccatctagtatcacgcttctgtagtgagaatctgctgcctacagcaacaacatattgacacatccattctcttctataggacacaaaaaaaggtttcagaaatttttacgttggtgctgccacatccacagcacgtcctaatcctacgggaaacaatccttgcttatcagaggtgcatatctaaattcaatagcttaccaatatcttcttgggagtaggccaaaaggaaacagaaaacccacattaaaaaaaaagtttcttttcgctaaacgttttcctgaagccgaatctgaagtggggaggacgtcagtcgtcctcgtcattctcgttgaagtcatcgtcctcctcgtcgtcctccccgacgtaggacaccggagtctccagcctggccgcgtgta

SEQ ID NO: 214571 - DNA, 1009 bp, Homo sapiens
tgaaggcatgcagaaagcagtctggagcccagaagggacacaccagcacagtctggtaggctacagcagcaagtctctaaagaaaggctgagaacacccagaacaggagagttcaggtccaggatggccagcctgttccggtcctatctgccagcaatctggctgctgctgagccaactccttagagaaagcctagcagcagagctgaggggatgtggtccccgatttggaaaacacttgctgtcatattgccccatgcctgagaagacattcaccaccaccccaggagggtggctgctggaatctggacgtcccaaagaaatggtgtcaacctccaacaacaaagatggacaagccttaggtacgacatcagaattcattcctaatttgtcaccagagctgaagaaaccactgtctgaagggcagccatcattgaagaaaataatactttcccgcaaaaagagaagtggacgtcacagatttgatccattctgttgtgaagtaatttgtgacgatggaacttcagttaaattatgtacatagtagagtaatcatggactggacatctcatccattctcatatgtattctcaatgacaaattcactgatgcccaattaaatgattgctgtttattagaacatgagaatcattattagtattcacatgtttcacttgctctgtactaatatagtctctccaaatggaggaagttagatagatggaataagttctagtagttgatagtacaatggggaaattatacttaacaataattcactgtatattccaaaatagctagaagagaattgtaatgattccaacacaaaaaagatgaatgttagtttggatgcatatcccaattaccctgatttgatcattacacattatatacacgtatcaaaatatcacatgtactacaaaaatgtgtataactgtaatatgtgaactacaaacttactggaaataaatttttaaagttttacacacataaacacatacgttcacaca

SEQ ID NO: 214572 - DNA, 746 bp, Homo sapiens
cttatcccacatttaactttcctatcaaactcccaaaagacacaaacatacctgagaaatggtgtcaacctccaacaacaaagatggacaagccttaggtacgacatcagaattcattcctaatttgtcaccagagctgaagaaaccactgtctgaagggcagccatcattgaagaaaataatactttcccgcaaaaagagaagtggacgtcacagatttgatccattctgttgtgaagtaatttgtgacgatggaacttcagttaaattatgtacatagtagagtaatcatggactggacatctcatccattctcatatgtattctcaatgacaaattcactgatgcccaattaaatgattgctgtttattagaacatgagaatcattattagtattcacatgtttcacttgctctgtactaatatagtctctccaaatggaggaagttagatagatggaataagttctagtagttgatagtacaatggggaaattatacttaacaataattcactgtatattccaaaatagctagaagagaattgtaatgattccaacacaaaaaagatgaatgttagtttggatgcatatcccaattaccctgatttgatcattacacattatatacacgtatcaaaatatcacatgtactacaaaaatgtgtataactgtaatatgtgaactacaaacttactggaaataaatttttaaagttttacacacataaacacatacgttcacaca

SEQ ID NO: 214573 - DNA, 434 bp, Homo sapiens
  misc_feature (352)..(352): n is a, c, g, or t
  misc_feature (421)..(421): n is a, c, g, or t
  misc_feature (426)..(426): n is a, c, g, or t
tgaaggcatgcagaaagcagtctggagcccagaagggacacaccagcacagtctggtaggctacagcagcaagtctctaaagaaaggctgagaacacccagaacaggagagttcaggtccaggatggccagcctgttccggtcctatctgccagcaatctggctgctgctgagccaactccttagagaaagcctagcagcagagctgaggggatgtggtccccgatttggaaaacacttgctgtcatattgccccatgcctgagaagacattcaccaccaccccaggagggtggctgctggaatctggacgtcccaaagggttctcaccaggaaatcttcatggggaagttngggggtaggagggaggaagcttgcagggaaaaacataaggaacagccttcacctttgggagggtttttnggtgncttttccc

SEQ ID NO: 214574 - DNA, 329 bp, Homo sapiens
agctggggctactgccaccacattcatctaattttctatttttgggggagacagagtcttgctatgttgcccgggctgttcttgaactcctggcctcaagtgatcctcctgtctcagcctcccaatgtgctgggattacaggtgtgagccaccacacctgatcctcttctgctgctggttaatagttacacgcttttcctaatgctaatcactgacaactactgattaatccacacattttatgtgtgcctacttttagaaaacccagccaaacatcataccttcctaggtgcaagaatcctatttccaacttctaaaattccctatgg

SEQ ID NO: 214575 - DNA, 480 bp, Homo sapiens
cgaagaagctgaaagttttgctccaaatgccattgtttatccatttttgaccacctgatctgttccattagcttcaaaagatgccttttcatttgtttcgttttgccttcgatggccttccgcctgccgcaagcaaccctctagaatatgggcctgtgcttggcttttctacacaaacatgagcagccttcaattactgggggacattcatttcctccttccaactagagagtgaggagtgtcccggggagagtgggtccttgagctcctctgggccttgcttgggacttggtccaggaggttatgggaagaaactggtttagaagctgacctcatgggttcgctattcttatgtaacacttaggaagagcagagacccacgcgattcagtcccagagcaatgttgcggtcaagagaacacagtccagctaccaacagttatttcaaaataattcaagctctttgtttatatttctgaaa

SEQ ID NO: 214576 - DNA, 638 bp, Homo sapiens
tttaactgtacatagcacatatgaaagcacttttcacagctattgttcatagaacatgcttataagccagaaccataaaaccttaattataatacatcaactccatacttccaaagaacataccttcccacaggaatatcgaccagtacttttcatcgtacattcagtcgttcatcgtacatagcacattacagtcaaataaatcctcgtcaccacagatatccccccccagatagtggtttctcgctcaccatcctccgtgaaatcaatatcctgcacaagagtgctactctcctcactccgggcccaaacacttgggggtagctcttctagtcagccagaaagtccttcagcctcgccaggagcagtggctcatgtttgtaatcccagcactttgggaggccaaggcaggcggatcacttgaggtcaagagtttgagaccagcctgggcaacatggtgaaaccctgtctctaccaaaaatacaaaaattagccgggtgtggtggtgcatgccggtaatcccagctactcggaggctgaggcaggagagtcgcttgaacctaggagacagaggctgcagtgaaccaagatcgcatcactgcactccagcctgggcgacagagcaagactccgtgtca

SEQ ID NO: 214577 - DNA, 547 bp, Homo sapiens
cagactaatttactagagaggctcacagagctcaaggaaacactgatgtttactagtttattataaaggatattacaaaggatacaaataaagagatgcatagggcaaggaaaggggggagggtcgcagatccccccccaccctccccaacccaccatcctccaagaacatccttgtgttcagctatccggaagctccctgaacactgtccttttgggtttttatggaggcttcattactaggcatgattgattaaattattggccatgagtgaccagcttcacagcccccctccccttcgtggaggttaggaggtagggctcagatttccagccctctaatcttgccttggtctttctggtgaccagcccccatcctgaagctgcctaggggctgccaaccattgatgataactcattagtatacaaaaagacatcaccttgtagagactcttaagtattttaggagttgtaagccagaaaatgaggtcaaagaccaaatatatatttcacagtatcactacatattttaagacccaggaaaagtt

SEQ ID NO: 214578 - DNA, 188 bp, Homo sapiens
tccaagacataacctgatggccgtgcaagatttcttaatcgactgtggaccgtgagagtctgcatctcattttaattaagatgggaaaagaaagaacaaaagagcaactcccaggttatagagaaactggattttagtgtaatattgaagtgtagcattgctaataataacaaacctttcccctgcca

SEQ ID NO: 214579 - DNA, 835 bp, Homo sapiens
taaacagtaactccccattctcccttcccctagtgcctagtaaccaccattctattttctgtatctgtgagtttgagtgctctaagtacctcatgtaagtggaatcatacagtgtttattctttctcgtctggtttatttcacttagcctagtatctttaaaattcgttcatgttgtagcatgcatcagaactcctttgaaaggctgaatgatattccactgtatgtatataccatattttatttatccatcaatagacatttgggttgtttccaccttttggctattgtgaataatgctgctatgaacattggtgtacaaatatttgttcaagtccccggtatatacccagagtggaattgctggatcatgttctaattttatgcctaatttttttgaggggacaccatactgttctgcacagctgctatgccatcttacattcccaccaacaatgcagcatgttccagtttccccacagccttgccaacagttgttattttccgttttttgttttttgttttttttttgataatacccaccctaatgggtgtgaagtgatatttcattgtggttttgatttgcatttttctaatgattggtaatgttgagcatcttttcatatgcttattggccatctgtgtattttttttttttttttggacacatgtctattcaagtcttttgctcatgttttaattgggttgttgagttttctggttgttcaattttaggagttcttcatatgttctggatattaatctcttatcagacacatgttttgcaaatattttctcttgttctgtggttttatcttttaactttggtgtcttta

SEQ ID NO: 214580 - DNA, 643 bp, Homo sapiens
acgtttactgctccttaatagggtagaattctaattttaattattggtccaggaggaattttaaaagttatgggactggctttagagttttaaatttgctgaaaacagcagtcttagagttgtgttcaaaatgctttgaagtttgttaggcaatattttaaatattgaatttctgatttccaaacttcatgaatgtgtggaagaaaattggaagtttaaattgcattcaggtgaagatttagataattagaacgctagaagaagactatgagtgatttcatagtactcataaaaaagtgagttcaacttgcccacttcaaactgtagactaagatctgtttcctttgaaaactaaattttattttaggaaaaaatgccatagacagtgtcagattgaaggactaccacccctgggctcagtggctcacacctgtaattcctgcactttgggaggctgaggcaggtgaatcacttgaagtcaggagtttgagaccagcctggctaacatggtgaaatcctgtctctactaaaaatacaaaaattagctgggcatggtggcaaacgtctgtagtcccagctactcaggaggctgaggcaggagtatcacttgaacggggaggcagaggttgcagtgagctgagat

SEQ ID NO: 214581 - DNA, 386 bp, Homo sapiens
aactcaccacatcacatacatattcataagactatcagtgatttatcagcagaaaccttgtgggccagaaagacttggtatgatatagtaaaagtgctggggacaaaacaaaaacaaaaacaaaacaaaaaaaccgccagccataacataaataccataaccaacaacaatatccttcagaaatgaaggggaaacaaagacttttccaggaaaacaaaagctgcaggagtacatcaccattagacctgccttccacgaaatcctaaagggaactcttcatgttaaaataaaaggacacaagacagcaacatgaaagcatgtaaaagtatgaagctcactgataagggtaaatttatagataaataaaaatatggtaattctgtaat

SEQ ID NO: 214582 - DNA, 409 bp, Homo sapiens
aagatgaattttgtttgatgctaagaaggatgaatttaggggacagagggagtgtggaaacagactctaaagggattttgtggtaattcctaaaggatataaaaaggacagacatgaggctgggtgcggtggctcacgcctgtaattccagcactttgggaggccaaggcgggcggatcacttaaggtcaggagcccgagaccagcctggccagcatggtgaaacctcgtctctactaaaaatacaaaaattagctgggcatggtggcgggtgcctataatcccagctacttgggaggctgaggcaggagaattgcttgaacccagtaggcagaggttgtagtgagctgagatcgtgccactgcactccagcctgggcaacagagtgagacttggtctcaaataaaaac

SEQ ID NO: 214583 - DNA, 536 bp, Homo sapiens
ttctttttttttttttttttttttattgagacagagtcttgctctgtcacccaggctggggtgcagtgatgcaatttcagctcactgcaacctctgcctcccgggttcaagcatttctcctgcctcagcctcccaagtagctgggattacaggctcctgccaccatgcccggctaattttttgtatttttagtagacatagggtttcaccatgttggccaggctggtcttgaactcctgacttcaggtgatcctcccgcctcggcctcccaaagtgctgggattacaggcatgagccatcacttctctttccttaccttggagaatggtaggcagccagagaaaccctgtgagaaaccaaatcaacctgatgtttccaagctagtttttctacagcagcttacaccacttttcccttatcttcgcctgtaccttgtgtgttaaccacactctcaactacttactcttcactgaacacagcacattcttttatctctgcaggccttcacgcctgccatgtattgctcctttcattat

SEQ ID NO: 214584 - DNA, 486 bp, Homo sapiens
gtatctatagtcactccgcaagagaacctcatctcccaccttcccaagttagatgtggctgtcagatcaacagcgacattagattctcatcagaggacaaaccctatcgtgaactgtgcatgtgagggatctaggctgcacacacctcatgagaagctaactaatgcctgatgatctgaggtggaacagtttcaccccgaaaccatcccccatctccccttccccatctgtggaaaaaaactgtcttccacgaaactcgtccacggtgccaaaaaggtgggggaccgctggattagggggaatgtctgaagaaaaggaagtcctagtggtgaaaaaggcaccactgaaggcaaaaatgttcaattctttcctcaaaacaccaaagaaactaatataacttttcttgcagctattctggtaaacgaaaaacccttgtttttgaaataagatatatctgttctttaaaaatgcttattcttttataat

SEQ ID NO: 214585 - DNA, 510 bp, Homo sapiens
tggggaaaggacaccctattcagcacaaatggtgctggggaaactggcaagccaaatgtaagacaatgagaaactggatcctcagctgtcaccttatacaaaaatcaactcaagatggatcaaggacttcaatctaagacctgaaactgtaaaatttccagaagataacatcggaaaaaccctagtagacatgggcttagacaaagttttcatgaccaagaacccaaaagcaaatgcaacaaaaacaaagaggtggaacttaattaaactaaagagcttttgcatggcaaaagcaacagtcagcaaagtaacagacaactcacagagcgggagaaaatcttcacaatctatatatctgacaaagtactaatatccagaatctacaaggaactcaaacaaattagcaacaatccaaacaaaaagggggttaaggatatgaacagacaattctcaaaagaagatatacaaatggccaatgaacatatgaaaaaatgctcaacatcaccaatg

SEQ ID NO: 214586 - DNA, 414 bp, Homo sapiens
ctgaaacatggaacagatacagaaaaaaatgaattacagatttttttaaatgatggaaatactatttttgtgcaatttactgacatttaacattctgtaccatgactctgtctaccagagctgaagaccagtaggctggaagtttaacactgaaatattcatctcatttttctcacttttttttattaacagacatgatatcctcatgtattcagaactgcatccccagtaactacccaaggtgataaggaaaaaaatgcgtttgttttccagaaaagagaaacatgacccaaagggaatggaacagagaatcacatttaaataggaatataacatttctgagaggagagagagagaggtctattatcatgctgagtttcaataaaagtttttattttaatcacttgggtagaa

SEQ ID NO: 214587 - DNA, 639 bp, Homo sapiens
tttctgaatagctcttcgtagaaactaaagaccagttttgacttagagaagtaaagtttgcctgattttcaccatactcaccttagtgtaacaagctctcctctaagttttaagtcttgagatgggattttattgtgaatgcttgacccaagttccttttgttctcaggcccttattatttaaggcatggagaatatctgaatattttatctaagccagtgttgctgtattcctctccagctaagtaatttgaattgtcagcggttgtcagattatactagtttgttttgtctaatttttgacacctcaccccttaatgaagaatgactcagtaaacagaaaaataccaacaaagagagagagaggaaaaaaaaaaacaactaatacctaaaatctatttaactattccccaggtaatcatgagttttctgtacttacataccccttctctgcttatgtcccttgtttacagaagcacttcggttagtgactctcctgagaacaaggtatttctgtgcaatgacagagcttcctaacttgataaattcaggccagatatctcagactgcaataatgatgataataataataattgcagttaatatttaaacagtatttactatgtgccatgtactgtct

SEQ ID NO: 214588 - DNA, 599 bp, Homo sapiens
cacagtggcttatacctgtaatcccagcactttgggaggccgaggtgggcagatcatctgaggtcaggagtttgagaccagcctggccaacacggtgaaatgctgtctctactaaaaatacaaaaaaaaaaaaaattagccaggtgtggtggcaggtgcctgtaatcccagctaacttgggaggctgaggcaggagaatcacttgaactcgggaggcggaggttgcagtgagctgagatcgtgccattgcactccagcctgggcgataaaagcaagactcctcctcctcctcaaaaaaaaaaaaagcaggataattcaacatacaaaacccagtagcatttgtatacgctaacagcaaacaatctgaaaaagaagttgagtgcaatcccatttccaacagctacaaagaatgtaaaatacctaagaatcgatgtaaccaaagtgaaagatctatacaagaaaaactataaaactgatgaaataaattgaagaggatgcaaaaaaatggagagatatcccatgctatgtattggaaaaattaatattgttaaaataacaatattacccaaagcaatttatagatttggtgcaatctctgt

SEQ ID NO: 214589 - DNA, 569 bp, Homo sapiens
agctacagatttagtcattcatttcatgatacatgttcatcatataatgaaatcaagcaaaatatccatgtcatgaatcaaatcagactgactttgtcagaaaaaggtctggcttgaaaattcaggttgtgttactgaattttgaacatacaaaaatcattaaaaaccatcacagaacaccttttgtaaatgattagtgaaaacagtcaagatttaaaatttcccttatttaacttataacaagtcgcagtcatctgtggcaaaaacaagttatttaggaagcaagttaggttgatgaaaggcaagatattctttcaatataggtgtgtacgtatattgaactaaggtatttggcttttggcagaattaagaatcaaataaaattctttagtgttaataatattaacttttactaggattacgcttttcctatagaatgttatcctgctaaaaactaactggcagatatctagaacctaatttattttctgttaagaggtagtaaatatttcccatttcataagatgaagtagattcatatttgactgtatttggagtaaatatttcac

SEQ ID NO: 214590 - DNA, 470 bp, Homo sapiens
agatactcaggcaggcccctgactttgcgctccaaaggaattggactttatcttgaaaagtatgggggccatgcaggtatcttgaatgatataatcaggcaagtagaaaataacattgataagggcatgaacacagatatattctttatctcttgctggaaagtgagttaaataaatcagagatgtttaagttcattcgaaattctgatttttttcatatgagattttgttttgagggcaagatgacatccatttaggccttggggagaatgcaattacaggagtgttttttttttttttaatattcttatgaaacttttcaaacttatacaaaagtagtataataaactccatgtgtccatcatctagttctaacaagccatactttttttggtcatatttgtttcagcattttccccccgaattattgtaaagcaaatcataaacattatgacgtttattgctaaaga

SEQ ID NO: 214591 - DNA, 517 bp, Homo sapiens
actactcttctccttcatttctaatcatctgtccgctcaggtgtcatctctccagttttgaactagttgctatttgtcttcagagcactctaaccatgtttttttctctatctctcccgttacactgttaaagtctttattatcaagcttcattgtaattccagcctctagcccaatgtctggcccctactaaataataaatgggccagtcatggtggctcatacccataatcctagcaccttgggaggccaaggtgggtggattaattgagcccaggagttcgagaccagcctaggcaacacggtaaaaccttgtctctacaaaaaaatagaattatatatacccaaaataaaggaaattaaaaaaaaacaatagctgggtgtggtggtgcattcttgtagtcaagaggctgaggtaggacaatcacttgagcctggggaacttgaggcagtggtgagttgtgacggcaccactgcactctagcctgggagacagagctagaccttgtctccaaag

SEQ ID NO: 214592 - DNA, 590 bp, Homo sapiens
ggggggcctgccgactcagccccccctccatccttgaacgcagattatattcaacgtccatattgtatgagaaggtttaatgaaagcgcagctgagcgacatactaatttctgcaaggatcagtcttctcgccgagtctttaatccagctcagacagcagccaaattggcatccagagctcagggtagggctcagatgggtccaaaaaaagaaccaactgttaccagtgctgtgggagctttgctgcagaacagggtcctggtggccacgaatgaagtcccaaccaagtcaggattagctatggaccctgcttctggagcaaaactcagacaaggatttagtaaatcttctaaaaaagattaactcctagaagccagactgcctccctgaaacccatcagcctggatggttgcgtacccgagaatgccacctaaggggaaggaacggtagatgtgatgtctgtttttacacccttgattcttcttgaagcatcacttagaacaagtaaaacttgcttcagatttttatttactccctttgaagttttcaaaacaaaagcattaaacacatcaacctgtataaaaaaaaaa

SEQ ID NO: 214593 - DNA, 569 bp, Homo sapiens
tgacaactttgcctattattgtgagtttctatttaaaaaaaattcaaccatttactactgtggtagacagaaaaaatggccctttaaacatgttcatgtcctaatcactggaatctgtgttactttacatggcaaaagagactttgctgacgtgattaatgttaaggaccttgagatggggaggttaccctggatgatctgagtgggcccattataattataagtgtccttagaagtggaagagagagagggaagaggatcagagaaagagatggtgattagggaagcagggtcagagagatgtaacatagttgactttgaatatggaggaagaaggctaagccaaagaatttgtttggcttctagaattttgaaaagacaaggaaatatattctctcctggagcatccagaaaggtactcagccctggtgataactttgattttaatgcagtaagacctaagtctgagttctaacttgcgaaactataaaatgataaatttgtgttgttcaatgccaccaaatttctggtaatttgagagagcagcaatagaaaacccatacatatac

SEQ ID NO: 214594 - DNA, 1122 bp, Homo sapiens
aagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaagatgatgatgaagatgatgatgatgatgattttgatgatgaggaagctgaagaaaaagtgccagtgaagcaatctatacgagatactccagccaaaatgcacaaagtcaatcagaatggaaaagactcaaacatcatcaacaccaagatcaaaaggacaagaatccttcaagaaacaggaaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagtaa

SEQ ID NO: 214595 - DNA, 358 bp, Homo sapiens
actgtgcggcgttttacagcaagaacactctatgaccatcacgcggtttaacgggccttgtttacatattaaaacctcttctgccgccgttctttgtcttttattgaagccattcttacagggataacaagaattttggccagaaatatagctataattaagcattatcgggtgtggcggttcaaagtgctgggaatacagatgtgagccactgcgcccggccaattgtagaacattttcattaccctcaaaagaaacctcataccaattaactgtcattttccattttcccattgcctattcctaggcaattgctaatctgttcttgcctctatagatttgcctcttctggacattt

SEQ ID NO: 214596 - DNA, 493 bp, Homo sapiens
atcagaggagatagcatatatttgctggtttatgctcaaatatatgcgggtattcaggggaacttaccattacagtagcttgtgggttcacagaagaggtacatctatagattaagaaaggcataactaatggtcagttcccattataagaatgtccaatggattaagagtttatgctgcttttcatattttagccattatagtcagtgaactacgagtaggaaggtagattttgctgttaatgttatggagttatttagtgttcccgagtatgctagttttcatgtgtggaatgaagtatctggttggaacctctgtattaattagttatacttatgttttgtaaaccatatgtcacattaaaaagtttttagtgtttttaaaatcagtttctttgtgttctttacataatgagttgttatattatttactgtaattacatgagtcttggtctgtcgcccaggctggagtgcagtggcatgatctcagctca

SEQ ID NO: 214597 - DNA, 2109 bp, Homo sapiens
agaaatgatagtaaaggttaacataaaaagactataaatatataattgctccccattctaacctcagcttctttaaaatatataaaattatataaggtaataattataagaatatgtcattggggtttgtaacactcatagatgtaatatatataacaatattaccattaaaaaggggaaagggaaggtagctatgtggcaataacatttctatatgttactagcattaagttagtatgaaattgaatcaaactgaatctgattataatgagttaaagtgtgtatggtaagccctaagaaataattaaaagtatatagggaaaaataattaaagatattaaaacactaccttaaaattttacttaatgtgaaagaaggcatagagaggaacagaagaacaaaaaccccatgatacacacacacaaaaatggtagacataaattcaactataccagtaataacattaaatgtgaactgattaaacaatccaatcaaaagagattgtcagactggataaaaaaagattaaattatatgatgtgtataagagacacagtttggaatcaaagatacaaatatattgagagtaaaaggatgaaaaaagatataccatacaaacagcaacaacaaaaatgctggtgtggttacagtaagatcaggcaaaataggcttcaaaatagaaaatgttactagaaatagagacatattttataatgcaaaatggtcaacccatcaggaaaatatattaattgtaaagatatgtgcacctaaaaatagagcacccaaatgtataaagtaaaaattgtcaagaatgaaggggaaaatagacagctcaacaataggagttgaagattgcaatataccactttctttctttttatttttttttttgagatggagttttcactcttgttgcccaggctggagtacaatggcatgatctcggctcaccgcaacctccacctcccgggttctagcaattctcctgcctcagcctcctgagtagctgggattacaggcatgtgccaccacgcccagctaatttttttgtatttttaatagagactgggtttcgccatgttggtcaggctggtctcgacctctcgaccttagatgatccacccacctcggcctcccaaagtgctaggattacaggtgtgagccaccactcccggcttttttattgatttatttttgagatggagtttcactcttattgcccaggctggagtgcaatggcacaatcttggctcaccacaacctctgcctcctgggttcaagcgattctcctgcctcagcctcctgagtagctgggattataggcatgcgccaccacgcctggctaattttgtatttttttagtagacacggggtttctccatgttgatcaggctggtcatgaactcctgacctcaggtgatctgcccaccttggcctcccgaagtgctgggattacaggcgtgagccaccacaccaggccatgcaatacaccactttcaaaaacaatcaagacaagtaggcagaagatgacaagaaacagaagatctgaacaacactaaaaaccaaccagacctaacagacgtatatagaacacccaactcaataataacagaatatacattcttctcaagtgcatatagagcagtctccagaatagattatatgccaggccaaaaacaaaccttaataaatttaaaagaatagaaataatacaaaatatattctctaagcacagtgtaattaaattaataattaataacaaacagaaagaaactggaaaactcacaaataagcagaaatttaacaacacactcctaaaaccaatgggtcaaaaagaaatcaaaagagaaattccaaaatatttgagattaatgaaaataaagacataacatagcaaaatttatggtaagcaatattaagaggagtttttttctggctgcaaatacctacattttcaaaaaagaaagatcttaaataaataacctaatcttctaccttaagacactggaaaaaaaaaaaagagcaacctaaacctaaagcaagccaaaggaaggaaacagtaaagattagagtgaacattaatgaaatagagaatagcaaagcaatagag

SEQ ID NO: 214598 - DNA, 422 bp, Homo sapiens
atctcctgagctcgtgacctgcctggctcggcctcccggggtgctgggattgcaggcgtgagccaccacgcccggccaaaagagggaatattaccattaagcttacagaaatttaacaacacactcctaaaaccaatgggtcaaaaagaaatcaaaagagaaattccaaaatatttgagattaatgaaaataaagacataacatagcaaaatttatggtaagcaatattaagaggagtttttttctggctgcaaatacctacattttcaaaaaagaaagatcttaaataaataacctaatcttctaccttaagacactggaaaaaaaaaaaagagcaacctaaacctaaagcaagccaaaggaaggaaacagtaaagattagagtgaacattaatgaaatagagaatagcaaagcaatagag

SEQ ID NO: 214599 - DNA, 501 bp, Homo sapiens
gtctgtttccttatgtgcaaagaataatagtgtgtatttcctgagcttgtggtaaagatgaaaggtatgaattcgtgtgaagcggttagaaccatggagtaagcgtgtgttggctgtcatcatcactgaggtaggtgctgtcatcaccctcattttacatgtggagaaactgatttctcagaggttgcctaacttgccgatgatggtatagcaataaatcagaacgaagagttgaaccctggctgtttgactctggtatcaggggtatttttctctgtaccttcttgctataccactaggctggtgttataaattcaagataagaaaaacaaaagccaggtatttttcccctggtaattattgtatagatatattatcaaggccagaagttaagtcctgtgttatttctctctgctgtcagctaagtatcatctgtaatgacggaagggaaaatgttacatagataataaaaaatggtggataataaaaataattgctgct

SEQ ID NO: 214600 - DNA, 223 bp, Homo sapiens
ctcagaaaataaaagagataaggcaaagaaaggaaacacaaaaaacaaaagtaaactgaaaaatagaagaagacgataaacaagtgaagttttggtcaaggcactgtccttatctttcactaggagtggtggaacatagaggcagtatctggatggagcggttccattgtgatgatttctggtggccaaaacaggcagctagtgcacgaaagccatcttggta

SEQ ID NO: 214601 - DNA, 466 bp, Homo sapiens
taatacttttagtgtgcatgcgtgtatttctaatcactgttattttttaagtatttgtaaaattagaaaaattgcttttatttcttgaaaagttgtcacatgcttagtttgaagttttactctccagatgtttttgagttgcataaaaatcttgcattcatcattcaaaaaatactaaatttcacatgagactcaaaaatttctgaatgatggaactcagacttccaatacattcatacatgctagagctgaaagtaagcagggaatttcagctctaaacacatttttgagacagttatctgtgagtgaaaacagggtattataacaaaagatgagtttcaatcttaactacagtgtttgttactgtgaatgctataataatacataagtaaaatgagtgtaaatgtaataaattattttatactgctgtatacatatgaaataaataaaactaggatacatatta

SEQ ID NO: 214602 - DNA, 480 bp, Homo sapiens
aaatgcagttagtgaaacaaagatgaagacatcagtcttctcccagagagtgaagaacaggagtgtgaagaggatggttcagagacagagactggtggccaggaggacctagaagatttacaggaggaagaggaagtgtcagatatgggtggtgacaatcctgaagtgggcaagaaagctagaaactcaagcaaatttgagctgaggaaaagcccagttttcagtgatgaggattctgaccttgactttgatatcagcaaattggaacagcagagcaaggtgcaaaacacaggacatggaaaaccaagagaaaagtccataatagacgagaaattcttccaactctctgaaatggaggcttatttagaaaacagagaaaaagaagaggaacgaaaagatgataatgatgatgagtcagttaaaagttccagaaatgtgaacaacaaagatttttttgatccagttgaaagtgatgaagac

SEQ ID NO: 214603 - DNA, 378 bp, Homo sapiens
tggtatatgctgtagtgtctagtgttcttgtagcacttttctcaatccatgtaatcagctttactattacattttagatcatttcattcttcaaacagttaaaaatcttttcactccaggaaagactgttttatttcttctgctgctcactgccatgctaagtaatatgcttattctgctgtttcatgatttgtccaaattttggcactattctttggcttcctactgttgaagatgagaaattagcaattttattttattttatttttattttttgagacaaggtcttgttgtgttgcccaggcaggagtgttgcagtgagctgagattatgccactgcactcgagcctgggcgacagagtgagactccgtctcaaa

SEQ ID NO: 214604 - DNA, 408 bp, Homo sapiens
agctgagatttctaagtgtgttgttagtgttagcacttgtagaaggatgttcattaggaagttcttgtttcagtttttcagagaaactccccattaagaaagatcattcaggaacatggctaccaagaaagaggaaagggaggagggaggctttcagctataagcattaaggggatattgtatcagtagtcttagttctaaagatttgcttctgagaattaattggagcaaatacatctcaagggaagaaaaaaaaagatttatagggcagggacagtagttgtccttgcaagtagaggacacttcattttgcagctgaatcaataccacaactaattatttctggttatcttttacgcatttgtaagacattgcttttgttcagtgtaataaaaaacccattgtttg

SEQ ID NO: 214605 - DNA, 544 bp, Homo sapiens
ttttaaattcccttaacatttgttttagagcttagaaattacattgaaggttatactaaacaggttctgattagtgtgactaaaagtgtgaagtttttaccctctttttaatgtgtaccttgaataagatttgggttgtcttaatttatattcaagtagacataaataggttgcttcacttctcaagatattaagtgaactgttttaaaagacttgcgattaacttctttggtagctaggtaatcacttagttgaacttctgggcaagtgtatgcagaaagctcaagtcaaggaacttgtgagccaccaatataggtactcaacttgctttgaactgtgagtgtttgatgtagacctaaaagtactgtttaatatctgaatgccttaattgtatatttcttactgatagttctgatttttgggttttgcctccttcagctgagtctagagatgtgaaactttagaattattatagcaaaaatagttgctcatggttttggagcacttaactttgtggaactatgcatattcctctcatttaaac

SEQ ID NO: 214606 - DNA, 530 bp, Homo sapiens
cttggagagagatgcacagaagttcaccattacatagtattttgtaataaatgtaagtcaccctaggagcatcaataatagtaaaatgaggtaagataattaggacttgattactctgagtatgcattacctttgtttttaataacatgtacttaattggaagtttgtgtaatttaattttttttattggctgcatttaacagctaactcacaaaattcctaaaaattaacagtagactttcaccagccagtatatgctggctccagcacacccctgagaatggttgattaatatggaatggccatgctgtgtaattttatgcaactatttaaaagaatgaattggagctctataggggatttggaggaatttttacaaagaattgtcaaataagaaagcaaaatatagaaccacagaatcatttttataacacaatgatcccccctcaataaaaccctctctatatgtgtctgtacacattaataaataattgcataagtatccagaatcaacttgatttgggggcata

SEQ ID NO: 214607 - DNA, 431 bp, Homo sapiens
gaactccagtcccctggagaggcaaggaaaacacacacacatctctgacaaatgcacatgagacaggacataacagttactgttcaatggtaagtaggcagtaagaaatccagcactgatcctaatagcaaaagaaaaccacaaggaagattacccttcacacaaaagcagaacctaacttacaaggtaaattacttcaggaacttccagtcacaatttagcaaatgacacaaaacaggagtatatggagagaagaaaccaggatgagataagataatttaagaaaagtgagataaattttaaaaggatactaagaaattaagattgcaatagcagaaataaagccaacattagaagtgaaaaagaaaaatcaaacgagtggtaaaaaagggcaaacttttgagcagttcacataggggacagaaatggtg

SEQ ID NO: 214608 - DNA, 159 bp, Homo sapiens
ttacgtgaaaggtatcctagaacatttgctagaaagcaaagcttgttgcacatctgtccacagaattcatcaagcatcaggccagtgtgtttcagttatcactatgtggcaggcatttcccacacgctgtttaatttccaccagaaacctgcagagagg

SEQ ID NO: 214609 - DNA, 289 bp, Homo sapiens
tcgtgccactgcactccaccctgggcaacagaaaagtccctgtctctgaaaataaaaacagtaagaaaacaggaccatcactcacagcacctctgcctctgccctacctacttgaatgaggagcagggtgtctcagctggtcagagcagcccttgggacatataagcggagataggtagaggctgttggttgctcaacatcagcaggatccgaagcttgaaaagaggtgggaaaatatggtcagctctatggtggtgatggaagtgcaggaaacaagaccgggtaccga

SEQ ID NO: 214610 - DNA, 427 bp, Homo sapiens
cagagaaaaataattactcttgaacatagtactcttaactttttacctcgctggtagggtacattttaagaaccaagaggattacaatgaaatctgaaactttataatagttttattgttggtaatttaaaagctgttttatgtatagtgcagcatcaagcaaattagtatgttcatggtattagaaactaagactttcaggaatagatatggcatacaaatataaagtcaaaaattaaggattttttaagttttagagtgatttatttgggttttattttggagtatggaaatgtggaactagatagaggtggtagttgcacagcattgtgaatatactaagcatgactgaattgttcactttaaagtgtttacttttatgttatatgaattttgcctcaataaattaaaacaattttgttaaaga

SEQ ID NO: 214611 - DNA, 365 bp, Homo sapiens
cttcaccttcagggactcaggaatgctccttgctaaagatttgaatagggccagcagccgctcggaattattcaatagaatcattttgtgggatgcttcagtcctcaagcccttcaagaaaaaaactctgaagagaagtggagggaaaatgttaaaggaccagatgaaattaaaatgcactttacacatctccattcaagtaacactcatgatgtaggtactgttagtatcgtcttcattttgaatacgccaaagcttagagagactaaataaatttctcaagttcttacagggataaacgacagagtcatatccaaaacccatgcatttcctctctggtggaatgaataaaagtgaatattaag

SEQ ID NO: 214612 - DNA, 716 bp, Homo sapiens
gcggccgcctactactactactgctcgaattcaagcttctaacgatgtacggggacatgttctcactaccccaatacttaatatactttgttctcagtatccttgttgttagtaccctgttctcactaccccttttcttagtacccctgaggggggaaaaaaaggatgataatggggtataagtctcaaaaaacttttggattgtttgatttgaactgagtcaaaggtaaaaccagtgttctggagttcgacttctgggtgcaaatccctgttgcatcatttactggccttgtggcttgaataggttattaaactctgtaaaatgggcattaaaatcgtgtgtcattcatagtgttgctgtgaatatgtgagccattccatattgagggttcacacagtgtccagcaactggctaaagtttgcaaaccttacccattattattgtcattgttagtggtatactttgaggctgtcacaaataagcagatatttcttcttgtgagagctatataatcccttagtgtagagaaaaatttaattttgttacaagtgatccaagccaggtatggtggcaagtgcctgtatacccagctgtacttgggagggtgaagtgggaagattgcttgagaccaggggttcgaggctgccgtgagccttgtttgcatcactgcattccagcctggatgacatagcaagaccctgtctccttaaaaaaa

SEQ ID NO: 214613 - DNA, 527 bp, Homo sapiens
tgtctacagatgaggtttccatttgtcaaaaggagatataaaactaagtaaggaattggtagattttctcttcatccactctcagtgctaatataagaacttaaaggggattttttggccgtaattcaatatgacattaatgttagaaaattattcacctaaatgaacaaaaagttttccaaagtaaaaaaattatcttgataatgtaaatttatatgctattcaaacttgaaatgcatgaaacaatttttatggtagtatactttattatgaatcgtttataatttttgaagcaaaaacaatgtgaaatcatagtaaatagtataagatttggaactagacagatataaattcaaatcctacctctactaattgtgttcctatgggcttcttgcttaatcttttggagtttccatttctccatctgtaaagtgaggataacaaaatacttcatgtagttgtgaaaactgaaattagatgtttaaaacacttaatacaacatctgacataataaagcatgctccata

SEQ ID NO: 214614 - DNA, 562 bp, Homo sapiens
tcaatgcagcggactcgtcagatgataatatcaagacacctgcccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgataatctcaagaca
